United States Patent 12,642,819 (COMPOSITIONS AND METHODS FOR TREATING INFLAMMATORY BOWEL DISEASE) - sequence listing, part 54

SEQ ID NO: 22 - DNA, 2176788 bp, Bifidobacterium catenulatum
  modified_base (622788)..(622885): a, c, t, g, unknown or other
  modified_base (697529)..(697627): a, c, t, g, unknown or other
gctaccggcttccttgagcatggttaccgccgatacatcgaacgttgcctgcgcgaggaattcggttttgaaggttccccgattcagatttcggtgaatattcgagagaagaagaaacgcaagtaagtttctatggatggtggccgcacaccattccttgggtgtgcggccaccatccatatttgctagatcagtgcacgccaatcatgcgtgactcattgtcacatgcttaaaacagcggctgttcctcagtatcccgttgacgtagatatccgctgatcgcacgccgcgcgagcgaactcaaggatatgccttcctcggacgcgcgctcccgtgccatcttgccgatggcataggggagtttgattttccattcgtctccgagctgttctcgaccgtcggtgttcttcggtcttcgtccagggcggacggtgtccgtggtctcattcagatcgtcgcattcaagcgccttgcgcgtcagttcggtaagggtgatgccatcatgcttcgcccgctccctggccgctacgccaagttcccgggacagacgtatcttccactcatcctcaagctcggatgagtcaaacacgtgggcaaagccgtcaacgtcgtcaaactgtggctgggcgtccatcgacttcaagacaatcaccccttacctgcatgcgtaagactgacatcctaaaaagaaaacccgaaatcgcatgaattcgggtttttctggtcggaccagcgggatttgaacccgcgaccccttgacccccagtcaagtgcgctaccaaactgcgctatggtccgaacgatgcaaaaagcaccgaacatgaaacatagcacaacctgctctatttttcaaattcatcgtgtcgcacgattcgcgaaacatgataaaagagttcttgggatgtcatttttgtcaagaattttccctttttgccaccaaaagcccccgtcatgggaattttgtcgtagtattgcctaggtacgatgagaacaggacgcccgcacgaaagggaaagacattgactgaggacgcatttgaacattccgccgcaaagatgcgggacaacgggatgaccgatatggccattgcgcaattcaaacgactgtacgaggtttggcgcagtgaggaagcaagcacatggatccgtgaggatgatgttgagcctctggtgggagtgcctagcttccatgatgtctacgagaccatcaaccatgacaaagccgtcgatgcttttgccaaaaccgcgttcctcaaacttaatggtggcctcggcacgtccatgggcttggattgcgccaagtccttgctgccagtgcgtcgccataaagcacgtcagatgcgcttcatcgacatcatcatcggtcaggtgctgactgcacgcactcgtcttggtgtggaactgccattgacgttgatgaactccttccgcacgtcgaatgacaccatgaaggtgctgcgtgccaacaaaaagttccatcaagaggacattcctctggaaatcgtgcagcatcaggaaccgaaaatcggtgcggaaaccggtcttcctgtcagcttcccggcaaatccggaacttgaatggtgcccgccaggccatggcgacctgttctccaccatttgggaatccggcctattggacgtcctcgaggagaagggcttcaaatacctgttcatctcgaattccgacaatctcggcgcacgtccttcgcgcacgctggcgcagcacttcgaaaataccggtgcgccattcatgatcgaggtcgcaaaacgtactccagctgatcgcaagggcgggcatatcgtgcgggacaaggcgaccggccgcttgatgttgcgtgagatgagccaggtgcatccggacgataaggatgatgcgcagaacatcgaaaagcatccgtattttaacacgaacagcatctgggtgcgtatcgacgctctgaaggccaagctgtccgcatatgatggcgtgcttcctcttccggtgattcgcaataacaagaccgtcgatccgaccgatccgacgagcgagccggtcatccagctggaaacagccatgggagcggcggtgacgttgttcgacggggctacctgcgtatgcgttgaccgtatgcgtttcctgccggtgaaaaccaccgacgatttgtttatcatgcgatccgatcgattccatctgacggaccagtacgagatggaagatggcaattacgtcttcccggatgttcacttggatgcgcggtattacaagaacatccatgatttcgatacgagattcccttatggcgttccgtcgcttgccgcggccaattccgtcgacatcgatggtgactggaccttcggcagggacgtgatactgttcggtgacgcgcggctgaccgacacaagtgagccgagttatgttccgaatggcgaatacgttggcccgcaaggtgttgagcctgatgattgggtctgattcgaggggtagcctcaacacgaaaaactgtattttttcgtaaaatagacacaatctgaacgaaaaccctctatcatagagaggtgtgtgcagagcctgaaccggctaggcacttaagatgaaacgttaacgagacgtgaggactaatggcagagggcagtaacggaaggcgtcgtttctccgacaaatggggcaagcacgaacttgatgtattggctgtgctttcctcagctttcccgcaatggctcacttcccgtcagattgcccagcgtgtgaaggcgtatgccgattcctatggggagctggctgatcaggcggcgaaggcggcttttgccaagcaattccagcgtgaccgtgccaagcttgcggccatgggcatcgccatcgaatcgaggcagcctgagtattcatctaagtcggaaggccaggatttcgcatcctatcgtctgcagcttggagatgagcctcgcgttcgtctgctgttcggcgacgaggatttgccgattcttgccgcggccaactatctggcccgttccatgtcgatttcctcagctcccgcacatgagacgcagcatacgtcccgtaccgcgcctcgcgtccctcagactccgactccagggcttggtcttgattccatcgctccgggtctgggaacgcaatccattcccgacgaattggtcaaggtcgttgaccagcgtcgtttcgcggcgactgtagatgttgacggcgagcatttgaacgtcgcctacaccgattccgatgatctggccatgttcgtgctttctcatccgggtgcttccatcgtcagtcctcaggaggctgtcgacgcgttcaaccgccgtttgaatgccgccacgcagttcgtgcctgccgacgaatccacaggaggcgatagctccactgtcacagccatggaaatcaaccgcaacagcgctgacgacgatgcagaggagtgcaaggggcgtccgaagaagaattccgcattccagacgggtagtgaagtcgaccgtcgtctgcgtctgatgctgttcctttcggcgcacctcggcgaagaatattcgcttgaggaacttgcggaacgtttcattggcaaaccgaagtccgatgacgagctgaagaagttcgtcaatgtcattcataaagacatcaacacgctgactacggtttccgacgatggtgagatggcaggaagccagttctttgacatcgactggtcgttgcttgacgctgaaggcattgtttccgccacgaattcgcttgggctggaacgcttggcaggtatctcccagcagtatttgagcatgcttaccgcatcggtgagctatcttgcgcattcgtcgttgctgccggacaagttgcgtgaacaggctgaatcgttgtacagccgtcttcgtcaacatgttgagccgggggacatgccttggctgagtctgaccggttatgagatggaaccgcgtaatttctccattgtgaagagcgcgatctccaagagcttgctgcttgacatggaatatacggatggcgccggaaggacccagcgtaagcttgtcgcgccagataagatcttcgtcgatgagggagtcttctacgttgccgtatggactgacgtcgctgccgctgcaccggctgacaaagctaagtacgtgaagaaagacaccacgatcaacaaggccacaggaaagcctcgcatctggcaggtgcttcgcatttcccgcattgaaaaggccgaactggttgaacctaccgcgaaaatcgacattcccgacgttcccgcatccgaattgcgcaaatggagcttcgataatggaactccagctgtgttcgtcaccaatcaggatgatctgtcatttattgacgggctgtcgggagcaacagtcgagaagtgcggagagggcgagaaggtgcatctgatcgtctcgtccgattcctggtatgtcgcattctgtatttcccacgcacggcatatcactgccgtagctcccgaaacgttgcgtaccatgattgtcgcccgtgcccagcatgagctgagcattggcgatcgtgagaatgaaggctgacgggggagagactatgccttggtggatttggctgttgctcgctctgttcatgcttgcaatggttgtttccggagtcgtctacgcatgtttacacggctatcgagcattcaaggacgtggcgaagctgggtgaacggacggcaaaacgaatcgaggcgatgggcaaaccattgccccaaaacaacgagaatgaagcgcctttctttaccagacctttaaaggatgctgcagatcgttatgcggatgcccatgccggagtcattgagaggcatgaagcgaagcgaagccgtcatgctcaacagtgggcacaatggcgtcattgtaacgattgacccaaccatattaaggaatcatgacccatcatcgtcgtcgtaataacggtattgacccgtcgaaaatcaatgagaccgtggagttgtctcccgcgcaacggtatgccgcattcaaacaaacgcaggccaagcagcgcacggttgcggccgaattcgcaagatccatgccattcgagcttgacgaattccagatgcaagccaacgatgcgttggaggctggcgataatgtgctcgtggcagctcctacgggagcaggcaagactgtcgcagccgatttcgccatctatctggcgcagacgcggaatgtcaaagccttttataccacgccgatcaaagcgctgagcaaccagaaataccatgatctggtcgaccagtatggaacggataaggtcggattgctgaccggagacacgtccatcaactctgaggcggatattgtggtcatgaccacggaagtgttgcgcaatatgctgtatgagcattccgtgacgcttgaagcgcttcgttatgtgatccttgacgaagtgcactatcttgctgaccgtttccgagggccggtctgggaagaagtcattatccacttgccgaaaaacgtgaacatcataggtctttccgcgacggtttccaatgtcgaggatttttccgaatggatcgaatctgttcgtggcaaaaccacgttggtcatgtcggaacagcgtccggtaccgttggagcagcatgtgctcgtacaggcagatgaccataccgaaccagaactcatcgacctatatcggcgtgacgccaatggcgaacagacggtcaaactcaatgcgcagctgataaacagacttgatcagcttgatcgtcaggcggaacggcgcaagggcgagcgacgtcctgataagcgtagggccaaaggtaaaggtggacgatgggacgatcgcccgcataaggtcgaacgccatacgcctcgacgctgggcggttgtggacgagttgaattttcttgacatgttgccgggaatctacttcattttttcaagaaacggttgcgatcaagcggttgaccaatgcatcaacgcaggcttggaactcaccaccagcgacgaagtgcaacaaatcagacggatcgtcgatgagatggtcgaaggccagttgagccaagaagacttgaaagcgctgcatttctcgcaatttcgtttcgccctggaagaagggttcgctccgcatcatgcgggaatggtcgcattgttccgccagattgtcgaacgcttgtttgaagaaggcttggttaaaatggtcttcgccacggaaacgctggctttgggcattaacatgcccgcacggtgtgtggtggttgaaaagcttgagaaattcgacggcaccgggcatgttgggttgactcccggcgagtttacccagttgaccggtcgtgcgggacgacgtggcatcgacaccatcggacatgccgttgtggtggaccaccatggttttgttcccgccactgcggccgccttgtccagcaaacgagtgtatccgcttcactcaagcttcagaccgaccttcaatatggctgtcaatctattgaattccagcgactatgaaacagctcgcgttacgcttgaccactcctttgcgcaatgggaagccaacgagtcggcatggcagcttgaagcacagatggaaaccttatgcaaggctctggaaggatacgagcaggctttccagtgtgaattcggcgatttcaaaaaattcatgcgtttgcggatgcgtttgagtgatttggagaagaacgaacgtcgcaaactcaagcatgaggtgttccgtacgcagaaggaacgcagccaggcgtttatggatcttgacaaacgcatcaagaaactcagagaagaagaccgcgaccatccatgccgtaaatgccctgatgtgcagaagcacttgaaatggggacatcgttgggctcgtgagatgcgcgagttggaacgggtacagcatcgttacgattcgcgaaccggttccgtggcacgtcagtttgatcatatttgcgctgtgctttccaatctcggctatcttcagccggtacgggaatccgcgggccatggtgattatcagctcacggaacgtggccagctgttgcggcatttgtacagcgagcttgatctagtattggcgcaggcgattgacgatggcgcatttgacgggttgaacgcctgtgaattggccagcgtcgtcgcatcgttggtgttcgaagcccgcaggggaggcgggggagagccgcgtcgttaccctggaggcattcaagggaacgtcgccgtgtgcgcagcgcagcttaagggcgtccatgcgtcgattgccatgttatgtgaggatcacatgcttgaggagcctcgccaactcgattttggcatcaccgatatcgtctacgattgggcgcaaggtgaaagcctgtcgcaggtgctgtacggcaccgatctgacgggcggcgatttcgtgcgtaacggcaaacggcttgccgacgtgcttcagcagatagccgtggctggaccgtatcttgcggatcgtgccgaaacgttggcgccagtcgcaaagcaggcgtacgatcgcatcaatcgtggcatcgtcgcatactccggcgtcgactaaaatcgaacatcaagcagacgaataaggaataaaagacacgtccgaactgttctgtagcttagacagagcagacaatccaaggaggcaaaggcaatatggcagaacgcagcctgcgaggcatgagcatcggcgcaaagtcgttggaatctgatgacaatgtggatttcgcggcgcgaaacgacgtcgcatatgtgtgcccaaagggacaccgcacgattctgccgttcgctgaaggcgcggaggttccggaggaatgggagtgccggtgcggcatgaccgcgcatcgtgaaggcgacgaggatcgtgaggccgacgagatttccaagccgacccgtacacactgggacatgctattggaacgccgtactgaagacgagctgaagacgttgcttgaaaagcgtctgcagatgcatcgcgacggctggtttccagactacgagtaaccagtagttgaacgacacttgaactgcatgcccggtcagtaagaccgggcataattgttatctgaacagttcacattgcatcgagcatttaacaaggagtgcattaatctcatgtccgagaagaccaagcaacccaagaaagtcgttctgcttgaccttgacggcacattgaccaagtctgatccgggcatcattggttgtgtggtgaaggtatttgaggaactggggtatccagtgcctgatgatgaggagttgcagcgattcattggtcctgcaattgtcgagtcgttgcagcgcaataatattccggacgacttactcgatgagggcattgccatctaccgcaggtattatgcgcaggaagcggtgttcgatgatccgaataatccgggtcaaaaggttccgggccgtttgaacaataccatttatgacggtatcccagaacagttggccaaactgcgtgctgacggatactacttggcgatcgcaagctgcaagccgcagtatcagtgcattccgatttgcgagcatttccatttggacaccatggtcaacggcatttacggtgccagcgaagataattcgcgtctcgacaaagatcaggttattcaatgggcgttcgaccacattgggtttgacgaagccgctggcgataaggcgctcatggtcggtgaccgttggaccgatgctgacggagccaaagcgtgcggtctggattgcttgggatgcggctggggttatgccgagcctggcgagctgaaagaacatggcgcgtataaggtgatcgattcggttagtgagcttgcgcaaaccatcgaagactatttcgcctgatagataacggctgatgcacgagcggatcatcttgtgcataaagacaaagaaacccctgggtatgcatgccagcgatgacatttgcatacctggggttttgagagatcgcgtacatctcaaataccccctgcacctgctcccacttttgtccgataatgtacgttatgtcagaaaagctacagcagttttcgactgacgctcttttctgtacataacatcggtgggttatgccagcacgtccctttcgggactttgctcgacataacccaccggcatgatggatggtgcgttttcgcttcgatggatgtctttttggctagtccttaatggcttggctgagttttctttccatttcgcttttcatgccgtttcgggcctgcagatacataaacaccagttccgtggcgatgagcataaccatcagtgctgccgacggccaaccaacctgttcgtagaaatgctgaaatttcaaggaaaagctgggtttgaacatcgtatatatcggatacggcagagctccgatgatcagcgatgtgaaatgcaatccgacaattgaccagcgtaccggatatacgtcactcttggtttttgagaagatatttcctcgaattgcagtaatcgaacaaatgttcaacgatatgaccgctgcgacaatccacagcaatgccggcagaatatcaaacatgtattgctcccctgttgtatgtctgtctgtacatatctatctcatatcaacgactcgtacatccgtcttagtccgcatcaaccatacggcatgcattctggtatgttacagtgacgcggcggcgcgtgtctgatgttgcgcctcgaagttctttctcatgcgcattgcagtgatatcgtcaacaggtcggtttccacccatcatggaaggcatggtggtcagatcgacgtattcctcgtgggcaagagtctctctgatctgcttccataaagatcccaccgatacgccgaataccgcccgaccgctttgcaacaacgccaccatttgctcactatccgtacattcgtgcacttgctgaccgtcgcacataatcgtgatattctcaagttgttccgcggtacgctgcgtcagaaaactgatggcagtcgtcacattttgcagattgatgcccgcgtcaagcagtcttttcgacacagcaaggatcaccacgtccttgaacgagtacagcctgcgcgaaccggatccatgcgacggcgtgatggaaggttccacgatttgtctgcgagcccaatagtcaagttgacgataagtgatgcctgctacttttgaagccaccgtacccttgtagccgcgcgtcaccggctgagtgccggtcgcggggaataactccccctgcaccgcagtcgacacatgcagacgcaaccgcgttgttggctctgcttcgttcatcacgctctcctacgacatctacaataacgcccatgagcattcgtgcgaagctcatgggcgcgaagctgttgtacacagtctatcccgcataacgtggatcaaccggcaatgacggctttattgtcgaaataaaccagacggaacttgccaagaataatctcatcgccattcttgagctcctgctgatcaacacgctggcggttcacataggtgccgttcaagctgcccgcatcaataacggaatacctgccgtcagacctgcggaacaccgcatgggcgcgggaaaccgtggaatcatccaaaagaatgtccgctcttggatcacggccgacggtaatctcatcctcgtcaagaagataccgcgaccccgacaccgctcccctagtcgagatcagcaatgccgtgccatcggcaagacgcatgatggtttcaaggtcctctttcgtcagaggacggtctccggtggaagtcaccggtacggttattgcaggaaggccaatgatggtcgtttcacctgcgcttggaatcggatcagtcatagtcgccattctagtcattacccttgcaaatagccggtattgagaccggcatggtcacgaatcatacaccgtaaagtgggtcttatccctcagtcttgtcgataattgacacgaactggtcgtttggcaacatgtcatcatagctgcgccaacggcgttccagctcacgattcgcctcgtcatgctgctgtttgccgagcctggcataagccttcaactcgttcggccccatgtctttgaccggctgattgagattcaatgcttcgtcactcacaagctgccattgtagccgtacaccttgaaagaacacggaaaaagcccggatagtgtgtattccggacttaaaactgtattcgaagttatattcgcggggattgatttcagcgctgctcgtcgatcatttcccgcaatgccttgttgcagacggctcttcttgaattaggagcatcgccggagtgaatggcctcggccaccgcgtcgctctgctgcgtcatcttatagtcttctccctgcgtggactcgatctgggatttatccgcacccatgtatttcactgcataggagttggttgcagctccaatcaagttgcccgcgacaggcggacccgcggttccgcagcgcgcccagatttccctgtgagacaactcatgccttacaacagcatcaaaataggccgtacaagatcctcatccttcaggaactggttctcataattctggaattcgtcgatgcctgcctgaacgagatcatcaggttcatcggtgctggaagacatttgataccatccaatatcaaccgattctttgtagtcagtcaaaatcaccatatactggtgaacataatcaccgccctcctctgttgcaggaacgttggccttgtcgaaaatcgttccatcatggatggtatccgaaccatttgtcgtaggtggtcagaacgagattctcgtactcctgatacaacggacgatcctgcacgtaatagatttcgcctgtggccggcagtcccagcttacctctgagatcctgctcgactttttgattgatgttgcgctgcctggaagtataggcgccatgaatcgctatggcgcccaaacccaacaccacgcaccacccgtttccgacatgccgcacgaaacggcggaaacccaacgaaaccaacaaaaaaaggcggcacgacgtgccgcccgatggtgggtgatataggaatcgaacctatgaccccttccgtgtgaaggaagtgcgctagccgctgcgccaatcacccgatgatgggttatataggaactcacgttccagtgggcgatacaagattcgaacttgtgaccccttccgtgtcagggaagtgcgctacctctgcgccaaccgcccgggtcatgcgtcgcactcgcacatgtcaagcacaacaagaggtgggtacgagagtcgaactcgtctatacggctttgcaggccgctgcctaaccgcttggctaacccaccctaaaggtcgataatcaatcggaaccttagagcggacaacgggactcgaacccgcggtctcaaccttggcaaggttgcgctttaccaactaagctatgtccgcatgttctccgcagtactactgcctgagcacgagtatctactatatccgcattctcaaaatttgcaagtccgcgtgtcgtgttcgtgttttgctgttttcaaagggcttttatctaccgaaaaaaggttttgagctttcttgacattcgggtattttgagatgctgttgtctagatcgggatgccctgctcgtcacattcaccgatggcggaagcgtgtttgcggaaatatgatttcgttatacatttaaagcatgtgtgaggagacgaaaaaacgcgagacaataatgatctccgcgtttgaggggtggaatgacgcctgccaggctgcgacgaacgtcatacggcatcttgtgtcgcgatatgattcacaggaggtgcatcatatcgacaatgagggtttctacgactatcaggtagcccgtccgatgatttgctcggtacaaggtcgtaaacgaatcatctggccacagaccacgttctatgacattgcagtctccccctcgctgcattttctcgctcagatcgcccccgagccaaattatcgttgggaggaatactgcaggcagacgttgcgcatcgcagaagactacgatgtgagcggtatcgtcacgcttggatccatgttcgacgattgcccccacaccaggcctttgccgcttgacatttccaaaaatgactgcgaaagcgaacccgacaaggaatataacggccctgtgggcatccccaacattcttgacgcatttgcggcggacgcaggatttcataccacatccatgtgggtgtccgtaccccattactgtgcgaataccgagtgcttgcagggcacgctggaattggttcgcgcattgtctcttttacttgagcatccgctgactgaaggtgatttgaacagaaaagccgccgaatggcgcaaggctgccgacgagattgtcgagcagacgcatgccggcgattatcttgcctgtctggaacgcgactacgatttgaacgctcaagcgcaacgtatcgcgtcgaatggcatgcccgcttgcgaagagctgattcgtgaggctgaatcgttcttgcgtggcaattaagttgtgattggcgataagcagtgaatatataagtcgggccgaccatcgcaggatgatcggcccgacttttttgttattcgattatcgaattagattcacgctgcagctgcggcttccagcggcgaaagcacgccggtaatcagcagcaatgccacgacgatcgccaagccgatgcggtagatggcgaatgccttgtacgagaaggtggaaacaaacttcaggaagccgatgatcaccacgtagccgaccacaaatgccacgatggctgcggcaatggtaggaccccagccggggaacataccggcatcccccgcggcaacgtccttgacggccgatacggcttccagaatgcctgcgccgaacacggcaggaatggccatgaggaagctcactcgaacggctgcctcacgggtgtatcccatggcgcgtccaaaggtgatggtgcccccagaacgggaaacgccgggaatcaatgcgagcatctggccgatgccgaagatcagcgcatccttccaggtcatttccttcatggtcttgacctgcttggaacgggcgtcgaccacccacagcagcacgccgaacaatgcaagtacggtgacggtgatccacagattacgcagtgacccttcgatcgcatgcttgaacagcaggccggcaatcagaatcggcatcgtgccgaggatgatgaaccagcccatctgcgtgtctggattgtgcgctcccatacggcttttgaaatccttgccttctttgccgaacagggagccgaaccatgctccaagaatgcggatgatgtcatgtcggaaatacaaaatcacggcaagctcggtgccgatctggatgattgcggtgaacgcggcgcccggatcggatcccagcatcaaatcgccgataatgcgaatatgcgcgctggaagaaactggcaggtactcggtcaatgcctgcaccagaccaaggaaaatcgcttggaagaaattcatgaaccctcttttatatgtatcaatggtttcgtctgcttttccgcatccaagactagcgagaggggtctaatttttcgctatggatccttgagttgtctcaaaccatgcacacaatggtgccaaaacccatcggagcttcactaacgattccataaggtctcgcaaatgtggcggatcatgcaaggaaaggtcgggcagcatgagcaaatatcgcaagagcagggcattcagtcctgaaggtttcttcgaatgcgagggccgtggcctgcagtggcttggcgaagcgcaatccaaaggcgggccacgtgtggtagacgtgtacgactggggcaaggattatctcaacattgaacgagtgaacgcctgtggtccgactttgcaggccgcgcatgatttcggcgctgctctcgcacgtatgcatgatgccggagccgattactttggatctgccccagccggatatacgggaacttgttatttcggccccttgcaggatcccgttcccatggacgcaggcgaatgggatgatgtggcgacatatttggccgaaggcaggctccgtccgatggtacagcttggtatgaagcgccgtgaactcactgattacgatatggaactgactgaggccgtcattgaagcgttgcctgaaatactgggcaaggcggccaatgacaagccagcacgagtgcacggcgatctgtggagcggcaatgtcatgtggtcggccgattccggatccgtggaagcggtgctgatcgacccagccgcgcacggcgggcatcgtgaagaggatctcgccatgcttgacctattcggcatgtcgtacttgcgggacattctcgacggataccagtccgtacatccgctgaaagcaggatggcaggagcgcaccacattgtggcagctctaccccatcgcaggccactgcgtgttcttcggcggtggctatgtgaaccagtatcgcgctatgtgccggtcattgctcaaataaacacgtagatatgcctaatgattggctgttgtaggcgtgaggcaatccgcttgctacagcagaaacattgacaaaatagccggttgcttcgtttttgaagcaaccggctatttgatatgcgatctaacgttttctcatcggatgtacgacatgaggatagggaaattcagcgcagtgcatccttcagcttggagaagaagcccttcttcgttccggaagtcgggcgtgcgcttaccgcaacatgttgggcatctgtgtcatgcttttcggcaaaccgttccatcaaggcacgctcgtcgtcagtgagctttgtcggaatcttcactgcgatatgcgccaccagatcgccacgctcgctcttgttgttaagatgcgtgacgcccagattcttcaaggtcacagtgtcgtcaggctggcttcctgcaggcactctcacagactgcttgccatcgaacgtgtcgatttccagatcatgccccagtacggcccagctcatcggcacttggatccagcagtgcaaatcatcaccgtcacgagtgaaggtgtcatcctgagcgatgcggatgtcgacatacaggtcgccggcaacaccgccgttttcacccacctcgccctgattagcgagacgcagacgggtattgttcgtcacgccggcaggcacggacacgccgacattacgggtgatacgcacacgaccatgaccaaggcaggacggacacggattttcgataacggtaccatgtccctcgcaacgctcgcatggagcggtggtcatcatctggccaagcatggtgcgcaccacgcgctgtgcgtagccctgaccatggcagtcggggcactgtgccggctgggtacctttctggcagccggtgccggcgcattcctggcacagaccgaacgttttgatttcaacatgtgcggtgtcgccgaacaccgcagtcttcaagtcgatggtcactgtggccagtgcatcgcgtcccggctgtgtacgaggggtcggaccgccgttgccaccgccgaaagcacctccggtgaacatgttgaaaatgtcacccatgtcgccgaatccgccgctgaatccgccatgcatgccgccggcgttcggatcgttcgggtccacgccggcgtcgaacatctgacgcttctgtggatcggacaacacttcgtaggcgttattgacttccttgaatttgtcttcgaattccggacctgcgatatcgggatgatatttgcggctcatctttcgataagcttttttgatctcgtcgtcgcttgcggagcggtctacgcccagcacttcgtaatagtccgtcacggttgttctttctccctattgcttttcgcgtgtcattgtgccataaggcggggtcagttgttgttttggttttcgtcgtgagccacgaatgcggtcagatatctggcaacggcacgcactgctgccatggtcgccgcatagtccatatgcgtcggtcctatggatccgacgaaggcgatgggctcggtggaatcctgcgctgcagtggtgtgattgcttgtctctctcccctgctcctccgcagtctcgccttttgttacgtcgtcagcggttgccgaggttcgaccgtacccgctggtcaccacggatgcatgcagcagaccgggcgtgtgcgtttcggagccgatggccactccgactccatcggattgcgtggtttcgctcaacgtgctcatgagtttcatgagcacgacttgctcttccagcgcatcgaacaatggtgcaagatcggccacggcacgctggtgcgcgagtcgtgaggttcctgccatatagagttcgctcgcgcgctcgtcgtcggccatgccatcgaaagcttgagcaagcgtttccgccagtttactgatggggcggtattccttgcgggatgacatctgcctgacacagtccgcggttcgcgtcaaagaaacgctggcacactgcgcgttgatttcgttgaccagatgcgacagcactgtggtgtccggcaactcggaaacgttgagtatatgttgcgccactcggccggtgtcagtgatgacgacggccaacagggtgttgattgatacgggaacgatttcgatatgccgtaatgtcgatttcgccaacgacggggccgccacaaccgcgacctgaccggtgatctgtgccagaaggcgggctgcgcgctgcaaggtgtcctgcagattgacggatcccgacagaaaactgttgatgccacggcgttgcgcttcagacatcggcaccactgtggccaagcggtccacgaagtatcggtaccctttttccgttggtatgcgccctgccgacgtatggggttgaataagatatccctcatcttccaaggcggccatatcattacggacggtggccgagctgacgcccagatcatgatctttggtcaaggtggtcgaaccgactggctcctgcgagcgaatatagtcctcgacgacggcacgcagcaccaacatacgtcttgactgcgtcatgcgtgcctcctctttatgtatacgcgatacgattcagcgggagccggttttcggaatatctgcgatattaggagaaaccgtcttccgtaaatacttctcccattgtattagcactcgcaaggcgcgagtgctaatacgttcgcttccagagtactcgtttctcgtttttcccgatagcaatctcccgaaatgctcgtcataccaccaatcgaacagagcaatcgcacgagaatgttaactgtgagcgttaacagaacacaaactaccaaaacacgccaaaaatccaccacaacgtcacctcacatcgctactatggaaaacgcaatgtgagggcgtcgagcgctcggcacaagccggatacgcggcccgaccaattggaaggaaagtaatccatgaccgaattcaaggagaccgagctggacgagcgcgccatcaagatggccaaggtcctgtcggccgacgcggttgagcgtgcgggacacggccacccgggttcccccgtctccctggcgcctatcgcctacactctgtaccagcatttcatcaagcatgatccgaacgatcccaattgggaaggtcgcgaccgcttcatcctttctggcggtcatgcttccctcacccagtacgtccagctgtacttctccggctacggcctgactctggatgacctgaagaacttccgcggcggtgctgacacccgtaccccgggtcacccggaatatggtctgaccccgggcatcgaaatgaccactggtccgctgggccagggcttcgcttccgccattggtttcgcctatggccagcgtttccagcgtggtctgcttgatccggaagctccggcaggcgaatccccgttcgaccacaacatctgggtcatctgcggcgaaggcgatatcgaagaaggtatctctggcgaagctgcctccctcgctgccaaccagcagctgggcaacctgaccgtcatcttcgatgccaaccgcatccagatcgaaggcgacaccaatctggttctggctgaggacgtgctcaagcgcttccaggcctacggctggtacaccgacgagttcagcttcatccagcctgacggctcctacaaggaggacgtcgagggtctggccgacaccatcgccaaggctcgcgaggccgctccgaaccagccgaagctcatcaaggtcgataccctgatcgcatggccgaccccgggcaagaccaatgatccgtcctctcacggctccaagctgggcgccgaagccgtcgcaggcctcaaggaactgcttggctacgatccggaagagtccttccatgtcgacgaagaggctctggctcacgcacgcaaggttgccgagcgcggcctcgaagcccacaaggaatgggacgagaagtacaacgcatggcgcaaggccaacccggacaacgctgccctgtatgaccgcctcaaggccggcgaactgccggagggcttcgacgaggccatcgatgacctcgaggctaccttcgaagtcggcaagggcgttgcaacccgtggcgcttccggttccgtgctgaacgccatcgccgctgtcatgccggaactctggggcggctccgccgacctcggtggctccaacaagaccgatcttaagggcgctgccaccttcgctcctgccgagtgcgccaccaagcagtggccggtctgcagcccgtacggccgtcagctgcacttcggcgtgcgcgagttcaccatgggtaccatcaccaacggcatcctgctgggctcccatacccgtccgttcggtggcaccttcttcatgttctccgactacgagcgttccgctgtgcgtctggccgctctcatgcagattccgaacctgtatgtgtggtcccacgactccgtcgccgtcggcgaagatggtccgacccaccagccggtggagcacctggcttccttccgtgccatcccgcagcttgaggtcgtccgcccggccgacgcttacgagaccgccgaagcctaccgttacttcttcgagaagaagaacactctgcctgcagccatggtgctgacccgccagggcgttccggttcttgccgaaaccgctgagaaggccaaggacggcgtcaagaagggcgcttacgtgcttgtcgacaccgagggcacccctgacgtcattatcatggccaccggttccgaagtgcagtgggccgtctccgcagccaagaccctggctggtgaaggcattaaggctcgcgttgtgtccgccccgtccctcgaatggttcgaggagcaggacgccgagtacaaggaagctgtgcttccggcctccgtcaaggctcgtgtctccgtcgaggctggcgttgccatgccgtggtacaagtacctcggctcctacggcaagccggtttccatcgagcagttcggcctgcagggcgacggtgctcagaacatgatcgacctgggcatcaccgccgagcatgttgtcgaagccgccaaggcctccattgcggaagtcgaagccgccaagtgattcgacggggaggggcatgatgcatgtgcctctccccttttaccgcacaataaataaagatttgatccaaaaaggtatcaaggagaaaaacaatgactgaagcaactcagcgcacctctgactccggtgtctcgatctggctggacgatctgtcccgcacccgtatcgaatccggcaacctgcaggagctcatcaaggacaagaacgtcgttggcgtcaccaccaacccgtccatcttccagaaggctctgagccaggtcggcccgtacgatgcacagctcaaggagctcggcaaggttgacgttgagaccgctatccgcgagctcaccaccaccgacgtgcgcaacgccaccgacatcttccgtgagatcgccgaagccaccgatttcgtcgatggccgcgtctccatcgaagttgatccgcgtctggcccacgagaccgaagccaccgagcagcaggctgtcgagctctgggagaaggtcaaccgtccgaacgccatgatcaagatcccggcaaccctcgaaggcctgccggcaatcactgcaaccctggccaagggcatctccgtcaacgtcaccctgatcttctcgctcgagcgttacgagcaggtcatcgatgccttcatcgaaggcatcgctcaggctgacgccaacggccatgacctgaagcacatcggttccgtcgcttccttcttcgtgtcccgcgtggacaccgccgtcgacaacaagcttgaggagatcggctccgatgaggccaaggctctcgagggcaaggccgctatcgccaacgctcgcctcgcttacgagctgttcgagaacaagttcgccaacgatccgcgttgggctgctctcgaagccaagggcgccaagaagcagcgtccgctgtgggcctccaccggcactaagaacccggcctattccgattgcgtctacgttgacgagctcgttgccccgctcatcgtgaacaccatgccggagaagaccctgaacgctctcgccgatcacggcaacggcgctccgaccatcaagggtacctacgaagagtcccacgccatcatggccaagctcgctgagctgggcatcgacttcaaggctgtcaccgacaagctggaagccgacggcgtcgcttccttcatcaagtcctgggattccgtccttactgacgtccaggctggcatcgaccgcgtcaacggctgagcttcttgcttaagtgttagcgatctaagctaaggatcccccctgccagaattctggcagggggtttctgctattgctctacatgttttcagcttattccggtacgaggcgtaaaaccagtggcctggcggatcgcttgaatcgcctgcgttttgcgcccttcaaaagttggattgtcaagcgtcaccacacggtcggcatacggtgactcctgaatgacgcgtaccaaagtctcatggaaccgataccgatccgaagcccaccgcattgcacggaacccaccatccacatattcggtgatcggaggaatcagcaacaccagatcaggcttctcctgttcaatcaccatatcgaatgtcggcttgcagcttggcgttctcatcggccggcagatagtgttccgcatagacacgcgtaaccatggcatcagtatcaagaaaaaacgatgccatgattggcatgcgatgctattgcatgctcgttctgagagaacttggaaagaatcagccgctcgtaatcgaaagcggtaagttcatcatcgtcaacattgcaggcttcctcaaattcacgggcatactcgaccgcgatcggagcgtcatacaatttcgacaagcgtgtcaccaatgtggttttgccgacggaagccggcccaacaaccaatatgatcgttgtgaactcgcgacggaacgattgattgatcagcggccaccatttgcgattatgctttccgtgcaaatacttgattgcagatcatccgatacggccatagtgctgctcttgtggaaccagacccatgcgccgtaaaaaccgttggccaacatgaccacctgaagaacgaacatcgacatggcgccaggacctccggcggaaagctggttgaaccagataaccaccttgatcacgtcaagaataatccatgcgacccactggctgcggtagccgtatgtcatgagaatctgtccgacgataccaagcggcagcagcgtgccgtcaagccgaacctgtacaccgccagtatggctcgacacgaataccacaatcagatagatcacgatggttgcgatgacggcgagaatgccttgccaccatgtgaacatgcgggcattgacttcctcatactcgttttttcctgacgatcaagctggcgctgccacacccatacgccgacgaactgcatggtgacgtagaagatctgagcgaagatgtctccgacgagatggttcatgatggcaacgatcagccaagtggcacaaccgatgaagccccacagatagttggtcagtcgcccacggtcgacgagaatgagattgaacacgatgcataggccggaaatcagaccaattcaacctgccgcggaaaatctttggacacgaagaatgacaccaactgcgccaacagcatgaccgcgatcaggacaaactcccccggcttgaagtcagtcagctcgcggaacacacgcttcggattgacgacgttgccgattcctttgagcaaatcgttcacaatatcccctttcacaatgaaacgatggctcggccctaaggccggagccatcgtagccctacttatggtcagtatgactataagtatttggggacggagtgtcgcgatgctgcgcgtacttcacaccatgaaagcccttcaagcaatcaaggtcatcatgcctgatgatatgtgctcaagaaatcaccgatctcacttacggtttcctttaacatcgtgatacgtggcagatataccaccctgaaatgatccggattctgccagttgaatgcaccgccatgactgatcagaatatgcttgtcatgcagcagatccaacgcaaactgctcgtcggagtgaatattgaacttcttgacgttcagcttcgggaagatatagaacgccgctttcggcttaactgcggtaacgccgggaatttcattgagcatctgatagaccagttcgcgctgctcgtacacacggccacctggcttgatgtaatccttgacgctctgatgcccgcccaaagcggtctgtaccaccgactgagctgggacattcgagcacatacgcatgttcgccagcatgttcaagccctcgatgtaatccttcgcaatacgcttgttgccggaaagtatcatccatccaatgcgatatccggcaatcatatgcgacttcgacagaccggagaacgttacacagaacaggtccggagccagcgatgcgatagaaatatgctccagtccatccatgaccaaacgatcgtaaatctcatcggagaaaataatgagctgatgttctcgggcaatgtcgacgatttgttgcagcagttcctttggataaagcgctccggtcggattatttggattgatgatgacaattgccttggtcttatccgtgattttagagcggatatcgtcgatatcgggataccattcggatccctcatcacagatgtaatgcacggcggtaccgccagctaaattcacgcaggcggtccacagaggatagtccggcgaaggcaccagcacctcgtcgccatcatccagcaacgcggatagcgacaggttgatgagctcgctgacgccattgccggtgaagatatcatcgatggagacgttcggaatattcttgagctgtgcatactgcatgatggctttgcgtgccgagaacagacccttggacggtgaatatccttcggtttcagggagctgttgcgccatatcatacacgacttcatccggagtccggaatccgaatggcgcaggattgccgatattgagtttcagaatatgcgttcccgcggcttccatgcgtgctgcctcgtccgccaccggaccacgaacgtcgtagagcacattgtcgagcttatgagatttcgtaaaggtgcgcatagtctttccttctgttgattgcgctgatgcaggattgctatcatgttgggcttcatcagacttgattgcgggcaaggtggcgacgttctgctccatgggaacgtcctttcccatcagccagtcctcattgacctgcagaaaagccgcaagaaaatgggcgatatcggcacgcggcacggttttgccgctcacgtactgactcatatgacttttgccaagtttgatattgaacttctcagcagcatgcacaaagtcaatttgtttgacattgcggaacgccatagcgacgttcaaccggttggagaacgattccgccatactagtcctttcagttcaattttcatcaagcgctagttcaaatcctaacacaaaccaactaacgaaattgcggaagttcaatatcaaatgtaactatttcgcatccttttgcgacaaaagttcaattcacgaagttcaactcatgtaactcttgaatatcacgagacatcacagcagattatcttcaatccactgcgccacaccgtcatcattattagatggacagatttcatctgcgatgttcaacacatccggattggcgttcgccaccgccactcccctgccggatttacgtagcatggcaatgtcgaccaaatcgtcaccgaatgagacggtattgctcatcggcgtctcaaaatgttctgccagcaaatccaacgcatgctccttgttggcttgaggattcattaacatccagagcgatccctcagagatatgtacgtcaaaatcgttgggcacaagagaaccgacctgattccgctgctcatcgttagggaagataatgagcttatcggcgatgccttcaggaacatcgtcgaagtcagtgtatcgccaggtctgtgttttccaatatttcgtaacatcgaaattggtgtatctcacatcatccatgacaatgccgacttccataccgggcagttcattcaacagattcttgcagacttcgcatgctcgctgtgaggagaatccgattttcttgagatggccgtcttccggcagcatcggcgaagtgagcatttcataatttgatgaggctggattgaaatcgatcaatgctccattgagataggcaacggcatcaaccggcagtttttccacgaacgaaaagcctgtgctgaccggacgtgccgtttccacaacgaaggtcacgccattatcgtgcatgcggttaatcacatcgatggaacgttgtgtaagaaaacgttcctcgaacgtttcgccatcatgcagcaaagtaccgtccaaatccgcgacgaccatcgtggtttcttgggttttctcgattttcaaagacgtcaaatcaatccttagctcgtatgttgtagacaatactacgataaaaaacacttcggcccatgactgtaatccagtcatgggccgaagcaaaaagccaatcagatgagatcgaacttcgtcatcagaccgagggcaatgatgatggcaacccacagcaccgcgatgatgacggtccaacgattcaggttcttttccgcgacaccggaagaacccgcattctgggtgagaccgccgccgaacatatcggacagaccgccgcccttacccttgtgcatcagaatcaacagggtgagcaagaggctgaaaataacaagaataatctgcagcacaagcttgacgatggccatagcggacacgagtgaacctccagttcgtaaacactgctgttaacaatagcgcaaggtattgagaaaatcgaataatgaccacaccttgaaaggccaactcgataaaaacattactccgcgagcatcatactgtcgcattcatggtgagctggcagattctggtgagctcatccacgttcagcgcggcaccgccgataaggaatccatccacatcgggctcgccaatcaattcttcggcgttctttgaggagacggagccaccatacagaatgcgcacggactctcctacatgcgtgccgaaagtttcagccaaatcatcccgaatcgccttggccgcgtcctgagcggattgtggagtggccaccattccggagccgatggcccatatcggctcatacgccacaatcagacgcgacgcttcctcgtcggaaagatcgcgtgtgacgtcatgcacctgccccacggcgaaatcaagctcaatgcctttgcgacgttcctcgtagctttcgccgacgcaaagaatcggctgcattccggccgccaaaacagcgcgtacctgatccacgatgttcgcatcatcttccggatggtactttcgtcgttcggaatgtccgacaatcacatacaaacagccgaggtgggcgatcatatcggcagacacatctccagtgaacgcgccctgcgatgttacggaaacagcctgtgcgccgtagtgaatcttcaaattgtcggattcgaccaacacctgcacgctgcgtaacgatgtgaaggacggcatcaatgcgatttcacaatggcggtagtcgaaatggatgtcacgaagtttccatgcgagctgctgaacgaaataggtggcttcaagatggtcgaagttcatcttccaattgccggcgaccagtggaattcgttgcgatgccatgtgtttgcctgcctccgttcttatttcattcagtgttcgtacgccgtggtttcgggttagtgaaaacaagaggtgctcccccaccttttttgttgataggggagcacctccggttatgcgttaagcaatcagtcgagcaccttcaggcccggcagttccttaccctcgaggaactcgagggaggcaccgccaccggtggagatgtgcgagaagccatcctccgggaagccgaggttacgcactgcggaagcggaatcaccgccgccgacgatggtgaacgcaccagctgcggtagcgtcgaccagaccctgggccacggcctcggtgccggcagcgaaagccggaacctcgaacacgcccatcgggccgttccaaacgacggtcttggaatccacgatcttgtcgtggaagagcttctgggaatccggaccgatgtccagacccatcttgtcagccggaatggcgtcggcagccacgacttccggagcgatgtcctcatcggacttcgggaagaccgggttcaccacgatatcggtcggcaacacgagttcgacgccgttctgctcagcgcgctcgatgtagcccttgacggtctcgacctgatcctcttccagcagggaggtgccgacctcgaggcccttggccttgaggaaggtgtaaaccatgccgccgccaatgaccagacggttggccttgtcgagcaggttttcgatcacaccgagcttgtcggagaccttggaaccgccgagcacgacggtcagcgggcgttccggctcaacggtagcgcgggacagagccttgacttccttctcgaccagcaggccggcagcagccggaagatcggcagcaacgtcgtaattggagccctgtgcgcggtgcacgacgccgaagccatcggatacgaacgcttcgccgagcgcagcaatcttcttggcataagcggcgcgctcctccggatccttgctggtttcttccgggttgtaacgcacgttctgcagcagaacgacatcgccgtcgcccattgcggcgaccttggcctgggcatcctcaccataggtgtcttcagccagcgggacctcgatgccgagcagctcgccgagacgagcagcgaccggggcaagggacagttccggaacgaccttgcccttcggacggccgaggtgagccatcagaatgaccttcgcgccttcttcgcgcagggccttaatggtcggcagagcggccttgatacgaccgtcatcggtgatcgtggtgccgtccagcggaacgttgaaatcggcgcgaacgagaacgcgcttgcccttgagatctccaagatccttgagtgtcttcatgtatatcctttcctagccgcttgtaagcgtggaatggccatattgccatttacgaataatacaagcccaaacgaacaaaaacaccatactgttcgaaaacaggcatggtgttttgcataaaagattcaatcaagccgactggcggcgcgccttttcggttttctcggcgagctgcagaagtcgacggatgcggcccgcgatggcatccttggtgattggtggatcggccaaacgtcccagctgttccagcgacgcatcagcatggtcgagacgaagctggccggccgatttgaggttgtctggaatgtcatctccaagaatctcaaacgcctgacgaaccttgtcgcatgcttccgcagccgccttggcgctgcgacgcatgttggcgtcgtcgaagttggccagacggttggctttgccccgagcttcgccgtcggaacgctttccggtccactcgcgtgcggagcgcggcgcacccataagaatgagcatacgttcgatggcgtcgggatcgcgcagggtgacgcgttcggagctgcgtagcttacgcggcttggcggtgatgcccagacgccgtgcggtggagaccagtgccagagcggcctcatggttcgggcacacgatttcaagatagctggccttgcctggatcggacagacgtccgttggcgaggaacgcgccgcgccatgcggacttgatctgcgcgattttgccgttgatgatatcgcttggaagaccaagcaccatgttcttggtgtaacggctgtacaggccggtctgcagcacgagcgccgtactgcccttcggcacgcgaatcacataacgctgcacggtgccggttggcgtctgcctagagacaggagtaagcgtggcttcatgaccatacaggttcttgatggtgtcctgcagccaagcagccgcatcttgggagtcgagctgcacctgcacgagaatgtggtgatccaccgagtgcaaaccattgccgaatcgaatcatcgctgtcgcctgcgcctttttggcgatcggcagttcgttatcgattgcggccagctcgcttttgacgtcatccagaagagccaagagccaacctcctaccttgctgttcttccctaaattgcaggcgagtcgcggaatcattccgcactgccacggcttactgtgataccgaatatcttggacaatcacagccaggtttctttacatatggacactattctctcataatacggtcatttttccgctgaccgcttatcaagctcgcgtgcggaaacggaaaccgacaaccccctcgcacgcagtcgcttagccaaagcctcactcatcgcgacagaacgatgctggcctccggtgcaaccaatcgcaatagtcacataatgcttatcttcctgcgcatatccttcaatcgcaatcgaaagcgccttttcatacgagtcgaggaagtccgcggccccttcgctggaaagtacgtaatcactcacctctttgtcgcgtccggtcagcgagcgaagcctgggaacccaaaatggattcggcaggaatctcacgtcggccacaaagtcggcgtcgatgggaataccgtatttgaaaccgaaactgaagatgtgcacggaaaccgtggtcggaccggatccgagcatggcctcatataatttcgtggacagctgatggatactcaatgatgacgtgtcgataacgatgtccgcacgttctttgagattctcaagcagatctcgttcctcgagaatgccgtcaatcagtcgattgccctgctgcaacggatgaggcctgcgtacggattcatatcgtttgatcagcacctcgttgctggcatcaaggaacaggatacgcgttttcacaccaagatcatccagatggctgagcaccgcggacaggtcatcgaaatagtcgcgggaacgcacgtcgacaacagcggcgagtttgtgaatattggatcccgtggtcatcatgtccaccaagggcaccagcagttttggaggcatgttgtcaaccacataccaacccatgtcttcaatgctgtcggcagcatgcgaacggcccgcaccgctcatgccggtgatcagcaatacttcaaaaccttcagccggcgaaggggcgctggcatgcgtgccattcgcctgtacgtcgatgtctttctgtgccatcacagagcctcctcaagcgcgatgcgcatggcttgttccaaacgcgcggtgcaatcctgatcaaccataccgctcggcggatcgtcatcccagattcccgtcatcaaccagacctgcaccatggcctgatacaacagcatctgctcgccgccaatggcgattcctccctgttggcgccatgcctgcatcagcttggtagggcgtgggtcatatacgacgtcgagcaatgttccatgcatgcgcacacctggcattctcaatgattcggcaataccgtccgcagccaatccgggaatggtgtttatcgccacatcagcctggcgcaacgcttcgatggcgtggtccatgccgacaatgctgatcggctgttccgatggcatataccgttcggcaagtggcttgagatcggcgttcttctcaggatggcgagccacaacgatgacatgtccgatcgcagacatctccacgcatgccgctaacgccgacgttgcggtgttgccgttgccgatgatcacggccgttcccgaacggtccgtcttcggcgttatcgcacgtgtctgatacgagtgttcgaaagcgagttcgatgccgcgtacgtccgtgttatatagcctgatgaaggggatgttcgaattgccattgacgcaggttttggtccaatcaaacaccgcggtattggcaaccataagctctttggcccatgtattgcacggtgttccgtatggctggatcgttttcttcaatggcatggtcaggctgagtcccgaccaggtcggatcaagcgattcaagaaagccctcaagatcaggctcgcccacctcatgcttgtcgtacgaccagtcgtcaagatgcaacgcgtgataagcggcattgtgcagcaccggagacaatgaatgtgcgatgggcttgcccagaaccgcgcaccggtggttgacctcggtcatattccctccctatatattcaccgtcatcatgctagcaatccgattgtcttttttcgctacccaatcttattccatttcatctttcggactattcgacgaaatggcattttccgtcgacggttgcccgtcgtgggcgtgcaacgcttggtaaatggctgcggctttggcttttccgacgcctttgacctgctcgaaatcctcgacatccgcctcacgcatggcacgaaccgagccgaaatggctcagtaggcgcttctggtatgcctcgccgacgcctggaatatcgtccaagacggaacgcaacgcgcctttccttctggtctgacgatgataggtgatggcaaaacgatgcgattcgtcgcggacgcgttgcagtagatacatgccttcggattgacgtttgagaatgatcggatagtcgtcatccggcacccacacctcttccaaacgttttgccaatccgcacacggccacgtcatccacaccgcaatcctcaagcgccttcgcggccgccatgacctgcggtttgccgccatcgaccaccaccagattaggcttgtatgcgaaatgatgccgattggtgttctgctggacagtcggttcatgagtctggtcaccatgctcggatgcccgacgttcattatccatgctttcgccggagtcaccggcgatattgccatgttggaatcgtcgcgtcagcgtctcgtacaatgcgctcaaatcgtcgagtgcaccctgtccgtccgctccgcgaatggcgaaacgacgatattcggactttttggcaatcgcgtcctcgaataccaccatggaagcgacctggaacgctccgccgacggtattggaaatgtcgtagcattcgatgcgcaatggagcctgttcaagtcccaaagccttggcaacatcattcatggctgtgctgcgggcgcccatatcgctgatgcgactcatcttgctgcgctgcattgcctgcttggcattatcgttggcacggtccagaagccgtctcttatcccctctgctggccacgcgaatgctcacggcaccaccgcgcaatccgctaagccatgattcaagctcttcacgccgggccggctcgatgggaacaatcacctcgcgcggcaccggagagataggagccaacaaatccgcacgaccggtctgatcctgccgctcgttacgttccctggtagcttgcgcgcgtgccaccgcatcggtcgccgtcacgatttgcgtcgatccgatggcattgcgttgttcggtgacaacagtcgactgcgaagccctaatcgtctcccctgcggtttccgaatacacctgcacaataaggtcggcaatcagctcctcatccgtcacatcctcaacccgttccacactccaattgcgttcacctcggatggaaccggcacgcacgtaaaacgcgtgcacggaagcttccagctcgtccgaatcgacgccgaagaaatccgcatcgacatcggaatcgaacaccacggcattctgctcaaccactgtggatagcatctggatctgatcgcgcaaccgagccgctttctcgaactccaactcgtcgctggcctccttcatttcacgcgtgagctgtgcgatatacgatttgccgatgcgaccggttaatacgccaataagctgttcgcacatcttccggtgttcctcgacgctgatacgtccaatgcaaggggccgaacatttgccgatggacgcaagcaaacatggacgatgagtgatttccgccttatgataaacgttctgcgaacaggtgcgcacaggaaaagtcttgaggagacggtcgagactgtgacgcagatcccatactttggcgtacgggccgaaatatcttgtatcgcggcgtttgcggcttctggtcacccacacccgcggcacgcgttcaccggatgagatcgccagatacggataggttttgtcgtcgcggaacacaacgttgaatcgtgggtcaaactctttgatccacgtgtattccaacgtcaatgactcaagttcggtaccaacgaccgtccattccaggttgcgggccgtcaataccatggtttgagtgcggggatgcagctgatacaacggttggaaataattggtcaaacggttgcgcaggtttttcgccttgcctacgtaaatgaccctgccttcaccatctcgccacttgtatacgcccggctgcgccggaatgtcggatgttttcggacgaaacaggtcacgtgaatcccccagcagaggcgcgccgttcgtgtttacgtctttgccgggagaatcatcaccaccgacactgaaaccgtcgccgttcaactgttcggcggttttgcgccaaacctcctggctgtgccgctcgatgggtgcgctcacagcatgcccttaaggaacttgccggtccaagactgttcgcattgagccacctgttccggcgtaccttcggtaacgatggtgccgcctccgtcaccgccttccggcccaaggtcgatgatccaatcggccgacttgaccacatcgagattgtgttcaatgacaataacggtattgcccttatccaccaatccctgcaagacaagcagcagtttgcgcacatcttcaaaatgcaaacccgtggtaggttcgtcaagaatatacacggttttgcccgtagaccttcgctgcaactcggtcgcaagcttcacacgctgcgattcgccgccggaaagcgttggagcaggctgtccgagtcggatatacccaagtccgacctgcacaagcgtgtcgagatagcgggagatggagggatacgctttgaagaactgggcagcctcttcgatcggcatgccaagcacgtcggcaacggatttgccattgtatttcacctccaacgtttcgcggttgtagcgtttgccatggcattcctcacagtccacatacacgtccggcaggaagttcatttcgatcttcaaagtgccgtcgccatggcatgcttcgcaccggccacccttgacattgaacgagaaccgccccggaccgtatccacggacttgcgcttcaggggttttggcgaacagcgtgcggatcttatcccatactccggtataggtggccggattggaacgcggagtgcgtccgatcggattctggtcaacgtggatcactttgtcgcactggcccacaccttccacacgggtatgcttgccgggcacgatgcgcgcaccgttgagtttgtcggcaagcaccgggtacagaatctgattgaccaaagtggatttaccggaacccgaaacacccgtcacgcaagtgaaaactcccagtgggaagttgaccgtcaaatccttcagattgttttcgcgggctccaaccacgcgcaactgcttggtcttacgtactttgcgacgggactgcgggacctcgatctttcggcggccggcaatgtagtcgcccgtaaccgaacgcggagcgtcaacgagctttttcgcgggaccggaatagatcacttcgccgccatgctcgccagctccaggtccgatgtcaataacccaatcagcgttcttgatagtgtcttcgtcatgctccacaacgatcagcgtgttgccaagatcgcgcagatgatgcagagtggtgatcagccgctcattgtcacgctggtgcaagccgatggatggttcgtcgagcacatacatcacgcccaccaaaccggaaccgatctgggtcgccaaacgaatacgttgcgcctcgccgccagacaaggttttggcggcacgagacagtgtcagatagttcagtccgacgtcgttgaggaatccaagacgggcacgaatctccttcaacacctcgccggcgatctgcgcggccgacccttcaagctgcaagctatccatccatgcgaggcttgtctcagcggacatgtcgcacacatcggcaatggattccccgccaacggtcaccgccagcacttccggacgaagcctacggccttggcatgcctgacaaggtacttcacgcatatacgattcataatactgcttcatctgatcggagtcggtctcgtcatgcctacgcatcagcgtacgcaccacgccttcgaaaccggtggaatattcgcgcatacgaccccaacggttacgatacgagacctgcaccttgaaatcacgcccatacataatggcttgacgggcctcttccggaagatccttccaaggggtgtcgagatcgaaacccatctcatcgccgagcccctcaagcacatggcgataatattcgccggtgcctttggtcatgccccacggttcgatggcgttctcattcagtgtcttgctgggatcgggaatcaccagttccggatcaatctccagcttgtatccaatgcccgtgcataccgggcaggcaccgtacggggcgttgaacgagaacgtgcgcggctcaatctcatcaagttcaagctgatgcccgttcgggcatgcgcgtttttcggaaaaaggcttacggcggtcaggatccttctcatccaaatccacaaaatcggccaccacgatacccttggcgagcttcaatgcggtttcaatggaatcggtcagacgctgacggatgccgtccttgaccaccagtcgatccaccaccacttcgatggtgtgctttttctgcttggtgagtttgatgtcgtcggacagctgcttcatttcgccgtcaatcagcgctcgtgcgtagccgtcgccccgcaagagttcaagcagatcctcgaactcgcccttacgcccacggacgaccggcgcgagaatctggaatcgtgtgcgctccggatactgcagcaacgcgtccaccatctgttgcggcgtctgtgcgctgaccaacgcgccgcattccgggcaatgcggaatgccagtgcgggcaaacagcaatctcagataatcgtaaatctcggtaatcgtgccgacagtcgaacgtggattgcggttcgtggtcttctgatcgatcgacaccgcagggctcaaaccttcgatgaaatcgacgtcgggcttgtccatttgccccaggaactgccttgcgtacgccgacagcgactccacatatctgcgttggccttcggcgaataacgtatcgaaggcgagcgaggatttgccagaacccgacagtccggtgaacaccaccatgcgattgcgcggaaactcaagatccacgttcttcagattatgctcgcgagcgccttggatggtgattttgaggtcgttgggcaggtgcttgaggtcggctgtaagtgaaccgtttttcgttttgagaggggcttttttgatttctcttgcgaggaatgcgtcgctggtgagaacgcgttcgactatgacgtcgccgtttgctgcgttgttgcgtttggttgccacggcttgcctccgctggtggttgttctttgttctagttgtttaggatacctcattttcgttatgatttcgaacaggtgttctatttgtggtgtgttgtgttccattggtgttggttgtggagtattgtcattgcgtcgttgatggggatgcgttcttgttcgattcgtaggtaggttgtgtttttcccggtgcagagttgttcgtataagtttctttcgtgttgtgtgagtcctggtgttggtttggggtcgcgtgttttgaggggttgttttttggtgtcgagtttggtgccgtatggttcgtatgttttgtatgctgtgctgtccatgagtatggagtcgcaggtgatgccggtttgtcgtagttcggagagtatttcgaggccgtctgcgtctatgtctccccagtagatgatgtggggtgtggttgtgatccaaggtagtagtgttttgattcgggtcgccgcgtgtccgctgccgaatatgcagatggcgtgttctgttgtgggtatggcttggtaggtgtctttgttttccacgatgatgatgtgggtgatgtcgtgtggcgcgccgtctgtccatggttgtgtcacgatgaggtctggttggttgtggtgttgtgtgtcgaggagtcggagtcggatttctccgtggcggtcgttgagggctagttgttctcgtttgaggagtttgcagattgctttgcagcggtttgatgttgttttgcctagccattttgcgctgaatccggggatggggaccatgcgtggggtcatgttttcggtgttgtggttggcgaagtagtgtgcggcttgtatgacgaggttgaagtcggtgtcgtcgtggtttttgaggattttggcgatgtttatggaggtgttggagtcgaggttgaattggttggtgatggtgtgtgcgcgttggtgttcgcgttggtagagtttgcgtgtttgtggtgtggtgatgttgagggccgtgttgaggtcgggtatggttaccgagtcgatgagttggctggtttgtcggacgattccgttggagatgattttggttttttcgctggtttcgcagtggtgttgttgtgcccagttgcggatggcttcgtcttgggcgcggatgtgcgtgtaatgggcttcgagttcggcttgtttgggtagtcggatggttttgcgcaatggccaggaggtgttggcgtcatacatgtgcttggtgagatagtcggtgacgtatccgttgagttggctgtggatgtcgctgttggtggtgcttctggccgttgccatgggttatgcctccgttgttggtttcgcgggtgcggtggtgggctgtgtttcgtcctgtgtgatggtttcgctgtcgagttcctgtaggtatgagttgccggtggatgggtctttgtatgcgacgtatgctctgttggcgacgttgaggatttccgcggttttgctttccggggcggagacgatgatttggaagccgagtcggggtagtacggcgagcgcgcgtttggtgtagcggccgtcggctttgatgagtgcttcgtcgaggaagagcgtggtgtaggtggggcgtgcggtgaggtcgccgccgaggaggtagatgagggccgcgccgtagacgaatgaggtgagttcttggagggctccgccggattttccgccggtggagctgatgcgttcgtcgggggcgttgtcgtggtgcacgattgcgtagaatgagctgcgtacgcgtgggtcgaggttgcgtgcgccgtatgctttgatgccgttggtgtcgtgtattttgtcgagttcgttgtgcagtctgttcacgaatgtttcgcagttgttgaatgctttgcgtgtttccgtgggattgtcgcttgcgttgcgcgtccagtcttccagttttgacaggatgcggctgagggttgtttcgaattgtcggtcgattgggctgaaggtcacgtcgagtgatagtctgccgccttgtgggccgaattgttgtcctttgagcatgctgttgatgcggttgagttgttctttgatgttttcttcgtcggtgcgtagcgcgcggttgagctgttggaagctcatgtagagttttttgacgctgttggcgtattcttcgtcggttgcggcgcgggtgacgagcatgttgagttcgtcgagttcgtcgaggaagtatcggtagtcttccacgcttgccatgacggtgttgtcgtctgtggagtggtttttgaggtagtcgtccatgatgcgttccgtgtcggcgcgcagttggttggatctggcgtcgatttcttggattcgtgtgcgtgcgatgcgtgcgatgttgcgtagcgcgcgcgtgtggaatggtgtttcgctttcatggtcgaagaggcctgcgatgagttttggccggtcttgcgcgcgtacggatgcgccgaagcagttctcgtatgcgtcggcgagtaggttcgataccatgctggatagtgtggcgtcgtcgaagtcgtcgttgccgtaggcgtcgagccatgcttgttcggcttggacggcgtgttgggccttgtcgaggtcgtcttcggcttggtactggtttctgttttcggcggtggcctgttggttgagctgtttcagttcggtttgcagttggccgagttccgggtcgttttcgatgcgttcgatctgcctgcggattcgcgtttcctgttcccgtagtccgttcacgtcgattttgctccatggcatgtctgctacgattcgtgcgagctcgtgctcgtcttgcagcaggctgatggcgttggacatttgttcgcttcgacggtcggcgttctgcaacgcctgctccgccttgtcgagttggtttttcagttcggccaggtattgttcgttcatgaagccgatgacctggtgtagtcctttgctgccgtggaatccacggtcgccggatttgatttgtccgtcggcctgcacttgtcgttcgtcatggttcatgtcgtcgatggcgtgcacgcaacgcgcgtcgaaccgtggcgacgtcgtctggtttttcagccatccggcgaacggagagtcctcccggtattgcagtttcgacgacatccagccttcgctggcggaggattcgtattgcatgccggtgtcgatgaaccgccacgtgcgtcgtgtcataagtttcgggtcgatggcgctgattttcgccgcgaatccttgctcgtggcgtttgtcgacgaggatggtctgcgcgatgggcgcgtaggtgacgttcattgccagacgccactgttcgtcctgttcgttcacgtccatcagttcggccacatacggcagttcggacgcgtccaatccggtcgcccgcatgataagcgtgcgcgcgtcgtccatgtcatcgctgatgcgcgtcctgtgcgtgagtttgcgctgatagtcccgtcgtaggctgtcacggtcgcgctggcggtcgtgacgctcccctaccagctgctggaatctggcgttcgcgtccttcaaccgttcctcgtatgtgtcgagcgtttcggcgagcatggcgcgtttggcgtcccatgtctgctcgctgtcgggaagcctgccttcgacctgttcgaatcgttcggctatggcatgacgttgcctgcttgcctcgtcgatgtcctggcgcacgcgttgaagatccttgccgagctgctgcagactgccgccgtcgatgccttggatacgttccttgacggcgtcgattcgcgtgttgagctcgccgacgcgctgcatcgcccgatcgatggcctcctgcgactccttgaccttgcgctgcgcggccggcagaccagcgcgcacttcgctggccatgcgcgagcgcgcccatgcggacagtgttgcgttgccatgttcgctgtcggggttgatgggttcgtattcgcgtcgttcgctggtttgctttgcgtattcgccgtagcgtgtctggatgttttgcaggatggcgacgcgggccattttgtcttccatgctgtggaagttttcgttgaaccggttgtagtcgtcgacggtttcgtgggcgaggcggatggattcgggtatgtcgagcacgccttgcttgaagatgtcgtcgagttttgagggggcgtccgccgattgtattttgtgcaggaggcggcaggcgtcggcgcttaggcccatgtcctgccagatggaggcgtggaatgccgcggcgttggtgtgcgtggtgcattccggataggttttttcgaacatggaccgggtgaatggtgtgttgcggtactggtccatgagtcgtgggtcgatggttcggttccaggtgatgtagcggcggcgtagtccgtcttgtccgtctccggcgttcaggtagaggaatttgccgcaggagagcagtcctccgtcggttttgttcacgtaggtgtcgacgattgcgccccagatgttctgtggggtgccgtcggcgtctttgccgcgcaggaagatcggcgtttcgccgttttcgctatcgcttacgccgatcatgccacgcaggtaggtgtagtcgttgcgttccgaacgtccggagttcgacgccttgttgtagggggttccggatgggtagaggagtgagatttgcgcgtcgacgagtgtggatttgcctgattcgctggcgccggcgagcagggtcaccggcatggtttcgtccatggatgggcggaattcgtgccagccgccgtatgagccccagttgacgatttgtcggctttgtagcatccacttgtcggaaacgatcttcatgccgtctgccatcagtgttcctcctcgtcgaaacggttgtcgtcggtgttgaaatcgaatgcgtcttgttctatgtcttccatgggcctgtcgtccgggccggcgttggtgcggccgtcggcggatgcgttctcgtccgtggtttcggatccgagccactggtcggcgaggccgcggtcgagcaccatgggcaccagtggcgtgaggacgtacatgtcgtcgtcttcgatcggcgcgagatacccgtaggtgcgcatgcgtgagatgatggacgtgattttcttcgcagtgccttcctcgtcgttgctggcggtgaggaatcccgcgccggtggcgagcaatgcgcggatgtcgtcgaagctgataagccagtcgcatggttcggcgttctggttttcgtattccaacgctttgatgcgtagcgcggcaagcgtggcggcctcctcgcgggtgaggctcatacgtgttttcaacgaacggatgcatgtctccgagtcggtgaccggcgacgcgtacatgatgcggtatttcgtgttgtcgaccagtctgagcatgtcgttgttgagcgaacgttccacgacctcacggttctcgcaggcgaggtcatacaggctgccgtcgatgtagcgttcgcgtttgagcgcgatcgcggccatgcgcgcttcgacgggcatgtcgccggtgtcgccgttgaacagcgcggtcgaggcctgctggctgccggcctcttccaataccggctcccctcctgtcaggatcgtttcctcgatgttggcttcgatatagtccgtcatgcttatctctcctcgatgatgtcgtcgagcgtcgtttcggtggtgagaatgggtttggtgcgccatacgcgttcgctgccgtcgatcgatatgcagcgccatgtcacgtatgacgagtcgtcctgcgtgcgcagggcactgaggaagccgaccagttcgctttccctccgttcggctttcggcagctggttgaagcttgccgcgaggtccacgaacatgccgtccgatgtcgtcaccggattgctgcggataagcctgatcatgcgcgtcagccgtggcccgcatatttcgaccatgttcttgaggtccggcgcttcgatggtcgccgctggggcgtcgttcaggctggatgatgcggcgcgcgccattgatctggccggacgagatggcaatgtcgggaatttcgcctgcccggcgtccgtatggtagggccggctttggtcattgggatgggctttggcttcggcgctggtctttgcgaacagctggttgagtttggcgagcatggtccggtagctcgtgtcggtctgctggcgtacgagacggctgaccgcctcgtcggacgtgcggatctgccggcgcacgtcctcgatgccttcatagatgcgtttgagttcggaacgcacctggttgagcagcacgctcggctcgccatccaaataggggtttctggcgatgtcccgcaccgcgtcgtcgatctcgcgccggccttcgtcggtgacgatgacttggaacgcgtcttcgaaacgacgtccgctgtcggattcgcggaacgcgcgtcggtattcgtcatggtatgcggtgaggatgctttccacgctcatggcgccggcctgcatgcgccgtcggagcgcgtcgccgttgtcccgttcagaaagggcgagctcgcgcaggtcgatgggcactcctcgcagagtgttgtgaatcacgccgatgatgtcgccgacctgttcggacgtgagcttttccaaggcctcgctatgttccagctcgtcgatttccttctgccgttcctcaatgtccctcttcagcaggcggatgcgctcgcgcggatcggcgatcaactgcatgcgagcatgctcgatttccatgatgatgctgttggcctgcgcgccggacagcgctttcgtggtgtcctcaagccggtcgagcgcttcgatggcacggtgcgctcgcgctgtgagacggtacaggtagcggtgcgaggccacgtccatggaattggcaagccaggcgtagtcgccttccctttcgcgggcgaggtcaagcaggaccgaatgcgcggcctcgcgcgcagtctgcccgtctttcagcgtgtaatcgccggtttcgatgagccggttgagactgcgtgcgaaccgttcttcgacgatttcgcgcggcagctcccccgtcagcgggtcgaacgtggaacgcaacaacgcgacgtacagcatggaattgttacgcagcagcaaccgtaggacaccggtttcgtatacgggtcgaagccgttccatctcccgtctgatctcagccaacaatacgcctttccatgtgttcgatgccttggcggcaagtctccattctaaacgaaaacaaggaaaagacgccgcagttacagtacgaatgcgacgtcttttcctgtcatggaagagggaacccggccccatctaatttccggctagatgctcatgctcataagctgggccgcatactcctctacgagttcgctgtcccgttccgtccactcgtggctggcggaatcgtccggcacgaaaataatgtcgctgttctcgttcatttgttttacctccgtccgttccgctctcccccggcatcgttgcctgttttggcggaacttctcctagcctctcgcatggattatctcttttcaagagaacgttcacattgtggtcaaacgttttctcaacagaggaggattccagttcggatttcggtcgggatgaattgaggatgacgcccggatttgcggtcggatatgaaaaaagcttccttccggaagctttcgaatggagcggacaacgggactcgaacccgcggtctcaaccttggcaaggttgcgctttaccaactaagctatgtccgcaagttgtttccaccgtggtgggcaacgagtagaaaatatacatgaagcatgccaactccgcaaatcgcggcgtgtcgcgctattttccaacgacttaagccgatgttatgccatggttcgcggagccggtgccaacgatacaaccggcattccgaccgatatcgcccctggtgcgtcctgttgccacatgccttgccgttccacctttgcgtccccgttgctttcttcgccttatggcaggcacccattatccaaccacggcggataaagcaaatgtcgttgggggcgtaagcggttgacacggattgaaagcgactaggcgtcccactgacaacgggcgagatcgactcgcagtccggaagctccggcgttcgagtctttcatcttgcctgactcgcttagttcgggcatacctttcggagagatgaagacaacgccttcctcttcgagcagaagccgctgtctttccggaccgccgaacgcgaatccgggtgccaacgagccgtctcggaacaccacacgatgacatggaatcacacccggctcaggattcgaatgcagggcatagccgacaaaacgcgcgttgcgtggcgctccggccaaagccgcaacctgcccataggtggcgactttacccttcggaatgcgccgcaccacctcataaacacgcctgctgaacaatcccttctccattcgttgtcccattcctcaagaaactagtcgaggatgacaccggcggagagcatttgctggcgggctgcgatgccgagttcttcactgaccggttcggtcaggttttcgatgacatgcacttcaagtccaagcttacgggcgtccagcgcggtttccttgacacagtgcgattcggccaagccaaccacgtcgacgcattcgatacccgcggattccaatgcaacggcaagcgtacgccctgtagccatgtcagaggcgacctgttcgcgggaaggaatcgaatccgtattatcctcgtatccttcgaaccccgaatatgacggcgaatactgtcccttcttgaaatgatgctctacatgcagcgcggcgatcgctggatgaagttcggcgccgggagtgccggccttgccgtgcacgggccacgtatccacatagtcgggttgctccgaccagtgtgagccgggctcgatatgccaatcctgcgtggttgcgatgtattcgtactcgccgcgatgcgcattcacgtaatccgcgatacgttccgcgacggcattgccaccggctacacccagttcgccgccttcgcaaaatgtcggctgcacatccacaatgatcaaagctttcttcatgtttgctcccttccgaatttgcctgctcaccagaataatctgattgttacgcttccgcgcaatctattccatttgcgattgcgtaccacgcggtgggattcacgtggttacaggcgttcggtatgatgttcgattggcgtttggccttatgaaatgatgggcaggccgttatgtgcggcacagccagtttggaacgacagtaacgaaagtgcagaggtgttgaggcatggcaattgaagcgcaggagcttgagattcagatcggcgcgcgcacgttgctgcatcccacgaatttccacgtcgccaagggcgacaagatcggtctggtcggacgtaacggcgccggcaagaccacgctcacccgcgtgatcaccggcgacatgctgcccaccgccggcaaagtgcgtgtatcgggcaagctcggctatctgccgcaggacacgcatgctgccgatccggaacagaccgcgctcgaccgcatgatgagcgcgcgagacatcgcttccatcatcagtcgtatccgcaaggccgaaaaggagatgaccgatccggatccggacgtcatgacccgagcgatgaaccgttacgacaaggccatgcaggatttcgaaaaggccggcggctatgcggctcagtccgaagcgaccgcaatggcggcaagccttggcctgccgcaggaggtcatgggccagcaattgggtacgctttccggcggccagcgtcgtcgtatcgaattggcccgcatcctgttctctgacgcggatacgctaatccttgacgagccgaccaaccatttggacgccgactccatcgaatggttacgcggatacctgaagaaatacgagggtggattcctggtcatctcccactccaccgaactgttggacgaagtggtgaacaaggtatggcatctggatgcgcagctcggacagatcgacatgtattccctcggttggaaagcctacctgcatcagcgcgtggttgatgaggaacgtcgccgtcgcgaacgtgaagtggccgagaagaaggcggaacgcctcatgcagcagggtatccgcctgcatgcgaaggcgaccaaggccgtggccgcgcagaacatgatgcgtcgtgcggagaaacttctcgagaacacgtccgaggcacaaaagcaggagaaagtggcggatatccggttcccggagccggctccgtgcggtcgcacgccgatcatggcgaaggatgtgtcgaaagcgtatggttcgaacattgtattcgccggcgtgaatctggctattgacaagggctcgcgtgtggtgattttgggatacaacggtgctggtaagaccaccaccctgcgtctgctcgcgcatttggaagagccggacaccggttccgtggactacggtcacggctgtaaaatcggctatttcgcgcaggaacatgacacgcttgacctgaatgccacagtgttggaaaacctcattcatgtggctccggaactgaatgatacgcaggcgcgttcgattctcggctcgttcctgttttccggggatgatgcgttgaagccggctcgcgtgctttccggtggcgaaaagacccgcttggcgttggctactttggtgaccagccgtgcgaacgtgctgctgctcgacgaaccgaccaacaatcttgatccggcctcacgagatgagatcctcaaggctatcgccaagtatgaaggtgccattgtgctcgtcacccacgatgagggtgcggtgcaggcattgaaccctgaacgtgtgctgctcatgcccgacggcgacgaagacctatggaacgattcctatctggaattggtcgccgaagagtaagccgagtaattcgagttttattcggattgtatttatgccggacgcgaaaacgtccggctttttctttccacatgcgtttcgagcacgttcggtatttccgtatttgtcttggggtctgcgaacaatctgtgatttgcaagcggccccgactcatgaatcgcatcttgcatgcccattgagggcttgagtcgattcgtttgccaggaagtcgccattgcgatcgtccgaaccttttcggatttcgttatgcgccccctagccttccgcgctcctgttggaacatgacgtgcggaacagaccagaggggccgatgcagcaacacatcgaacgcatagcgaaaggaagttccatgccacgtaacggcaaggagggcattctcttcagtttcatcatgtccgcgatcatgatttatgtgatggcggcactcaattacggcgtacgtatcggtgacgtcggtgcggcggcgtggagctacgcattgttcaactggccgttggcctacgtggccgacatgatttgcgatttgtgcatctgcacgccaagctcccgcgcgattatgaatacattcggcgcggcaaccgaccgtgcggtatggaaaggcatcacggtcaaattcctcatggtggcgctgatgaccgtgttcatgaccgtattcggcgccatcatggcattcggtttcacattcggcgcgttcacgggattctggcgcatgttcccctacaatttcaccatcgcgttgccgattcagatgctgatcgtcgcgccattgtccggcaagatagttcacgccatcggcgatgctgccggatggaacaagtccgcgcaacagcatgttcccgctttggatgtcaagaccgttgccgatgtgatgcagcatgacgtttacacggtagcctcggatgccacggtacgtgacgcagtgcgcatgatgttggaaaagaacatcagcggcatgcctatcgtcgatgacgaacgccacgtggtcggcttcatctccgatagcgacgtactgcgccgcttcgcacaagacaacgcgccggtttccgacatttccacgctggtcactggcatggcccgcggcgaattcccggaactgtctcacgcagaactgcttgatatgaacgtcatggttattgccgcaaagccggccgtcaccgtgcaatcggatgccaatatcgcgcaagtctgccagatgttcgactatcaacagtacaagaaagtgccggtggttgaacaaggcaagctcgtgggcgtcgtcaaccgtggacgcctcacccgccgttccttcgaagcatgccttggtactgccgaatagcaattaaataataactaaatactgcaataagtggagggcgccgaatctgtcaatcgacgccctccactgtttatctcattccttattgcaatcaaaccgaatcatgcgcgatatgcgcaagccttcaccggcttcgcttggtgagcggctcccaaggttcaagctcgaccggctgatcggccagtatttcgcgtgtggcctcatcgagatactccttgcgaatgatcagttcggtaacataacggtcgaaccaagcatcggacgccacataatagccatcctgaccattatccttgccccaactgttctccaccttccaacggttcggccgcccgtcagcatccaaattcacgccagtcaacgtcatggcatgattgcttgggcaatcaccatactccaatcccttggccttgtcgaacgtgaatttcgtaccgaaaagctggtcaacgcgcacggtatcgcaatcaaaaaagccatcgccacgcaacgagaactgcatgcaatcacaagcgaaccaaatcggatgaccgtcactgatctgacccacagcagccttcttgaacacgtcaagaggcacgttcacaaactccatatcacccgcttccgccacattggcggaaaaacgaatacgataccgcttgccaaacggacgactctccatcggcacattgcataacgtgaccagatcgttcacatccaccggcacgtacttcttataaaactccatcggagtgataccgaattcacgaatctgcggacgctcatccttaccggttttcgcagccttttcagacggcccctcccccgcggttttcttcttgccgtcatccttgtcatcactcgtacgcgcaagaaaatcaaaacgctccggaggctcacccaacgcaatcgcacacatgcgatacaccgtggacatatcctcattcttcaacgcacgcaactcatccaacgacgttccagccgcatgacggtcacgcaaatcggacgcgaactcacgtagcttcgtattcaaatactgcttgaacgcatccgaactcttcgaattagccgactccggataagcactcttcggcaccacaccatacttgttcaccaaatcagcgaacatctgccaccaaccaccatcatcggccggaccataattaatcgcctcgaacacacgactatccaacggctcatccaacgtggcaagcacattctccaaatacgtgttcgacttctccatcgcatcccagaaaaacaggtaggtttccgaaaactcgaaatcctccaaatcccaacgatgcatcaactcataacgcaacgtattaagcgccgcaaacatccaacaacgccccgaactacgctgattggtgatgctcccctgcttcagctcgatggagaaatcattctgcagcacgcgctcgcccttgtagtcggtggctgcggcgagcacaccggatgatactgccgcgttggctgccaccagattggcacggtcggcgttgaagtctgtggaatactgtttgagcagtgctgggtcgagtgctttgacgtcactcatggttcatggtcctttcgatatgttcgatttcggattctatgtcgcgcaaacggcaacgcaggtcggattccacgtctacgccgtcacgttgcgctttgcggatgatggcgatgatttcgtcagcgtaaggatgatcgccatcatgctgttcgtccatttgacttgcgcttgttgtgaatgctgtttcaagctgatcgcaatactgcgatttgtgtactctcgatacgattttcgtggcgcgcggcaatgcgccttgcgcatgggagatgccttcgagcacagacttgcgatgcttttccttctgcttcatcgcttcccacaatttcaacgtatcttgcgcattttccggtgctggcgcggaagcgtcggcagcgtcgtctgattggaagacgtgcggatgtcgggtgatgagcttgtcgacgagacgattgcacacttcatcaatgccgaacggatcctgcgcatccacggcgcatacttgcgcttggaagacggattgcaacagcatgtcgccgagttcttcacgcatgttgtctcgatcgttcgtttccacggcgtcgatgtattcgtaggtttcttccaatagcggcttaagcagacttgtattggtctgctcgccgtcccatgggcatccgcctggttcgtgcagaatgcgtacgacctgcttgacacggtccaacgcgctaggcgcatcgcgtacaggggcaagtttcaaacagtgttcgaattcttcgggcaactgataatcatcatgtgcggcttcagtcatgccactgattcttctcgcatgtgccgaccatgcgatcgtaaccgttaatgggcagattcctccacccactggagaattcggtgcgctcatgtgctcgtcagcgggaagaatcttccagtagctggaagattcgggacgttcacagtcacctcagcgtgctggtgatctggtcgacggtttcgccgtctttgcgtgcgacgggctggaggatggtttcgtcctcggatgcgtagtagtagccttcggcggtgacttcggtatcaccgttccatgtgttgtgggtggtgccgtccacgccggtccagcggagcgtgctcgtgccggtcacgttctcgctgatcgagctgccgttacggctggtggtgaccgtgtccacgttctgcgtgtcgccggccttggtggtcgtgccggatgccttcgtggccacgctcagcgtgtagtccggcggggcgggctggtatttgtcgagcacgatcacgacgatgctgcgggtcgagtcgacatggcattccatgatcttgtcgacgctgttcgacggatcgtcgctgaagccatcgccggtgtgataagactgagatccagcgtagttgtaagtgttcggtgcgacgtacttgtaccagttgtccttccatatcttcgcgtcgtagacgccggacccgttccacacgctggtggtggacccgttgccggacgccgcgcccacggccacgacgcggcagtcgccgtcgccctcgcccggatgcctctggcggaagccggccacgcattccgcgttcgcgtcgctcaacgccttggcggccttgccggccgaatcgtccatgcgcacgccccgcgcggccatggcgcggctcacgctgttcaggtccgtcgcggaaccccacgaccccgtcgcgtcgtccttgtaggcccagaactgcgcggacgaaccgcctccgccggtgcctccctggtctccgccgccgcccgcccaggcggtgccggcggtcaggccgccggccaacgtcgccgtggcggcgagcagggccagcgtctttcgccttccgttactgttcttggaacccaatgttccgtctcctttcagagatccatctgcagatgttcaccccactcccggtggggtcggacaggagaacaaatcccgtccgaacacttcacatgcccagccgtcgacaaacgtcgatatcggattcgtttccgtcatccacctgctatgcaacccggtttcgggcgtgtcgggttggacattttcccggaaggctgcggatacgaaaaagggaccccgaagggtcccttgagaagaagagtcgtctgaatcagtgctgaataatgttccctggatgccagctgccatccggctctacgccgtaccctccgctgcttggaacgaagtcgggcgcgctgctgctggaaccaccgctggtcgaacccgacgtgccgcctgaatacgagggcgtgtacgactgttgcggcgccgaatacgactgctgcgtctgggcctgtgcggcggcctgcgcggcggcctcctcctcggccttgcgctgcgcctcctcgtccgccttcgtcttcgccgtcaccgagtcgttgaccttcttcgacgcggccgcgatcttgtccgcatccctggccttgactgccttggacagttcgtcgcgcgtcgccgcatcggcgaccttgccgtccgaatccttcaacaaccgttccgcatcggaaacggtcttctccagtttcgaatcgttcacggccttcaccgcttcttccaagctcttctcgtgtttcccgtaccagccggtgttcttttcaatcaggctgttcttcgactcgtaatccgccttcgaatcggccacgcaggcgaccacgtcaggctcgttcgccttcaacgcttcggccaacgcatccacggtcttcgcatccgccacctgcttcacggtgatctgggaggctgtggccgcgtcgccatccaccagcccggaatacgagtccgccgccttgcggtagctttccgacgcttccacacacgcctgtctcgcctcggccagctcatggttcgcgtaggtcttccaaacgaaccagccgccaccagccagcacagccacggccgcgaccgaagccacggcgatcacagcaggctttctgctcttcttcttgttttcagttacattctttgacccggcatcgcttatattcgggttggaaacttcagatagttttccctgcatacttgtgctttcgatgagttatgtcacatacgttttaggaaaaagcggatgggaatcgttcgttcccatccgcacatcattttctaggattttatggcaaaaacctacttggcgtggcgtgccataagaccgtaacggccgtcaccacgacgcttcagcatgagcgtggctccggcggtaccggcggccataatggtaaacacggcggtctccatcacgtccacgcccgtgtcgccaagcttggcctgcgtggaggtcttcacggccgccctgttcgcactgttcgcactgtccggagtatcaaccgtgatggtcgtatccttcgacggggtgacaaccttgtgggccttgtcgtacgcgtcctgcgcggattccgcgtcggacttcgccgtggccaatgcggtttcggctgtcttcagcgtggcgttcacttcagccagagcagcctgggcggcatccacatcggcctgcgcgtcagccgccgactggtcggcatccttcttagccgactgggcggcatccagttcggactgcgccgcattcgtggccgggtcggaagcatacgcatcatccaccttggattgagcgtcctgcacattctgctgggcattatcataagcggtctgggattcggatacggccgtgttggccttgtcgagcgcatccttcgtcggatcggccgactgggtctggcccaccatcggatcggcggccgtctcatctgccatggcgggcgcggccataccggccacctcggtcaagcctgcgatggtcgcaacggccagtttcttcggattctccatattctccattttctccatcctgtctcccggagcgttatgacaggggcgcatgcgtccccgaatgcaccacccaccctaccactttagggggggggtaagtgtgtctcgcatctcgagataaacaaaccaatcgcatctgagacatacctccacctagacgcctttgcttcaagaaaacgggttttacgatctattagatatgggggtaatccattagattagaggaatcatacgaaaggaaatgtaatgagctatagcattgagcagttcatactggatagcggcatcactcgcgccgaggttgatgaggctaaagctcggatgttggaaaggatgcatatgtatgggctcaaggagacgcataacaagaaagcacatgaaaaggaggagctggcactccgaactcatcggaatgccagctcctcctgaaaaccgtatcgtcgcctcatactctacgtctcataaccataggtacaccgcacaccactacgagacgattttgtggtcggcgcggtagaggtcgggctctacgtagatttcgaaacggaaccacggcagcgcggtacgcacgcttcgttcgattttgttcacggtttcaacatcgtaatcgcggtcgagcttgctggtctgcaccttgacgcacagcagaatgtcatcctcggacatatgcacggtctgcatattcagcagtcgttccacaccaggcgttgaaataacagcctgctcaatcttcttgcgcgtatccgaatcgacggcctcaccaatcaacagcgaaccggatttgaacatgagcagcaacgatcccgcaatcaatacaagaccaaccatcaaaccgccgaatgcatcaaatatctcattatcaaacagaatcgcaagaccgatgccagcccctgcgaatgccaagccgatcaaagcaagcgtgtcttccataatgacggacgcaagctccgccgacttggtacgcctccaaaaacggaacacacccatatgagccacacccgtgcgctccatacgctcgttcgcttccttgatgctttgatgcaggccgtagccttccaaacaagcgctgataaacaccacgataaacgccaccagcagttccatctggttgacgtcacgcagtgcggggtcttcggcaatggcgaacaatttcttcaccgcctccgaagtggagaagaaaccaccgacgaaaaacagcagcgtcgccactacgaacgaagcgagatatttggcgcggtacagaccgaacggatgatcgccgtccgtcttatgcttggagaagcgaccgcctgccatgagcacgatttcgttggaacagtcggcgatggaatgcaccgattcggaaagcatcgcggacgatccggtaaagaacgccgcagcgagcttggcgatggccacaccaatgttggctccgagcgccgcttttacggccgctccttgatgttctgcctcctgttggcgaatatcgttcggattgctcgtactactgtcgttggaatcttgcgattcgttcattgcctttccatttctttctggagttaatacaagacatattcaatcatacatagggtgctgtcatagggtgccacccggattgacacgcttgcaggttcagcgaaaaatcacttccttgcacagcggatagccccacgcgaactgacatgccatagtcaggaacttcaccaacaccgcattccatccgaatgcggaaggcagccatgccagcatgatcgaaccgaacaggtaattccaaacccacagcagcatgaacaaagccacgctacggccgaaattgctggacgatttgaacgtgacattgcggttcatcaggaagttgtacgaagccgacagcacgatggccacgccgttcgcgatggcggatggtacggaaagcacatgcagcaaggtgaacgatccgaattccacaatggtttgcgttgccgacaccaacagatatttgccgagcgttttcggctttttcgatgattcctgattggaggatttcggattatccgacgtaccactttgcgctgccattgcctgccgcccggtcccatcactcatatcacccccccaccgaatcatatgtcgttcaatcgcaaaacactataatgcgcccgtctcatattcccgacgtaatcgtgcatttttctgaaggattgactagtcttccctaggtattttcactgacagcacaacaaggagcatccaatgacgtattcccagaacgcgccgttccgcgccgacgtggtcggctcatacctgcgtccggcagaactcaagcaggctcgcgccgatttcgcagcaggcaagattgacgaggccgcactcaaggccgtggaagataatgccattaccgaactggtcgccaagcagaaggccgccggtctgcacgtcatcaccgacggtgaattccgccgtggctggtggcatctcgactgcatgtggggcttcgccggcgtggaaaaggtgtcgatggacaagggctatttcttccacgatgaggagacccgcgccgaatccgcacgcctgaccagcaagatcgccttcgacccggcccacccgttcgttgagcatttcaagttcatcaagcagttcgaagacgacaccgccattgcacgccagaccattccggctccggcacagctgtatgcggagctgttccgcccggagaacatcgcttccgtgcacgagttctacggcgacacccagaaggattacgacgagcttgccgacgacaacgccaaggccttccatggtctgatcatggcattgtatgaggccggctgccgcaatgttcagctggatgactgcacgtggggcatgttctgtgatccgaacttcaaccagcattacaccgccgatgagttcgccgccatgcaggaacagtatgccgccatgaacaacgccgccatcgaggatctgccagaggatctggtgatcaccacgcacgactgccgtggcaattaccactccacgtgggcttccgccggcggatacgccactgtggccgacgtgcttttcggcaaggaaaacgtcgccgcctactacctggagttcgacgatgatcgttccggcgacttcgagccgctcgccaaggtttccggagataagaaggttgtgctcggtctgatcacttccaagaagccggaacttgaggatccggaagtgatcaaggctcgcattgccgaagcggcccagtatgtgccgcttgactgcttgtgcctgtccacccagtgcggtttcgcgtccaccgaggaaggcaacaagcttaccgaagagcagcagtgggccaagatcgcgctcgtgcagtccgtcgccaaggacgtatggggcgagtgatgatcgcacacgcgtagcgcgcttgtaaaaaacatataaggggctgtttgccaatccaatcgtgactggcaaacagcccctttcgtactgaagcgaacgaaatcctaccgcgatcagccttgcatctgctccgctgcatcgttgatgcaacgaatcgcattcagcgtacgcggatacccgatatacggcatgcactgcgaaataacggcaatcagaaatgctttctcattgcctacgcccatattggccttcgcatgagacgtcagctgcggctcgcaaccgccctgcgcggcaaggaagcacaacgtgatcatttcacgctcacgcgtgctcaagccaccgcgcgtgtagtagtcgccgaagcagttgcaggcaagccacttgttgatgtgtcgcgtatcttcggggccggattgcgtgaatccacgcattccttcaccgaagatttcgatctgcttgtcttcgcccgccctggcacgcgtttccggcgtggtggtgccttgcggttcaagcggaagatgcacgttggccgcgccaagaaagttgttgagtctcttcaggaacggcagggttttgccgaaaccacagtatgcggtcgcctgatacaccatttccttgatggcgatggacgacagtccggtttcgtaggccaccggcagcatcatttcgaaagcatccaagccttggcatccgaccagcacggcaagaatggccaaagagcgggttttgtcatccaaatcaggatgatttgctcccggttcgttcaccacttcgtcataagcgaaattcgagaagaattcaatgaattccggatcggtttgcgacaatgtcctgtcattattccagaacgaattcatccgtttgtgcagctcttcaaacaagatttgcttcctttcgtttgatttgcgcttattctatcgtcggtatattgctcagacctcactgatgcgcagcagcgactttacggtgcggcgctcgtccatggccgcgtacgcttcctgaatatcgtcgagcgtgtattcggaggtgtagacgatgccgggattgatgttgccgtcgagcacttccttgagcagtcgctgcagatcgtacgtgcgcaccggtgccggaccgccgcgcagaccaacgttgcggtagaacagtcctggaatatcggcttccacgccgtgcggcaagccaacgcgcccgactacagcgcccgcacgcgcaaccttcatggcagtgtcgttcgacaatgcggaccctacgcattcaagcacggcgtcggcaccgtaaccatcagtcatttccagtaccttggctacagcctcgtcgccacgttcctccacgaaatcggtggcaccgaattcgcgtgcgatacgttggcggtcggcatggcggctcatggaaatgatgcgggtggcgcccatcagcttggcggacagcactccgcacaggccgaccgcaccgtcgccgaacacgactgcggtgtctcccggcttgatttcggcggaagcagccgcatggtaaccggtcgacatcacgtcagagagggtgagcagcgatgcgagcatttcgtcggagaagctcttcgcgtcgcccggaacgaccaccagcgtgccatcggcctcgggaacgcgcaggtattccgcctggcagcccaatccctcgtctccgaaatatccgccgtgggggcagctggattcgaaaccggccttgcataccgggcacttgccgcagctgaacgggaacggtacgatcacgaaatcgcccggcttggccacggtcacgtcgtcgccgatctgctcgaccacgccgatggcctcatgtccggcctgagtgttgggttccttgctgccgtcgcggtagaaccacaggtcggatccgcacacgcatgcgcgtaccacgcggatgatggcatctcccccatcgatgatggtcggttcggcatgctcttcgcatgccatctgcttgactcccttgaagatcgctgccttcatgagttgctcctttgttatacgaattgaattaaggtaacgtctgcgatgacgcctcgacttatgcgtcagccttgctacgaatctgttttttcactgtttcgatgacatcgtggttttcctccagaagtcgttgcgcttcgtcgtcatggccttccgccacggcacgccaatacaatgttttaagggaaacataggcttgctgcatgcggatgctttcggcttttgcggccaaacgcaacgcctgcgcgtccagtagcgccatttgcctgcgcgcaccttcggttccgtcgaaacggtttttcagatactcgcgcatggcgtcaagcggcatgccagtcgcagacaagcaggaaatagtgaccaacgattgaatgtcttcgtcggtgtaggcgcgatggccagaacttgggtcacgtgcgatcggggcaatgataccgatttgctcgtagtagcgcaaagtggattcgggaagtccggaaatcatggatgcttcacgaatcgtatgccatgttgaagtgctcataccctgcactgtaaaaacttaaagtgcttgaagtctaattggcgtgttgcatgctatctcatagcaaaagaacatgtaatcctgacaattagctaagttgcgtctgcaaagcgtaacttacgtgttcatcgtaaggaacatcagaccacgctgttttggacgaatgccacctcacaacaaaaagctcttatgctgctgagttgaatgaaatcgtgcggattagatgtactggactggaccgtacgcccggatttggaatatttgtaacgatattttggatacagggaaatccatgatgcgtattcggcaaacaacacgtcgtataatacctttcgtcgttcctgcccgagccgcgcaggtcgaggaacggcccacggcgactgccgcgatctccgactcacggtgcacggcatcgaccaacgcaaggattcattatcattatggcgaagccattctctaaaaccgttattcataatacagacgcgaagctgtcgaagcaggtaaggcagcctttgaaaacaaaccaaggaatacacaaggccctcacatggcgtgtggtcgatatcgcggtcggcgcggcggtcggcgtgatgtcgggagtgatgttttgggtgttcgacggcctgtcgtatggtctttttccgttgatgactttgattcttcctggttcagcggcgctacttcatgctttgttctacttccccgccacgctgggctctctgatcgtgcgcaagccgggagcttcggcctacgtgcttttggtcgcatcgttcgtcgaggtggtactcggcacgaaatacagtgtgagcctggtggtaatcgcattgctgcaggcggcagccgcggaagcggtattcgcactgttccgctaccgtcgttggacgctcggcgtcaccattctgtctgctttggcgattggaatcgtctacaacttctacctgctgttcttctactatcaggcattcacgttcttcagcccgcgaggcatcatcggcactatttgcgagctgcttagcgcggtggcattcgccggtttcggttcctggggaatgtattgcgctttacgtaagtcaggtgttctgtcgcgattcgcttcctcgcataaggaacataacgaagaaaacgcctgaaagtacgtttgaaagcatgcctcgaccattttaattttttaatcaaatctcatcagttttactgattaaaaggacgcaacgccggctgcgacgttgcgtccttttatgccatcgcacatagtgcgattactgcggaatcttcgaactcgaaattcccggaatcaatcggcggtgatcagctcgctcgaatccatgtcgaagtcggacatggcaaacgagcggatcgccggatcctcatacgtgttcatgtaatacgtgttagtctttccggaataaccgctggtgaacagcgtgcgctcgaactggccgttgcccatcttggacatgccttcaaccatctgtacggaggccagcgtgtggaacagacgagacacattggcggactcgttgttctgctgtggatagtgcgtgttggtgtaggcgacacgtacgaaacgcgacggcgaactcacgtcaccgggaatgccgtgcatgctcacgccggcgccccatgcgctcagttccgccttgccccaagtggtcggctccgccatttcgttgctcacgcacatgtagttgcgcaggttttccatatggaagtcgaaggtcggttgattggtgagcacatccacatcgtcatgatgaacatgcatgccatcagccatctgctcgatgacgatgctacgggtgccatcgccaatgaaccagtgcagcaaggactcctgctggccgggcacgacctgcgaaacgagcgtcacgtccttcaacgcctcttcgacttcgtcgacactgtcgaaattgcgtgccacccacagcgggaattcgaaagtggcgacgttttcggttccctcgaccggttcgtgcgcgaaggaggcgtatccggggaagttcaatccggcgatggccaagccgtgctcgttggcacaatcgaaatacatggggcgatcggccataaccacgcccacgccgatcaccgcattcggctcgctcttgcctttggccccatacgcatagtcataccggtagcctcgcggagtgaccagaatggtctcgccgtaggagaagctccagtcgagattacggccgaaatatgtgtttccctcatcgtcggagaaacgaacaccagtgcacatatggactcccttccatgatttgccgtgtttttcttgcttgcgtgttcatggtaaacgccgtttgctgggaaaatcttaagttttgcccgtggaagaacctagtctggatatctacgcattctacgacgaccgtgatccgctggatcctcgcaaccgatagcagagtctccgtcaaacgcgcaaattcgaggtctcctgcatgcgtgttagagaatagcccgcctcccgagtccccaaaacacccacccgctggaacaatccgtacgccaactgccttcttggcgggaaggttcccagtgggtggaagattcaggacgttacaagccggccaatgccagaaactttttgtcggactggatgccttgggtgaggaatttgccgtccctaaacaacgcatacgtggtgaccggcgcgggcgtacgttgggcggtctctttatcggtgatatgaatcgttttgaatggaatattgtgctcttccgccgtttgccgcacccgcggaacccaatagcatgtaaacgggcattgatcggtgtagtagagcacgaacccgtcttcgtccaccgcgggatgcttggcgcattccttgaatttcggcagctccgcattctcttcaaaaggcagggccatgagattgatgccgcaatcagatatgtcggtcacttcgaaacccttgtaggacagaaacttcggatcggcaaggaactctcgtttgcgaccctcggctgagagaatgcaaatgcctttgcgcccctgctctttggcgtctcggatgcattcgctcagcagattaccggaatgtccatgacctttcaaagaaccggccacccatagacagttgatatagatccacccgtccgcatcgatcggcacccatgcgttttccgccggaatatattcgatgaagcatttgcctcgttcctcgctacgatagaagacgagaccttcgttgaaacgctgcttgagccactcttttttcgcaaggctttgcttgccggacatggcacagcagatatgttccttgtcgatgttctcttcagtgatgtggatgtagctcatttttcctgcacctctgagtcggggatgctgtatgggcatcttcgttgattcctcgaatatgacaaaagctcttgatttccaagggctttcaaatggctcctgcgactgggcttgaaccagtgaccgtccgattaacagtcggatgctctgccaactgagctacgcaggaatgcgctgtgcacaagacaaaaatattacaccaaaacttgtggatttcaaatcttcagcgtgtcacatgtgtgtttcgacttgcaaaacgtttccatacgatgctttcggcctaatcttacatggagatcttcgtcaacggcatggccgaatcgatggcgaaatccgggtttgacggagccactcccgcttcgaccaggttgacgcccagcatggccaccatggcaccgttgtcggtgcacagtttgagctgcggcacacgcacctctaccccatgctcggccccgacttccaacagtttggcacgaagctgcgaattcgcggagaagccacctcctacaatcaacgtcttcgaatcgtactgctcgcagccgcgcatcgccttcttggcgagtacagtcgccacggaatccgccagcgacgcgcacacgtcatcgacgggaatctcattgccttgcgcctgctgttcctcgatccaacgcgcgacggccgttttcacgccggaaaagctgaaatcgtacggatgctgctggcccgctttgccttgggtgagtccctgcggcactttgatggcatgcgggtcgcccaactgcgcatgacgatcgatatgcggtccgcccggataggggaaaccgagcaggcgagcgaccttgtcgaagcattcgccggccgcatcatcaagcgtggtgccgaccacgtcgatatgacgtgcgacatcctcaacatgcagcaaggacgtgtgtccgccggacacgatcaaggcgagcgtgtcttcggggaacgggccgaactgcaactgtgtgaccgcaatatgcccgatcacatggttgatgccgtaaatcggcttattcgccgcccaggcaagcgatttcgcgccggacacgccaacggcgaggcagccagcaagtccaggacctgcggacacggcgatcgcgtcgacgtcagacaacgtcatgttcgcatcggccaacgccttggaaacgcatggcacgaacgcttcggcgtgggcgcgtgacgcaatttctggaatcacacccccgtaacgcgcgtgctcatccatggaggatgcgacgacgttggaaatcagggtgcgcccctgcactaccgaggccgcggtctcgtcgcaggtggattcgatgccgagtacgattggtccgctcattgctgctccgttcgctgctttgcttgctgttccgtttggttgttctgtttattgttccgctgctgcgaagccgacgatcctcggctcaaggtcaaggctcatggtgtacgcgtcgatgccttcgggctggtagtagcgtttgcgcaatcccattttggcaaaaccgaaccgttcgtacaatgccaaggccggagtattgtcgactcgcacttcaagcaacatgcgtttggccccctgctcacgtgcccgcgcaatcaacgcctccatcaacgaagccgcgattccctgccgttggaaccgtctgccgacgccgatcgtcatgatttccgcatcgtcgccgtcataccagaaaccggcatagccgcgcacgacgggctgttgtctagcagaatcgcctgcaaccgatccagcaaccggctcatccgcggcaacgcaacccgcaatcccgcaatccgcggtcttgccgtcatcatcaatatcgaacagatacgtgcgtgctggcgcttggaattcctggcgaatcgactgttcgctccacgctcccctgccgaacaggtccgcttccaaagcggccatctgcggcactgcgatctgttcatcgatgcttgtatggtcaacgatcatgccgtatcgtcactccgtgcgttccgcgccggcatggttgagtacatgcttcaacgggttcggcaccgacacgtccggcctgcgcaaatacaacggttcgaccggctccggattcaccaaagactgttgcgaagtggcgaaggccgcgaatcgttccaatccggacgcgccctcgtcgagcagcgcctgatcgcgcacttcgccgccttcgggaaggcttgcccacgattgcgcgtatttcgccgctccatggccgacgacgtcgaccacatattccacgttcggatcggcctggcgaagccgttccagcacctcgttgacacggttcgcaatcgattcgggatagtcgatatccatgtcgatcagggtttccacacagccgttttcaacgtttgcgtcatggtcttcgcctgcgctgccaccggcctcatagccgctgccatccaacaatgtgaaatacagctgcttgcgtcgcgcatcgttcacggcgagcgtcagatgatggcggccgtcatgctccgcgttgcgcacaagcacctgcggggaaagcacattctgcccgataagctgtgcaccggtggcgaaggcgagcgctttggctgcaacgattcctgcgcgtagtccggtgaagggtgcaggtccgatgcctacgatgatgcggtcgatgttttccggtttgaggccggcttgttccacggttgtggcgatgttcacctgtagtttttcgacgtgggtgcgtgagtcggtttcgacgatggggtcgtgtccgaccatgccgacggttgagccgtatgaggtgtcgatcaccagtgtctgcattttgtggaaactccttatgccaagctgggaactactgtacaaccgatgctggaatcgtgcttgctgctggtgttttagcggttgttgcgtgtgatgtcgaaggtttgccaggatgcgccgacgggaatgaaggttacggtgcgggtgccgttgctggtgagttcgttgtcggctctgcttgtttcgtctgtgctaacggtgttgagtggccggtcgatgtggatttcgaggcgttccggtgcgagcgcggctgccatctgttctccccattccatgaggatgatggtgttgtcgctggggtcttcgagttcttcgtcgagtccgagggattcgagttcatcgagtagtcgttcgatggcattttggcctggggcgtaggcgttgccgccgagtcggtaggcgtcgacgtgtatgaggtgggcggagttaccgctggggaattggcctttgagttcgcgtgcgatggtgaaggttggcgagacgatgggttcgctgatgttgagtcctgcgccgaagccttgtgcgaaggtggtttttcctgcgccgagtggccctgagaggagtatgacgtctccgccgtgggtgaggtgtgcgacttgtttgccgagttcgcgcatggcttcgccggttgtcgcttcgacggtgacggttttggcagtgccttcgctggtgttttcgttggcgtcagtaatggttgcctcgctcatgttagttggttcgtcctttgctgctgatcagttcgatggatcgttctagcgcgtagacagggtccgatccgttagttttgctttgttcgtcggcccatgcgagcatttggatgcatcgtctcatgccgtcggaggtccatccggagagctgtctggtggcgtttttcagcacccatgaattggttttcgcttccgcttcgctgatggtgccggagcgtacggctgaggctttggccatggtgcgtagtttcatggcgagcgctccgatgagtgcgattggcgcggtgccttgttctattgaggcgcgcatggcgatgatggcgtcggcggcacgtccggagagtgcgaggtcggcgacacggaagccgtctacttggggatttgctgtgaggtattggttgacgcgttccaatgttatgggattgtcgtcgaagtcgaagcagagttgtcttgccatggctgcgagttcgccggttttgtcgccgagtacggccacgagttgttgtgcggccatgggttcgatgcgtcggttgcgtcgttcgaagcattgtatggtgaagttgagtttcgcttcggcttttttgaggtcggctacggtttctttgacggctccggctttggtgagttggtcgatgagtcgtttgcctttgatgccgccttcgtgttggcagatgacgatgctggcttcggctggattgttgacggcttgcttgcagtaggcgaccatggtttcgccgagtttgtcgtcggcgttttgcaggttggatacgatgacgattgatcgttcggagagcagtgatgggcttaccgcttcgtcgaaggcgtaatgatcggcgttggttgcgtcgagttcgatggtttccgcgtcggggtgtttgcgttgcgcttggtggcgcaggtcgcgtacggtctgctcgttgaggtacgggtcgcctccgtagatgaggtggaagggcgttgttgcggatggtttcggcatagtattcaatctcgctgtatcggtggacaagattcattcgttccatttcatggttttgagcgcgttgtaggttcgttcgccccatgctttcgcccgttcgatcggattgtgtatgaggcgtcggcccggcaggtttggttccgttgtggtgatgcgggcgaagagtgttccggcgaatcgtgcggtcgtgtatccgatgatttcgacgaggatgatcagtagcgcgccgcctgcgtctccggtccatggaatggtggcgtggtctcctgatccgaggttgagggccataaattccatgatggcggtgccccatgaggcgaggctggcgaatatgaacccgaggcttggcagtatccatgagatggcgagactggcgagtccggcaagtgtggagaatcccacgaagggtgcgacgaccagattggctggaatggagtagaccggcagttctggttcgataagcacttggatcggcagggtgaagagttgcgcggcgatggtcatggccatggtttgcgcgatgaatgccggcatgatcggtgtgagccatgcgcctaacggtcctgcgaacagtacgatgccaagtacggcggcgcatgacaatgcgaatccgaaactgcgtgacatgtgcggattgaccatgagcatgcccaacgtggtccagctgagggttgacagggcttgcgttcttcggccgaggaacaggaagcccgctcccgccaaacccatgagcagggcgcgcgacaccgaatcggatgggaacacgcacatcgccagcatgatgtacgacgcgccgatggcgatggccgtgacgcgtttgggcagcagcaggaacgagcagacggcgcgcaccagggtggcgacgaccgcaagatgcccgccgctgaccgccatcagatgcagtatgcccgaacgttggaaggcgttttcaagcagattggcgtatgtggaatcaatacccgtgcccgtctggccattgccactatctggaggaacgtaatcctgcccaagaatacctaaggtcaggccgggaacgagcactttcccttggtcggaaagccgtgacgtctgttcgaagaacgcctgctgcatcatgccgatcgtgcgcaatgcgaggttcggtccccgtatacgttccacggaggcgatgtccgtcagccatagcggcatggcaccgtattgcgatatggcgagcgtgccccgcatccggtattcgccgccttgtttgagcgtgccgcagtccggccggtccgcatagacgcgcacccgcatcatgcttggctgcgtgacctggcttgccgtgatcgttgagatcgtcgcatcaatctggcaatcgtttgcacgtctgttcgaattcactgcgggagatgtcgtacgtaccagcgtgacaacgtcgctttcgccgtttctggccgcgtacgaggccgcatccctccattgcaatacgtcgtaggtcaacgcggaagacgcgcatgccatcgccgcgaccacgcatacgataatgctgaaatgccatgccgagaccgcccactgcacgccaaccggcactcgcagcataggcgatcgcaggaacggcaatcccaataatcccaataatgccagcaacggtaccgccaatgccacaacgagcggcagcatgccgaaccgaccatcccgttcgacgcaatagtcgaatcccatatgcgtggccaagctcgccgcccacccgcatagggcggccggcagcagacgccaatccctgctcccctgctccccatcccgccattcgaacgtgtttcctctcatcgtgcgcacacttggtctcggaatttcgccagcgttttctcgccgatgcctttgacttccaacagttggtcgacattgtcgaaacggccgatctgattgcgatagtcgatgatgcgttgcgcggtcacggggccgacgcctttcaaggtctgcagttcgtcggatcctgcggtgttgatgttcagcagaccgtcagccggatcggcgggctccgctggtccggatgttggttcgctctggctgtcgggttccgtggatggctgctggcttggtgttgtttgcgtggacgccgtcttgtctttctcggttccgttcgccttcgattgttcggattgggtgatctgcgattgttggagcgcactgtagtggacggcctgttggatgagcatggtcaggcttgcgcagagcgcgcacgacagggtgagtatggcgatgaccgcgtggattggttggaagacgagtcgtggacggtcgcgtttgggccggtcctgttcagtcggtttgtcggaaggcttgacgccggccagatcccgcaatgtgggttttgcgggttcaggcgattgttcagttgtcgcgattgcagtggacgtttcagccgctgcggaaatctcggatattgaggttgtttcggatatcgcgggaacagcatgttcgttgcgaacgttctgcccgcgcgcgttctttccacgtgtttcgggcatgccaagtccgcgcagccgttgcgcggactgcgatgcggtttcggcttgcctgttgcgcctgcccggcggggtaacgataatgcccatgcatccaaaatggaggatgcatgggcatgttgtccagtcgaaacggcccctgtggtcgaaggatgggagttatccacatgttcggcgtgtcgccttatgcggaaacggttcccaccctgttggaagcctcgtcaaagatctcgccagaagccgttggatccgtttttcgaaatatcattccgcaggaacgatggacacgatcttcggagccttgacgatgaccttgcgcggttccttgccgcccagacgatcggcgacggcttccaacgccatcttctcaagttccttaggatcgatgtcgggcgagacctcgagcttggcgcgcaccttgcccttgatctgcacgaccgcggtgacggcgtcctggccgacatagcgttcgtcggccttcggccattcggcgtgggccaacgattcgccgtgtccgagcttgttccacagttcctcgcagatgtgcggagcgatcggggaaagcatcagaatcaacggttcgacggccgcgcgcggcacttcgttgaggctggtcagatggttgttgagcacgatgagcttggcgatggccgtgttaggacgcatcgcttccatttccacggtcacgtcggcgatcgtgttgttcagcagcttcagcgtcttcgtgtcgagcttaccatcggtgacgcgcacttcgccggtgttctcgtcgacgacgttgcgccacaggcgctgcaggaagcgcatggatccgaccacgttgcgcgtgttccacggacgggattcggccagcgggcccatgcccatctcatacaggcggaaggtgtccgcgccgtagttcgcatacatgtcgtccggcgtgatgatgttcttcaggctcttgcccatcttgccaaactcgcggttggcgtgctctccgttccaggtgaaggtcggctctccgttggcgtcggccgggccttccaccacttcggcggccggcacgtactggccacggtcgtcggtgtaggcgtatgcctggatcatgccctggttgaacagcttgtggaacggttccgcggaatccacgaagccgaggtcgaagagcaccttgtgccagaagcgggagtacagcaagtgcagcacggcgtgctccacgccaccgatgtacaggtccacgccgccggacttgccagtggtctcgttgtggttcgggcccatccagtagtcgaactcgctcttctccaccatgtgttcggtgtcggtcgggtcgaggtagcgcatgtagtaccagcaggatccggcccagttcggcatggtgttggtgtcgcggtagtaggtcttcttgccgtcgcccaagtcgagttcgaccttcacccaatcctcgttgcggctcagcggcgcttcaggattggattcggcgtcttccggatcgaaagtcttcgggctgtagtccggcacgtccggcaggttgatcggcagctggtcgtccggcaacagatgcggggtgccatcttcgccgtagacgatcgggaacggctcgccccagtaacgctggcggctgaacagccagtcgcgcagacggtagctgaccgtgcccttgccgacaccagcctcttccagccatgcgttcaccttgtcgatggcttcgtccacgcgcagtccattgaggctcaacgcgtcgcccttggcacgggtggcgtccacagcggagttgatgacgatgccgtcgtgggagacgaacggagccttgccctcatagttggccagatcgtcgccggattccggcagcggctgcacggtgtaggtgaccggcagaccgaacttgaccgcgaaatcgtaatcacgctggtcgccacccggcacggccatgatggcgccggtgccgtaatccataagcacatagtctgcggtgaacagcggcagcttggctccggtgatcgggttgatggcgtacaggccggtgaacaggccggtcttctcgcccgcctcgtccacacggtccttggcggtcttggattccgcggccatacggtaggccttcacagcctcgaccggagtggcgtagccgcccttccagtcttccggagtctcggacggccattcggcgggaacatcctcgagcagatgatgctccggggagaccacggcgaacgtggtgccgaacagggtatcgggacgggtggtgtagatctccatgtccttgacgccgttcggggtttcgacgtcgaaatgcacggaagcgccgtgggattcgccgatccagttgcgctgcatgagcttgaccttttccggccagtcgatgccgtcaagatcttcgatcagacggtggccgtatgcggtgatgcgcatggaccactggcgcagctcacgctggaacaccgggaagttaccgcgttcggacttgccttcggcggtgacctcctcgttggcgagcaccgtgcccaggcccgggcaccagttcaccggagacttggagatgtatgccaggcggaagtcgttgagcacgtcggcctgctcggcttcggtcagatcattccactgcttgcctgcgaatcccggaatctcacgctcgccggattcgaactgctccaccagcgtgctgatcgggcgtgcgcagcccttggagccagacgggttggtggcatcctcgtcgtaccaggaatcgtagatgcgggagaagatccactgagtccaacgcacatagcccgggtcaatggtggcgaaggagcggcggttgtcgaagctcaggcccatacgatgcagctggcggcgcatgttggcgatgttctgctcggtggtgatgcgcggatgctggccggtctggactgcatattgctcagccggcagaccgaaggcgtcgtagcccatggcgtgcaacacgttctcgcccttcatgcggtggtagcggctgaccacatcggtggcgaggtagccgagcggatggcccacatgcaggcccttgcccgacgggtacgggaacatatccatggcgaagtacgacgggcgtccttcggcgttgcgacccttgccgtccttcagatcgccattgacgttggcggcccagaaggtgccttcgtcatcccaaatcttctgccatttttcctcaatgccctgagccaaatccgcgttgtaacggaacgacggttcggctggttcgttcgactgcgtctgcgcgcttttctcaatgtcactcataatgcatgaaactagccgcgcaactggacacttcgcaaggcgtcaatcattatgcaagaagcgttttgcaaagcgtcacgcaaggcgggggccgtcagccttccgacgctgccgagagcgttatcgcgggagggttgagcgacatgtcgggaacgtagccgatcgactgtttcatcttgtctatggcctgcttccacgagccgtcgtccatcatggactgcaatgcggcgtcgatctgtttggccagcgtggattggccggatttgaccgcgatcgcgtacgaacgttcgccgaacgtttcgcctacgaccttgagatatccgcctcccctgttggatgcgaggcccgccgctatggcgtcatctgccgcgatggcgtccgcctgcccgatcatcaatgccgtttcgcattgcggatacgtgtcgcgttcgctcacggtcacatcttccgcaagatttcgcacgctgtaggagggtattcctcctttggccacgcataccgtccttccggcaagatcatcggttccggtgatggttcccgcactgtcggaacgtaccaacaatgccgcatgcacagtcagatacggtcctgcaagctcaacctcaccatcctgaacgtcatcagcggcgaaagcatcgaccaccatgtccacggtgccatcttcaagtgacgaaacgcgcgtcgacggcagcacctgtttgaacacgatctgttttttcgcgaatcccagcgtgttcgccacatattgcgccacggaaatatcgaaacccgaatactctcccccatgcagaaaacccaaaccaggctggtccgcggccacgccaatcgcaatggtcggcccctgcgcgagaccattggtcactacggaaatggaagtgccgcacgcgctcgtgcccaatacggtcgaagcggcgcataccagcgccgcgatatttcgtgacagacgtgacagacgtagcatacgcgcgattctacgcgattctacttgaacatgcgcgaacgcgtcaggaaccaggtgacaatggccgaaacgaccagcgagattccgatgatcacggcgaagccccacggcttgtccgtcaacggcatgcctagcatgccctcctggaagttcatgccgtacattgagaagatcaatgtcggaatcgacagcgtgatggagatgatcgtgaagatgcgcatcacgttgttcagattgttcgacacgatcgacgcgaacgcgtcggtcatgttggcaagaacgccgctgtagatgttggccatctcgattgcctgcttgttttcggtgatgacgtcgtcgagcagatcctcgtcttccggatactgcttgatgcgcggcagcgtggtcagcttttccatcacgatttcgttcgatttgagcgacgtggtgaagtagaccaacgttttgctcagttcgagcagcatgagaatctcacgattctgcatggaatggcgcagtttgagttcgagcttgtcgctttcgcggtcgatgatacgcagataccgcagatacatggtggcgttgcggtacaggatctgcaggatgaaacgcgttttcatatacgtgttgaaaccgcggatcgtaccttccatgaacgggtgcaacaccggagtgtcctgcatgcagacggtgatgatggccgactgcgtgatgatgatcgacaacgggatggtctcgtaccagtctcgcccgccgcgctcttcgacggttggaatgtcgacgatgatcatcgtgtaatcgtcttccacgtccacgcgggagcgttcttcgtcatcaagcggggcgcgcaggtcggcgagatcaacgccggtttccatggaaacgttggcgagttccacatccgtcggatccgaaaggcataaccaagatccgttttcgggtttttggatctgctccacctggccgttaatcgttctgaacattctcaacatgtctctcacccgcctttcgcgctttccgacgttctatcgctgtacggcagcccgaatccaacatctccggcgatcggtctcttgcgatcgatctggaacattcgggcaaacaaccttatttaggatagtcccaccttgagagttggccggccgcgtgcctgagatttcatcgagaattcatgttcgacgcatgcgtccgcggcaggcgacagtcactgcagatcgttgcggttactgcggatcactgcacgatgggcttccacaatggcatgttggggcctcgcaattccttcggcccattctcccaatcggtaagcgcggcgatggcgggaccttggttgaaggcgtcgagcttccactgccatgtgtcgggatccgcaggaccgttggaaccgcctgtgttgacgctcatgctcgtccagaaggcgttgcgcatggctccgagattgttgaggtcgtccggatccatgtcgagcagcacggcgacggtggccacgatccacgatccatggccgactgcgagcagcgtggtggccgtcggatcatcggcatgttcggcgatgatgcttcgtatggcttgggagccacgctggccggtatgcctgcggctttcgacgccatgcttggtttcgcctccggtgtgggcacgccatgaatggtagtcgtcggcgtactgttcgaggatttcctcgcgggtcatgccttcccattcgccgaagctgcgttcgcgcaggcgtgggtcgagggctacgtcaagtccgagaaggtcggcgatggcgtgagcggtctgttgggcgcggaaaaggtcggatgatacgacgaccatgcgtcggctcgcggccggtgcctcgttgatttcgttaagatcggcgagatacgcgccctcgtacgcgggttgggcgagttcatcattatggtcggcgatgtgcgcgactttcgcccaatagtatgttttggcgagttcataagcgctttggtcggcctgccacctgccgacgatgtcgaggggaatgtcgatttggccttgcagtcgtcttgcgagattgtatgcggtgcgtccgtggcgcaggaagagtacttcgtcgatcatgcatttcattgtagctatgccgtgcgagtgtggtgagggtcgcccagatggctgtgagcgcgaatgccgtggtggagagggttccgtcggtgaggcatcctgtttctggcgggcattcgtcgtggttggggacgcgcgttcctatgatgagaagccggtgggtgttgatgccgtatggggtgcaggtcataagggtggcctgatcggcgctggcgtcgtgtttgtttatccaggtgaaatcgtcgggggtgatggtgcggattgtttgcacttgataggtgagggtttcgccgagggtggtgatggtgaattcgtcaccttctcgggcttggtcgagtttggtgaacatgagtttgtcggcgaggccccggtgtgcggtgatgacggtatgggttcccgctcccccgattggcagggatgtgccttcccaatgccctgcgccgatggcgagcgtctgttcgcttgttccgtggcgtatgggtaggctgatgccgagtttcgggtagttgatggttgccatgacgtcgctgggtgggatgacgagttgccgattgtattcgtcgggattttgcgttgcgggttcgccgtctgtttggttgctggtttggtttgcgaggcgcgcgttgtagagtttcgcctgccgtttgctttcttggattgccttgtttgcggtgttggtgatggtggctgcgtacgctttgacgttggctgcttgttggatgttgtcttcggcgcgcatgatcagggggatgctgatgatgagtgccgttgcggtgagcatggcggttcccacgcaccatcggatgatgctgcgtttgttgggcgcttttttgtgccgtggtttgctatgcgggggaatcgccatgtgttgcctattgtcggatgttggctagtcgttgcttgatcggcacatgcgcagcatgacgatgcctcctatgaagaggagtgccgcgatgctgaagagcatggtgaggcctgccgcaccagtcaacggtatttcggtgatggtacggatgttggtgacgaccacggtgtggctgtcgccttttttgatgaggttgttggggtcggatttgacgtcgaggctccacgtcatgttggtgtcgtcaacgttgacggtgacgactgcgctgggcagcatgagcgacgagtagtcctggggcgcttgtgtttcggtgatggtgtattcgcctttgagtccttggattttggtttcgccggcttcgaatgtggtggttgtggtggtatcgccgctggtggcgaggcggtaggtgccgttgccgagggccacgagtttcaaaggcgttttgtcgctggcgccttgggcgatggcgaatttcgcgccggtgagcttttggcttttggcgtcgaccttgcgtaatgcgatttcaccggtgcagactttaacctcgttgccgggctggttgttgtggtcctgccatgcgttgggattgtgggagtattccaagtcgatggagttgacgttgcaggggcttccgatgaccgcattgccgttgagtctggccttgtaggtgactgtgatcgtcgcgccgaccggcagggccgcctttgatgcgtccgaggcgagaatgtctccgttgacgccgaacagccagctgatggttttgccgttgacgttttccttgtagaacgtgctcgccaatgctttgccgccgacggtgatcgaggtgagcgaaccatagtcgagacccgcgccaagcgtatcgttcaacgcaagatagtagtgctcgtagcctgtccagttggggattttctgcgtcacacggtaggtcaggtccttgcctatcgcttcggatgcgctgtctttccaggcactgccaacgttgacttttttgtctggcgattccacgttggataccttgtagatcacttgcccgagggtcagggtcgtgccgccggccgtacgtagttggttgacgccgttgaccgcggtgccgttcatcatcatgatggacgcggttgttttgatggcggtgccgctgcttagtgtggttgtcgccggtgtacggtccacgatggcgtagattcccggtacgagtacgttgccggtcgacatggtggctttgtcttggctgagtgtggaaaccgccgttccatcctgcttggcgaagttggtttgtttggcgaggctgttgcagaagttgcgtagctttccgctccatggatcgctgcgcgagtcggtcaggttcttcaccacccacaccatcggatcgtttttgccgttgacggtaaggttcgtatcggtggctccggccgctttggctgccgcggtgatgtcggatgccaatgccgtgttcgtggtcagatcgtagccgacgatcgtgttgccgtccacgcttgcggcggtatatgtggcaagctggatggcgcggaggtccttgccttcgaggctttccccgttgcttgccttcacgctcatggactgcttgacgcctaaatcgccgagttgcggcgtggcttgggccgtgcccggcatggcaagagccgcgatcatgcccagcgcaagcatggaggtccatcggcggcgtatggtgtgttgtgtcatggttcaccttctttggttgttggttgtcgcataggcgtcttcgcttatgcgtgcagaccagcatggcagaaaccaatattcgcccgccacctctttaagaaaatctgtggataagtggatgagcgaacacttatccacacttatccacaacccatgcatgcaactgccgtataggaatccatggtcgaaccgccgcgaacgatatgctgcagattcgcgatcttccgttccgatatcggagaaccgcagaccggacatacagtcccgtctgcggttctccgatattgtcgtttcgactggttcagtatggaaccgatcagtccttgacgatggttttgcctgccgtagcgcccggagtgagatcctgaatttccgtgatctccaaaaccggaatggtcattggctttttcgtgccgcgttcttcggcgactttgacctgttcgtcatagatggcgtcatcggaatgcagcacgacgttgccgcggaaacggtatcccttcttctgttcgaggttggcgaccgcgacgaccagatcactgccgtcaagcaggttacggtatgtctggcccgcggtgcgctcgtggtagccgatatggttgttgtcgatgatgaacatgctcatcttcggaccgagatcgacctggccttctttgctgatggtggccacccatgcgaggttgctgttgaggaatcccttcatctcatcggtgagatctgccatgatgccgtcctttcgtctatatgcccatggaatgcgggcatactttcagactacgacaagaaaccccacaacgcatgttcgcccaacgtgaataacatcacatacgcgctccatctgaaaccgaatttaggagagataacacctgtttcgcactttgctgaggcgtcagaccacgatcatccgctatccaatcaatcatggaaaagaaaggattgattttgggttggcatcagcggtatctgctggacgatatgcacgtcgagttgattcgcaatgggttcaaagacaaagcctgcagcatgccgatatccgcacttggtttagatattgtgtgtgaattcctttattccattgatgggtttttccctcaaaagaatttatgcagattcagacatttccgatttagcctgggctttttgcgatgtggcaattcttgtttgctggcttagatatgtcagacagtatctgccagagaaagcacaaaggcattttattccatcccccattctcgctttgcttgtatgcgcgtacgcaacgccccggaggccctgaatctgagagggcgtcttcctgtgaactcgatgaggctcgcgcccgccagctcatccacgtatttgcggatcgtctgtttcgtcagcatgaggtcgccgcctgcatcttcgagcgtcatggacttggtggtgtcgaacagctcctcctgcatgactgcgtagagaagcagggtcgcgttcgtggacagtgcatgttccctccgtagctcgtcacgcaggacggtcgccttgtcgagctggtcgattttgacgccgagctcctcgatcagggattcctgcgcccgttcgatgagtccgaggatggtgtatacgaagaacgtgagttccccgctgttgagtttgtcctcggcctcagtgaacgccttgtagtattcgttcttgttctccgcgatcgtcctggagagggacagcacggtgggcagagtgagatcgttgctgaggtagagcgcgagcagatacctgcctgtcctgccgttgccgtcgtagaacgggtggatgtattcgaacaggaagtggctggctatcgcccgctgcaggaacggtatggtatccgaccgggcgaggtccatcatctgtgcgagcagcgctgatatccgcgcctcgctgctgacgccgctgtggatgacggtgccgtgcggtccttggacctcgacatcgcctttcctgaacagctccccgtcgggcctgttcttgtcgtcgatctcgtcgagggctatcttgtcgtagatgtccctgatgtcctcgagagtcttgggcagttcaacgtcgcgattggtgaggttgagatacagtttcgcgaactcgccgaacctggccttctccatgtcgccctcggtcctggcctgccgggctgcggccacggcggcttccgtctccttccgcgtcgacctgaccccctccatctcgttggtggcgagcaattcctcggatatggcgtggtagatgtagttccaccgcatgactcctgggatgctccgccacatggccgatacccggcgttcggcgaggagcaccttctgtgtgagcatgcacacgcagcgcggcgtggcgatgaacagttcgcccaagggtgtgccgattccggttgtgaatgtggagtccgcttcgaggcgttgtctgacgagccggtcgtggttggcgtaggagtccatgctcctgtcggcgtggaacagccgcgccaaagtcctgtattccatgctcataacggtcactgctttcaaaaagtcatttatattttatgagaattataaattagaagcactcagaagacaagacaaagcatctatgaatgaaaattaacaataagcccatgtcggctctaccgtccgtcgccgacacccctgccgacacgggtcgttcatgcgtccgtctgttcggcttgtatacgatcttgccgaaggttctccgcgtcgtcgtggaagtcctgtttctttaccaccatataaccggtttctatcaccttgaaccgtttttgaggttcggcaagcacgtccgcgaaacagcgtcgtttcaacaaaaagggccaccccttacggagtggccctcgataatcgtggagctaaggggattcgaacccctgaccctctccatgccatggagatgcgctaccagctgcgccatagccccaaagtctgctctgcaaactctgtataatatacatcgcagacataagtcacgcaaatttcggcgtgtcgcccgcactgaggaattggcatgagtaaaaccgcaatacgcaatcaccttatgtgaaccttatgcgggcgacatgggaagtgcgccaccagcgacattagttactacttgcatctcccgtcgagccggtagtaccgtcggtggatcccgacgtgccagtgccagtcgaaccatcggttccgctgtttccggatccggatgatgagccatcaccagtggtgccggacgtgcctccgtttgagccagtgccgttggacgaatccgttccgttctggctggaaccattgctggaattatcggatgacgacccgctgtttccggacgtggatccattggtattgctcgatgtgccgttggaagtggacgagtcggtggatccgttggtggttttgtcgctgccgtccgtggtggtttcgtcgttcgaatccgtggaatcggacttaggcttttgcacgggggtctgcccgtcgccagtctgatagtcatcggtatttccatgcgaaggtacaaccttctcatgcaccacgtcacgcaccacggtgtccgtcccctgaccgccggtgaaagcaagaatcaatcccgcgctcactcccacaccaaccaaagcactgacgaatgcgatgatcgccggagcgtacttgctatgcaaccaattcgaggaacgctgcccagcatgctgtactcgggcatcatgcgcgcttccgagtgttccggtcttaccggtaactacgccaacatcgctgacgccacgctgtccgttcgggaaaacggaagtctcccctgccccggcaatatcgccgagcgcacgagtcgcatccgcatattcctgtccggaggaaatgacgcgcggtaaaccggactgcgctaccgcagccgtatcggcagacaataccatcgtgacatccgacgcaacaggagacgatccaataatcctcgtctcatcatcctgttcggaagagccaagcacctgcgtttcatccgcagctcgctcattcgaaaccgtctcgctactcgacgggaacggcacggcctgttggatcttctcccctgatgccttcaaaacgttcttgtagacctgcgtggcaaccgcggaaacaaccgaacccgcggccacaccaatcaccgatcccgcgataccgattttcgcggaaagtaggaatgacgtgaccgccgccagcgcacccgcgcaaatcgacgaaaaagagattcccttaaaaaagtttttcacaagccatgacgatagctaatttcgctatgaaagtactggcgattctgtgaaaagcttgaaaaagcggtgacagaccagcgtccgacatcatgtatcggccggctacaggctggctacaggctgggatgctcccattcctcggaatcggcgatagcgggaccgtgattgtagtccatcaaacgccaacgcaatgtggaaccgatctccaatggaatgagccgcacccagtgagcgttgcgcatcgacaaaatgtcggcgaaatcgccatgcgcatccgccattcccagcagcgtctgcaacgtttgggaaatccatgcaccatgcgagaacacgtacaagtccgtgtcggatccggcacggaacgcccaatcgttcaacgcttcgacgccacgacgtccgacttcctccttgggttcggcaccgtatttgagttcgccgccacggaattcagcccaggaacgatagtcttccgggtaccgttgcgcgagttcctcaaccggaatgccttcccaatcgccgaagctgcgttcacgcacgcggatgtcgggatgcacttccaagcccagcgggtcggcgaacgcatgcgcggtggctgcggcacgccccagatcggaacagatgaccagccggttcggaatatcgggacgacgatcaacatacagttcacgcaatgcgtcggccgtctggcgaacctgccattgtccgacttcgtcgaggggaatgtcgatctggccttgcagacgatgctgcgcattgtaggcggtacgtccgtgacgcaccagcgtgatggcgtgcacgtgttccggtactgcgctgttatgctcaagttcgacgtttcgaggcatgctgctgctctccgttgctttctcgattatggaatgtttgcgaaaactgcttcgcttgatatgaaaacatgccttccgcatctatacgggaaggcatgttcatacgtgttattccgcggtttccgcggtctcttcgtcggaagtctccggatgttcgagctgcaggtcgatgctcgggcaatccttccacaagcgttcgaggcgatagaagtcgcgggactcctgatgcatgacgtggatcacgaaatcaccatagtcgagcagcacccactggccttcggtcaagccttcgcgggaacgcggttgacgcttgccgcttttgagatacaggtccttttcgatctcttcggcaaccgccaacacctgacgttcgttcgaagcggtggcgacgagcatcgcgtcggtaatggccaatggttcggtgacgtcgaaggcaacaaggtcggtggccttcatacggtcggccgcggcggcggcgatgcggatggcgtcgatggaatcttgtactgccggcatattcagcgctcccattcgggcttccagccctctactacatgttgtgtgttttcggaatagaccatggaatcgtccggaacgtcgtggcgtaccacggaaccggctccggtagtgacgccgctgccgacttcgacaggggccacgaacaggttgccggcaccgacgtgcacgttcgatccgatggtggtgtggtgcttgtgcacgccatcatagttggcggtgatggtaccgccgccgatattggtgtgctcacccaagtcggcgtcgccgacatagctcagatgcggcaccttggtgccgttgccgatgtgcgccttcttcatttccacaaaggcgccggccttggactcctcgccaagatcgttgcccggacgcaggtacgtccacggaccgatgttggccgcgcgaccgatgtgggtttcctgcacgcgggaacgctccacatgggcgtcggcatcgatgaccgcgctgataagtgttgtgtatgggccgacctgcgcgccctcgccgatcacggtctggccttccaggaagcatccgggaaggatcaccgcatcgcgttcgatacgcacgtcatcttcgatccacgtggtttcagagtcgagaatggtcacgcccttacgcatccaatgctcgcagatacgcttgttgtgagctttggcgagcgctgcgagctgcacgcggtcgttgacaccttcgacgctcaacgggtcgggggcggcgaacgcaccgacggcaccgttggctttggcggtttcgagtgcgtcggtcaggtagaactcgccttgggcgttgttggatttgaggttggcgatcgcttcagccagcagtttggcatcgaacacgtagacggacgcgttcacttcatgcacggccagttcgctgctgttggcgtccttctgttccacgatgcgcagcacgttgcctttgctgtcgcggatgatgcgaccatagccagtaggatcgtcaagaatggtggtgagcacggtggctccgttgccgctttgctcatggaaggcaagcagctggttcaacgtgtcggcgtcgagcagcggcatatccgaagctgcgatcagcaccgagccgtcaagaccgccttgctccttcaactgcgtcatggcgcactgcacggctcgcccggtgccgggaatgtcgtcctgattgacgatggtgacacgctcattgtaggagcgggccgcttcggcgactcgttccgcctggcagtgcacgaccacggccaacgtttcagggtcgagcgccgacacggagtccatcacacggttcaaaaacgtctttccggccaaagtgtgcagcactttcggcttgttggaacgcatgcgggtgccctcacccgccgcaagaataatcgcggcacttaatgccatgtctaatctccaattcctccggctctcacaaatccagacacgaagccagttatccgacgttccatcttaaaacgagccctccctaaacgcaaaacaaccacgtctcggaatgacttgtggagcgctggaatgtcagcatgcgtgcctcggaatgactaccgtctgatagacgactatggaaaacagcaataactacaaggcgttgcgccggagacggagcggatagattgatgtccgacatgaacgtggggtatctcacgtaatgtatcaccattttttgggaagggaatgatagtaatgtcagacatcgcatatgattggatcgccctcggcgtagccgcgatcctgttcgtcatcctggcgtttctcaaacgtaagaaaaacgcgggtttcaccacacgcgtgttgcttgcaacggcattcggtatcattttgggaatcgctttcaacggccacactgattatgtcggcgcggtgggttccatctggtccaacgcaattaccgcactggtggttccgctgctgctgttcagcatcatctccagcatcacgaaccttggagagtccatgcgcttaaagagtattggtgcgaaaaccgtattcttcctgctgcttaacactgacgaagttgaatccaatccacttcttcaaagcgttcttccctgccggagtggtcgcgttcacctcggaaagcagcatcggcacgattccagtcaccgtgcgtcagttacgtagcgcaggcgttccatgagatatcgcctcgttcgttgccggaacggagccctcacagagggcaaatatcacgaatgacgccaaatccgattcagccaacgtctcccaccaacagagcggtttcgctctgaacttcgcacccaatgcaatgttctccgccagtggagatgacgcctgctgcggcacgaagccgaacaaataatccatccacaaatcaacagacacctgtgggagaataccggatcaaagtgttcgaacgacgttaggctgtcagagcatgccgagcagctcggcctcgtcacgcatggcgcggtacagcatccactcctgcctggcgtcggacaatgcgcggtgctcctccatgtcggcgatgtggtagtcgacgatgagggtggaaactttgtggcttcgtttttccggatgcagtcgacggctgaggtccagagtgtcgacgaaatggtgcgcaaagcgcgcgtctcgctccgagtaagcgagctgtacagcattgtcgaggaacgacatgtcgaaggacgcattgtgcgccatgaccacggctgtgtccgaacaccagcgtgcaaactcatccatgacttcacgcacatccggtttgccgagcagcatgccatcgtcgattcccgtcaaaccagtgattcttgacgggacgtgttcgaacgggttgatgagctggtcgaattcgtcaaccagctcatcattacggattttgaccgcgccgatctcaatgagcttggcacctttgcgcacactcaatccggttgtttccgtatcgatcacgatgtaatccgtgaatcgtccggacaacgggtccaaacgtcgggaatcgccacttctatgcgctgccattcatctcacctctgctctttcatttgcgatgtatagcttaatcattccaacctgactttcttagccggggaaacataacaaaaaaaaagatcctgcagcatgacgctgcaggatcaatgaaccgttattcaggctttaccgcaaagctcgttcagcgggtcggagcgaccgtgaccgggcaacgctggaagctcttgagatcgacatagccggtggttgccatggcacgacggagcgcgccaatgtaattggtggtgccgtccgcattgtggctggggccgaacatgatatcttccagggtgccgacggtgccgacgttcgtgcggaagccgcgcggaagcgtctgatgacgggcttcggcaccccaatgcatgcccttgcccggagcttcctcggcacgggccagcggagagccaagcatcacggcatcggcgccaagcgcgaacgccttgatgaagctgccggagtcgcccatgccgccgtcggcgatcacttggacgtaacggccgccggactcgtccatgtagtcgcggcgggcttcggccacgtcggcgatggcggtggccatcggagcgtgaacaccgatggtgttgcggttcgcggatactgcgccgccgccgaagccgacgagcacgccggccgcgccggtacgcatcaagtgcagggccgcggtgtagttggcggcgccgcctacgatgacgggcacatccagatcgtagatgaacttcttcaggttcaatggctcgtgatcctgggagacgtgctcggcggaaacgaccgtgccgcggatgacgaacaggtcgacgcccgcttcgagcacggtcgaataatagtcctgcgtgcgctgcggggacagggcgcccgcaacggtgacgccggcgtcacgaatctcatgcagacgctcgacaatgagctccggcttgatcggctcagcgtagatctgctgaatacgctcggtcgcgctttcggccggcagttcggcgatctcgtcaagcagcggctgcggatcgtcgtagcgggtccacaggccttcgaggtcgagcacgccaagcgcgcccatcttgcccatggcgatggcggtggccgggctggtcaccgaatccatcggagcgccgataaccggcacgtcgaattcataagcgtcaacctgccacgaggtggacacatcctgcggatcgcgagtacgacgggagggaacaatggaaacgtcgtccagagagtatgccagacggcccttcttgcccaaaccgatttcaatttcctgagacatgttttcaaggctaatgctcagcaatgacagtatgcaagagcgtgtcacctgccgccacaccgtttttttggacattaacaggtgccgttaacacgttcgttataagacaggaacttatcaccttcaatcccgacaggagggcaacacatggccaaaatcaaggtcgaaggcaaggtcgtcgaactcgacggcgacgaaatgacccgcgtcatctggaaagatatcaaggatcgcctgatccttccatacctcgacgtggatctcgaatattacgatctcggcatcgaaaaccgcgatgccaccgacgatcaggtgaccgtcgacgcggcgaaggccatccagcgtgagcatgtcggtgtaaagtgcgccaccatcacgccggatgaggcgcgtgtcaaggaattcggcctgaagaagatgtggaagtcccccaatggcaccatccgcaatattctcggcggaaccattttccgcgagccgatcgtgatgagcaacgttccgcgtctggttcccggctggaccaagccgattgtagtagcccgccatgcgttcggcgaccagtataaggccactgatttcaaggttccgggggcaggcacgctcaccgtcaccttcactccggaagatggttccgagccgatcgaacatgtcgtgtacaactatggtgccgacggcggcgtggcccaggtgcagtacaacgtgaacgattccatccgtggtttcgcccgcgcctgctttaactatggtctgatgcgcggctatccggtgtatctttccaccaagaacacgattctcaaggcatacgacggccagttcaaggatacgttcgccgaagtgttcgaaaacgaatacaaagacaagtacgccgcagcgggcctgacttatgagcatcgtctgatcgacgacatggtggccagctccctcaagtggcatggcggctacatttgggcctgcaagaactatgatggcgacgtgcagtccgattccgtggcgcaaggcttcggctctctcggcctcatgacctccgtgctcatgacccctgacggccagaccgtcgaggccgaggccgcacacggcactgtgacccgccactaccgccgctggcagaagggagagaagacctccaccaatccgatcgcatcgattttcgcttggaccggcggtctcaagcaccgcgccgacttggataacactccggaagtcaagtatttcgccgaaactttggagaaggtcatcgtgtctaccgttgaaggcggtcagatgaccaaggatctcgccatgctcgttggtccggatcaggcctggcttgacaccgaaggcttcatgaacgctttggacgagaatctcgccaaggctctggccgaatgacctagccgaataacctttggctgaacgaccagcagcaggctcaaaagggctggatatgtatggttcacacgcatatccagccctttttgacgtccggatattacaatcggagctcagcataggaatcatcattcgattttcatgaaggaaacggcatgacactgcaccgcacgaccgtgacgaaacgtctgttcgcactgttggcatcgacctcgctcatcatgaccatgggcgcctgctcatccgccaatgaaacgcaatcgcatgaaacggactcccccagcaccgccactgccaccgatgccggcaacgtggtgatcttcaccccttcggacggcatcaccatctcccagcagacgcctctgagcaaatgggagaagctggtgccggaaatcgtttcatcattgaaagacaatgatgtcaaaggcgccaacatcaccgtcaaagcggcgccaagtctcgacaagcaaagccaaagtgtgcaggattacgtggtgaatcatgtcaacagcaccagcgacgatgcggattcctccgacaaaaccactctggtagtggcgccggtggccgacaccaccgaatccgaccgccaatatggagactatgtgtcgcacgccatcacatggaatgggagctcctccgacgaagacgcccaggactacgcccaatccgcggaacgtttggtttccgcattgcagctcgctcaaaacgagggcatgaaagtcgtgttagtgtcgaacacgctgcagggtttcactccggatgtgtacgtgccgatgaccacggccgagcagatcggccagcttcaagccaaacagctggtcagcaagctcgagctcgacaaaaccagttccgacaatccgaagcatatcgaagtgctactcccctacgatgccgccaatgaaagcggcagcacagcggacgcgactttcgcgcaaggcgtgttcaaaggcatttggtcagtgcttggaccgtatttcaaagatgggaaggccgtttccccatccggcacgctgacctcgtcgagcacggaatccgattgggtgtccgtggcgttcgacgcggcgaaaagtgagcgggtcaaatccacgctcgccggacgtctcggcatggataaggacacatcgcgccatacccgcatcgacggcatcatctcctgcaatgattatgtggccggctatgcttccgaagagctcaacgatcttggatataccggttcggcggccgacatcaacccatccatcaccatttccggcatcgtagacaatatcaccggcaagaaagacctgaaaaaacagtccgttcccgatcctgcgcaggcgcctgaatccgatgacggcgattccgatacggaggataccagcgattcccttgacgagcagaactcgcaatggccgatcatcaccggttacggcgcctacgtcagctccataccgaatatcgtgaacggcaaacagtggatgaccgctttggaaaatcgcaagaccttagcatccgacatcgcacagacctgcgtgcagctcaacacgtcgggcaaacttgcgaagctgacgttcatctcatccgtcgccatggaagacatgaaagtgccgaccattcaggaagaggcgcttgcggtcagcgccagcaatctgaagaaaacgctgatcgaaccgggatatatctcgctcgccgaagcaggcttgtagaccggcaacaaggtaatccggattatcagacataggaaatccgacaagagatggaaaaagctggcttccgtcgaaccgccgcgacggaagccagctttttatgttgcggccggcacattcctaccgccgatcatcgcattctacttcttcggaacgtagatgacggtgtcgatcagcatgcggtagtgatcaaccaccgcctgacggcgtgccttcatgctcggcgtgaccaagccgttttcttcggtgaactcgtccggcacgatttcgaacttacggatcgattcggcacgggatgcgagctcgttggctttgttgacggcacgttccacttcggcgcgcacgatcggattgcgggaggcctcctcgagggatgccgcgcattccgcgcctttcgatgcaagccatgcgttcgtttcgccaagatccaacgcaatgatggccgctatgaacggcttgcggtcgccgatcatcacgcattgactcaccacgggcgacgtcatgatcgacgcttccatttcgcatggagagacgttcttgccgccggcggtgatgatgaggtccttcttacgtccgacgatggagacgaagccttcgtcgtcgatggaaccaagatcaccggtatgcagccagccgtcgacaatctgctgcctggtgacgtcgggattgttgtggtagccggcgcatacggccgggctcttgatgcacagttcaccttcctcgtcgacacccatggccacgccctgcagaggcagtccgatggtgccaatcttgtatccggaggtcggattgacgcttgacggagcgcaggtttcggtcatgccgtagccttccagcagcggcagtccgacgccattgaaaaaatgcgcgatggatgaatcaagcggagcgcctccggaaaccgcgtattccacatggccgccgaacacgtccatgatcgaggagtacaccagcttgttgtacagcgcatgcttgagattcaagacaaccggaatgccttcgcctgactgctgtgcgtacgaccagtcgcgcgccgtctgcgtggcacctgcgaaaatacgtcctttgaggccggctccggccttttgcgacgccgcattgtatatcttttcgaagatacgcggcacggcaaggatgaacgtcggcttgaacgctttgaaatcagccaggatcgtcttcaagttgctggataggccgagcgagacgttacctgcgaagcagaagaactgcatgtagcgtgcgaacacgtgcgccagtggaaggaacagcagcagacgacggttcggcttcatcgcgatatcgggcatggagctaatgcccgaataggtgatgaacacgaaattggaatgggtgagctcaatgccttttggcgtgcctgtggagccggaggtgtacacgatggtggcgaggtccgatcctttgaccgcatgttcgcgctcttggaattcggcgtcggacacggcatgtccgtattcgatcatcgtgtcgatcgcgccaagtccgatgacgtagacgtcgccaagattggagcattcgtttctgatggattcgatcttgtcgcgttgcgcgtcatcttctgcgaacgccattttgacgttggcgtcgttgaagatcattttgacctgcgcgggagaattcgtctcgtatacgggaacggtgagcgctccgatcgacatgatggccacgtcgagcgcagtccactgccagcaggtgtgagagatgatggacaccgattcgccgggcatgatgccttgggcgatcaggcctttggcgatggcgatgaccttggcacggaattcggtggcgctgaacgacgaccactcgccatgctcgttcttgtattcgaccaatgaatcgttcggagtgcggttcgctcgttcatcaagcaccgagaaaatgttcttatccgtgtcgatctgctgttccaaaggccgcgtgtattccttgtacatggcatttctcccctgcgtaatcgtcgtacatgtagcatcatagcctgagagcttcacttttttcgacgaggccacgacgtatggacaaaatcaatggttctgtcgacccctgtttcacaggcctttcaatccgattctcaccgtacgggttttgctttccggattggtgtattgccgtccttccgattttatcccccaatgcaggcaccgctcgtcgcaatggtcggattcgccctccacacgcgcgaaacgctccccttgcgcaacatgtgcgccgacatcgcgttccgcaatggcgggttcgaacgtcgaggtcaggccggaaaggtcgcctccatgccggatggtgaccacggctttgcctcccacgttgccgctgaaggcgatcacgccgtccgcgggcgcgacgatggcttcctgagggtccgcaagcaggtcgacaccccgatggcctggaagccactgttgtttcggcgcatcgtacttgccgaccacctgcgcgccgttcagcggccatcgcatcaggacggcgcaggaaccggacgcggtcgccgcattcgttttcgcatacgtcggttcggccgaccataggcagcacacgagcagcatgacacacgccagagcgcatacgaccatggtttggcgcaactgctggcggatgcgcttcttttcctcctgtgcgattctgttccgtcggattcgcctgcgatattcacgttcgtccatgatggctccttcacgttgctgtgtttgcgccgttgcgttgtgctgtggtaaatcgccagcatgacagtgtgaagttgtgcttgtccagctgaaacggccctgtggtcggaggatgagttatccacaggctccgggcgtgtctcggcatacgatggaacgtatgagcgataacacgtcacagcgcaaagcgttgcagcaactggaaagcgagtccgattacgatcggatcacctactatcagaagccttttatggtgctgtgggcggccgtgcaggaagcgtcaagcgaattgcaggacgattacgcgctctcccccgaactggcgcagttgtgggttgccgagcagatccgcaaggtgtcggactcgctggtggaccgtcttgcggaaacggctttggcgcacggcgagtcgaaatcgaatgtggcgcgcgcggccggagcaagtcccgccaacgcgttgcggcgctttcctcggctcaagaacgatgaaccgcacgagcgcacgctgatcgacgacgtgcttgattcgttagagtaacaaaaagcccttgatttccaagggctttcatgtggctcctgcgactgggcttgaaccagtgaccgtccgattaacagtcggatgctctgccaactgagctacgcaggaatattctcctgttctaagcttctccccgacaaaaatcaggaaaaacctaaaaacgcgctcctgcgactgggcttgaaccagtgaccgtccgattaacagtcggatgctctgccaactgagctacgcaggaatgtgcttcctgtacggaattgcttccgtgcacaagtcacatatattacacaaatcctttgtcttcgcaaatcgagtgtcgcacagcgtgtcgcgacatcaccattcgagttccgcgatgtccatcggatgctcgttgacgtcgacggcggtgaccttgccatcatgcatgcggatcacacggtccgcgatcggcgcgatcgcggaattatgggtcacgatcaccacggtggcgcctttcttacggctcatgtcctgcagaatctgcaggacctgcttgccggtgttgtagtccaacgcgccggtcggctcgtcgcacagcaggatcttcggattcttcgccacagctcgggcgatggccacacgctgctgttcaccgccggaaagctgcgcgggaaaattgtcgacacgatcgccgagaccgacgtcttccaacactttgacggcatcctgagcatcggaaacgatctgcgaggcgagctcgacgttttccttcgcggtcaaattcgccacaagattgtagaactggaacacgaaaccgatgtccgtcctgcgataagccgtcagctgtttcggggaatagttggaaatgtcgcgtccgtcgatgaccacgctgccttctgaattcgtgtccatgccacccaaaatgttgagcaccgtcgacttgcccgcgcccgacgcgcccagaatgatggccagttcgcctttttcgatgccgaagctcacatcatcgttcgcggtgatggtggtggaacccatttggtaacgcttgtaactatgctgcatttcgatatatgccattttggtctccattccacgccgaaaaatccttgactcccaatattacgactacagtagggattgttgctcatagacgacgaggaagggaacgttatggacatcgccgacgacgccgaccgtttgcaaacactgctgtacagcgcttacgattccgataccgtgcgcgagatggaacgtccgctgcttgacgacggcgtgccgctgatgcgcatggccgcctcggctgcggcccatgtgaccatgacactgctcgatgatgaggacctcgccgtcgaggacgcgcgggtagccctccttgtaggggcgggagataatggcggcgacggtctatacgccggcgcggaactggcgaacgaaggcgcgcatgtcaccgcgatcgccgtgggacgttccctgcacgaggaggcgttcggcgcgttcgtgcatgccggaggccgtattctcgtacttgatcccgccgccgaaatcccaggatgcaccacgggtttttccgcgggagaggccggagaacgactgcaggccgccgttgaatacgttcagggctcccatgtgatcatcgacgcgatgaccggaatcggcgtaagcggcgcattgcgtggcatcgcaggcgccatcgcttcctccttgggattcgatggcgaacttcccgacaggcccgccctgccgaacaacgagccttcctccgccctgccgctcgtcgtggcgatcgacacgccgtccggcgttggcgtaaatgacggttcgcttccaggaccgtacattcctgctgatgttacggtaacattcggcgcgatgaagccgtgcgcgatggtgccacccgcctcatacgcatgcggccgcctcactttggtcgatttcggtttcgacattgatgattgcgtccccgcggccgaaatgacggacggcgatttcgtaacggattcgattcgccttccgcaactttcggacggcaagtattcgcgtggagtggtcggattggtgaccggctccgcccgttaccccggtgcagccgtattgtcggccacggcggcggcgcgcgccaacactggcatggtgcgctatctcggcccgcaacgagcgcaggacatggtgctttcctcgttgcccgaggcggtgatcggcaagggccgcgtccaatcatgggtggttggttccggcgttcccacgggtgacgacgaagccgccgacaccgacattcaacgcgaaaccataaccgcgttgttgaagcattacgcactgcaggaaaaaaccggctccaatgacgacgccaggaatgaaagcgccctgggcatgccgccgatcgtggtagacgccggagctttggacctgctgccaggcaaagtgccggctcaagtggttgtcaccccgcacgtcggggagctggcccgcatgttgactcggctagacggaaacgaagccagcgtcgacaaagtgcgctcgcagccgctcgcctgcgcccgcagggtccatgagctgaccggcgcgaccgtattgttgaagggcgcggtgaccatggtggtcggcacggacggcgaaggcaacgagcgggtgattctttccggacgcgcgccggcgtggatgtccaccgcaggatcgggcgatgtgcttgccggcatgttgggcgccctgctcgcgcaacaggacgacatgcttgccgaggatccggcattagttcccgaagtcgtggcggccggagcctacatacatggtcttgcgggctcgatcgcatcgcgatccgaacagcgtggatggcatcgtccgcagatctatgggcattccaaaaagcagcatttcggggaaatcggccatccgatcatcgcgagcgatattatcggcggcattcagccggcatttttgcaattactttaattgcaaaacaaatttaccgaacaccagccccaacatcggtggctttgcgctacactagcgttgccaatccgtattttgcaggaaggattttcatgacctcccccagtgccaacgtcaccgatgtggtctttgatttttgcggcgtgcttatcgactggcagacgcgcgcatgccttgaaggcaggtacccccaagtggttgtagaccgtatttgcgcggataatgatccgtgctgcttctacgattatgaggatcgcatggaccatggcgaggatttcgaagccatttatcccgacgtggtacgtgaacagggcgaagagatcgccgagattttccgcgattacatcgaacgttacggcgatgcgctcccccgcatgattccggatatggaacagctgcttcgtgatttgaaggctgcaggctacggcgtgtgggggttgacgaattggtcgcatgagacgttccatttcgcattcgaacgtttcccgcagctcggcgagctgctgcagggcacggtggtgtccggcgtagagaagatgcacaagccgaatgccgacatctacgaactggcgctgagccgtttcaatctcaggccggaatccagcgtgttcttcgacgacaccgcgaagaacgtcactggcgcacaggccgtgggcatgcacgcgttccgcttcactaacgccggtcaggctcgccgcgatctgaaatctttgggcatggatttctgactttttcaaaacgaacacttgaattaacaaagggtgcggatcgcacgcatgtgaaccgcaccccgattgttggactgaagaaattcagattcgattccttcactgtttgcaattggttctcctgagtccgttcattaaactttcccagattgccaacggcgtttgtcaacgttgatttgtgttctgtgtcaaggcgacggtatctagcgtcgctatgacgttacttcagttttgccgcgaaccgcgactgcggcggaacaacaggtagctgtatacataaggaacgagcgctgcaccaaccgctatcgtcacaataattgcgaccatgagcatgtcgcccacaggcacaacagagctgacaacacccgccacaatcaacagcactcccaacaccatgaaagagatgccacccacacgctgcgtacgcttccaattgttctcgtcgaccagagcccaaggcgttctgatgccgaaagtgtaattctggcgcatgcgcggaaggtaattgcctaagccgacgaacagcgcgcccaataccacgctgacaataagcccaacgggaccgccggtagctgggattacaccgaatgcggtggcttcagtgaaccatgtgacaccgcacatgatgagtgtgaacgcgatgacgaatccacgatacagtccgctggccttcatgtagttttctcccttggggtccatcttcgggatgacgaggaaaagtcccaagcacagcaacggcaatatatcaagaatcaacgttacggcacgcgggccataaccattgaccgaaccatcggcaccccaatgaatcggcacgttttcgggaagccgactatagcaggcaagatgtgcgatgatgttgactacacacagtgcaacaagcgcaatgcacagattgcgtccgatcggagcgatcttctcccccgaatcagtcttgttcttgtcttcggcatggttgatgttgtttttgaaatcgttcaagttgttcccgcgcataagactctcctttatttactgtctgtttgatcattcgcttgattgacgtttccatcgctgtccatgaatcccatgaaccatccgatcagatcctgcatcaccgtggtgttgagactgtagatgatgttctgcccgtgccgttcgtcggttaccagtcccgcggttttcaacgtggtcagatggtggctgatcgacggtttgcttatgttgaattgttctgcgagttcaccagccgtcatgtcacgttcgcgcagtaattccaaaatgcgccgtcgcgtgggatcggagagcgctttgaatcccttccctgccatgcattcctccttcactttgcaatgtttaaagattttcttatttagataattatctaaacatctactatgtaaacatctaccgcggacatgcatgcgttacatttcacgcattatggtgggaagcatgattgattggagcagctaggactgagttttcaaagaaaaagcgcgccttgcccgtgtggtgaagcaatggtgcgcccggtatttcgcttgacagtcgcaaattatgggatcgtggatctgtcataacgaccagtccacgatgattcgacctgtttgaacggttggccagtagtgatttgttttactgcttctgatcgtagggtgggttgatcatgcggtcacgccaatagtagacgtcatcatgttcgccgatttcgcgatacaccttgcatggctgtccgaatgcgaccacattggcgggaatgtctttggtaaccagcgagcatgcgccaatcaccgaattgtcgccaatggtgacgccgggaagcacggtaacgttggcgcccaaccacacattacggccgatggtgaccggcagagaatactgtgtgaccttctcgcgcaggtcaggacgaatcggatggccggtggtaatgatagtgcagttcgggccgatcatggtatgttcgccgatatgcacttcaccatcatcaaccaacgtgaggttgaaattggcgtaagcgtgcgcactgaaatacgtgttgcatccccaattggcatgcaacggcggttcgatataagcgtcctcgccgaattcaccaagcagttggcgtgcgatttcgttgcgttgcgtcatttgactggggcgggttgcgttgaagtcgtatagcagttccatctgttccttctgtgctttgatcatctcttcgtcatcgcaggtgtagatcagtccggaattcatagtgtcaagcactcgttgcggcacagtcatggcagcctccttgcagtcgttcatgtccgttgcgattatatacgaacacaacgcaactcatgccgtgattccgcatgcctttcgcgattctctgcacaatcatcggccgcgcgtctgccaatatcggaacgccatgcagtgtcattcatccccatttattccagcattgaaaactctgtggatggacggaagtacgttgtcaaccaagcggatggaatacgtcgtgtttgtgggtggtgggatagcatattgttggttttgtcgttgtgattgttaattgcaagtcaatagtcaaaggagaaacatggcatattccaagaatgcgccgttccgcgccgatgtggtcggttcttatctgcgtccggacgaactcaagcaggctcgtgcagattatgctgcaggtattattgatgccgctgggttgaaagctatcgaagacaggctgatcactgatctggttgccaagcagaaggcagccggcctgcatgtcatcaccgatggtgaattccgtcgcggctggtggcatttcgatttcatgtggggcttcaacggcgtggaccatgtcgcagccgcccatcgcgttgccttccatgacgaggtcactcccgccgacactgccacggtgaccggcaagctcgacggacacgatcatccgttcgtggagcatttcaagttcgtcaggcagtttgaagatgacaataccgttgctcgccagaccatgccttccccagcgcagacccgtttcgtgcttaccggcaacaagaacgcctacccgtacgacgagttctacaaagatgacgacgagctgaccgcggatatcgtggccgcataccgtcaggtcattgccgacctgtatgccgccggctgccgtaacgtgcagttcgatgactgcacttggactcgcctgtgcgacaagagcgtgcgtgagcgtctcggctggagcgatgaggatgcggcccgcctgcagcaggagaatcttgacgtgatcaacgcagtgatcgcagaccagcctgatgatttggtgatcaacacccatatctgccgtggtaatttccattccacgtggctgtcgtccggcggttatgctccggtcgcagccaagctgttcggcgaagagaacgtggacgcctactatctggagttcgacgacgaccgttccggtgacttcgcgccactggctgaggtttccggcgataaacaggttgtgcttggcctcgtcacctccaagagaccggaacttgaagatccggaagtgattaaggctcgcatctccgaagcggcccagtatgtgccgcttgaccgcttgtgcctgtccacccagtgcggttttgcctccactgaggaaggcaacaagctcactgaggagcagcagtgggccaagatcgcactcgtaaggtccatcgccgaagaagtctggggcgaataatccaagccaatgctcggtacgaccagcttatgacatggtcgtaccgggcattgtgttattcgatgatgtgaacgcggagcattgggcgaaacgtataatacgggacagcaatcgtgaaatcataacatcgcagacagggaaagctatgagaaaagtggcttttatttgcatgcataattcatgccgcagccagattgccgaagcgttgggaaagcatctacgcggaaccgattgtgatttttattccgcaggtgtggaaaccaagccgcagatcaatcaggatgccgtacgactcatgaaagagctttacggcatcgacatggagaaaacgcaatactccaagctgatttcggatattccaaaacctgacaccgcgatctccatgggctgcgacgtgggatgtccctatatcggcaaggctttcgacgataattggaatctgccagatccaaccgggcacaacgatgaagctttcattgacgtcatccgtcgcatcgaggaaaacatcatgaagctctaaagggtcttgaccagcatccgttcgaagcccaccaagacccttccaaagcattctaggttagcttctagcacaatcagcaggcagctaaattttgccagcgtgatttggtaagaacattcacgtgcccgacacgcacctcgtgcataagaggcaccggtacctcatcacacgtgtgatgatagacaaaaccaaccttctcctgcacccgcttcgacttcagattgccgtcataatagccgcaccaaatcgcactcataccaagatcaacaaaaccatgacggataacctccttggctgcctccggcatataacccctcccccagaaaggcttgcccagccagtaacccaactcacactcatcatcacgatccgtcatatccgtatgaccattaagctttaactcaatcgaaccaatggggttattgctgccgcgctcgcaaatcgcgtagcattccttgccattgagcacatgacgaatcgtattgagactttcttctttcgatcggtgtgcgggccagcccgcgataggcccgatatccggatctttcgcataggagtacaagctttccgcatctgtttccgcccaagccctcaatgtcagccgttccgtttccaacatgtagtcgacctctttcacacgcaatgcattgaactgaagtatagattagcctgcaaggagagtttgctgtgagttgcgcggcggaggcgtgacgcggatggaggcgatgcatgcgaaagtgacggctggcctaactctcctgtgggcttcgatgaaagttacgtccagtgcagggcgtagattcatagccaacacgtaaagcaggggggctccccaacggagctgagataggcgaatgcctgaccctttgaacctgttggttaacaccatcgtagggagcgaagaatgagtgtcgtagcgcacacgcattgccagcgtcaattggcatccgtaaaagtctgcgcagcagatgcgtcgaccaaacagtctgcatcgcgcaatcatcaatcgtgattccgttttctatcccgtataaccgagcatacgggcgcgtcagcatacccattgcctgcgaaatcaagttttcccaacccaaaacatcataatcaagggggaatcatgagcaattatccatatgcgtcgatgcgagacagcttcgacctgagcgcctattttgtggtaggaccacaggattgcaaaggccgaccgatcaccgacgtcatcgatgacgcattgcgcgggggcgcaagcttcatccaactgcgcgtcaaagacgctgacgcgaaggatctcaccgacatggcgcgtgatatcgcgcaaatcatcgaagacaacaataagtcggattccgtggcattcgtgatcgacgaccgtgtggacgtggtctggcaggcccgcagcaaaggcatcaaggttgacggcgtgcacatcggacagaccgatatggaaccgcgcgaagcccgtgcactgcttggcgaagatgccatcgtgggcttgtccgccgaaacggaaagcctggtcaaactcatcaacgaattgcccgacggctgcatcgactatatcggtgcggcaccactgcatgtttccgtcaccaagccggaagcgtccgtaggcggcaatgacggttccggtcgcacgcttgacgaagagcagatcaacaccatttgttcagccagtggttttccggtagtggtaggcggtggcgtgaccgcagatgatatggagatgctggcgcattcaaaggcggcaggctggttcgtggtgtccgcgattgcaggagctgatgatccggaagctgcaacccgcaatatggtagcgcgctggaaagccgtacgtggcgacacgaagcacgggtacgcgccgcgcgtgaaagcccagaaaacagcggaaatcaacactgacaacacagccgacggcgcatccggcgaaaagaagttcaccaatgcgaaggaagccaaggccgcctccaagcttgccaagcaacagcgcgtcgacattgccgcacgcgattccaagcagcgagacaaagcacatattcgcaaaaccacgccggtgcatttcgaaaacgaattcggttcctacgatctgcaagtgccgtacactgaaatcaaactgtctgacactcctggcgtcggaccgaacgcaccattcaaggattacaacaccgaaggtccgaaatgcgatccgaaggagggtctcgctcccctacgtttggactggattcttgaccgtggagacgtcgaagaatatgaaggacgtcgccgcaatttggaagatgacggcaaacgcgccatcaaacgtggcaaggcttccaaggaatggcgtggtcgccagcataagccgatgaaggccaaggatcatccggtgacgcaaatgtggtacgcgcgccacaacatcatcacgccggaaatgcgctatgtggcggagcgcgagcattgcagcgtggaattggtacgcagcgaactggccgcagggcgtgcggtcatgccttgcaatatcaaccatcccgaagctgaacccatgatcatcggctcgaagttcctcaccaagctcaacgccaatatgggcaattcggcggtcacttcgtctattgacgaggaggtggagaagctcacgtgggccaccaagtggggtgccgacactgtgatggatctgtctaccggtaacgacattcacaccactcgtgaatggattctgcgcaactcccccgtgccgatcggcaccgtgccaatgtatcaggcgctcgaaaaggtggaggatgatgcgtccaagctcagctgggaactgttccgcgacacagtgatcgaacagtgcgagcaaggcgtggattacatgacgattcacgccggtgtgctgctgcgtttcgtgccgttgacggcgaatcgtatgacgggcatcgtttcgcgtggcggttcgatcatggccgaatggtgtttgcagcatcatcaggaaagcttcctgtatacgcatttcgatgagttgtgtgagatcttcgccaagtacgatgtcgcattctcactgggtgatggacttcgtccgggatcgcttgccgatgcgaacgatgcggcacagttcgccgaactgatgactttgggcgagcttacgcagcgcgcatgggaacacgacgtgcaggtgatgatcgaaggacccggccatattccgttcgacaccgtgcgcatgaacatcgagatggaaaaggcgatctgcaaggacgcgccgttctatacgcttggaccgctcaccaccgacaccgctcccggctacgaccacatcacgtcggcgatcggcggtgtggaaatcgcccgctatggcactgccatgctgtgttatgtgacgccgaaggaacatcttgggctgccgaataaggacgatgtgaagcaaggtgtgatcgcatacaagatcgcctgccatgcggctgatatcgccaagcatcatccgcatgccatcgaccgcgacaatgccatgagcaaggcacgtttcgaattccgttggcttgaccagttcaacctgagctacgatccggacaccgccatcgcgttccatgatgatactttgccggccgagcctgcgaagatggcgcatttctgttcgatgtgcggtccgaagttctgctccatggccatcagccaaaacatccgcaaaaaattcggtaatgccgaagcacaggagaagctcgtcgccgacgcgcaaaccatcgctgccggcatgcaagagatgagcgagcgcttccgcgagcagggcggccatctgtaccagtagaccgaactgtagtaggttgtgacgaacgggattgtctggtgtgtagaaagccgggcaatccctttttgtcgcttatgccgatatggagcactccgatagggacaactcttttgcttgtgggcctgacccgtcaagccggtccgctcccattgggcgaacacctgaccggttttgtcgagcacggtttgtggggtttccaactgtgtgcgatcctcgtcaagctgcaattggtttttcacgtccttgatctgcgcgatcggcagtccactatccagacaagagggtataagcactcccccacggtcagtacatggctctaacctgaatttatgactcttcttcagctgaaatatattgtgaaaatcgtggaatgcggttccatgaacgaagcctcgcacgagctgtacgtgtcacagcccgcgttgagctcgtctgtgaaggaactcgagaatgagcttggcatcgagatcttcacccgctcgtcgcaaggcatcgccttgaccgtggacggagcggaattcctcacctacgcgcgccaggtgctcgatcaggcgtcgctgctcgaagaacgttacaagaacgcgaagccacgcaagcagctgtgttccgtgtccacacagcattacatgttcgccgtcgaagcgttcgtggaaatgatcaactccatcaaatccgacgaatacgagttcaccattcgtgagacgcgcaccaaagacatcatcaaccaagtggcgaacatgctttccgaaatcggcatcatctacctgtccgatttcaacaaagacgtaattggcaagatgttgcgcgaaaagcatttggaattccatccactgttccgtgctccgttgcatgtgttcatttcacgcaacaatccactggccggcaagaagaaagtcacgatggacgacttgaagccgttcccgttcatccagtacgagcagggcgaggagggcagcttcttcttcgccgaagaggcggtctggccggaatactcccccaagcagatcaacgtgaccgaccgtgcgacgattctgaacttcatcatcggtctgaacggctacaccgtgtgcaccggcatcgacaacggcgatctcaacaatgagaaaatcgtgaccgtgccgcttgacaccgatgagaccatgctggtcggctggatcacgaacgagcgtgcgaagctgtcgaaggccgcggaaaactatttggagaagctcaagtcggtggtggccgaccatggatacaacctgatcgactgaatgcactctgatatgagattgaaaagtgcctcgcaccgatgctttcgattggtgtgaggcacttttcatatgtcaactataggacccgcctatagaattcaggcaccatactgctccagataagcgtcggcagcggccttgatctcgtcggtcacatacgcggtgccgtcagcggtttcgatatgctggccggcctcgaagatctcgcgcacgttggcaatggcgaataccgggaagccgaactctgcttcgacggccttcaccgcggacgtgtcggaatccttggtcttttccatacgatccacggaaagcaccaagccgacgacctccacatccgcttcggccttgagcttgggaatgacctcgcgtactgcggtgcctgcggtcatcacatcgtcgacgagcagtaccttcatgccgtcggtcagctgggtgccgaccatcatgccgccgtcgccatgatccttcttctccttgcggtcgaaggtgtagccgacttccataccgtggccggaagtcagagcgatcgcggtggagacgcccagcggaatgcccttgtaggcaggaccgaaaatggtgtcgatgtcgttcggcagattgcctgcttcgatttccgccgcgatcttctccgcatagaatgcgccgagcgtggcgatcttacgtccgtcgttgaatgcgcccgcattgatgaaatacggcgacttacgaccggacttcagcgtgaactcgccgaatttcagcgcctgcgcttccagcaggaacttggtaaaacggtggtcgagggattcagtcatgtcatgctcctttgatgaatgatcgaggtcaacgccaagtttcgcccttggcgagcttgtctgcgagttcgggacgtgcgtcgagcagctcgtcgagttcgcgggccacacgcaatggcgcggtcggttcgaacagtgcggccgcaccgacttccacggcgttcgctccggcatacaggtattcaagcgccttctcaccggaatcgatgccaccgatgccgatgatcggagtgttcggtaatgcggagcgggtcttccacacggccacgagtcccatcggcagcacggccggtccggaaacgccgccggtcacatggtcgatgatcggttctccagtgcgaatgttgatgcgcatgccgagcagtgtgttgatcatgctcagcgcgtcggcgccgctttccacggccgcgcgggcaggcacggtgatgtcggtgacgttcggcgtgagcttgacaatcatcttcttgtcggtgagcttgcgcaggcgggtgatcagacggctcaacgccaccggatcagtgccgacgctcatacctccggcggacacgttcgggcagctcacgttgatttccagcatgtctgccggagaatcattcagcttggacacgacttcgacatagtcgtcgtcgcagtgaccggccacattggcgatgaccgtggcgttgatggccttgagcttgggcaggtcgtcttccaaataatggtccacacccgggttctgcaggccgaccgcgttgatgttgctggatgggccttcagcggtacgaatgccgggattgccttcccatggcaccggggagacgcccttggtggtgaccgcgcccagttggctcacgtcgtagaaccagcggaccgccgcatactggaaggtgccggaagccgtggcgaccggattcttccacggcacgcccgccacctgcgtgggatgcttccactcgtacgaaccgtacaggttctcatgctgggtatcgtcgatcatctcattcaccccatcccaaacgttcgcgagtaaagaccggaccatcggagcagaccttcaaacgtccgtccaacgtgtcgaccgtacacagcacgcaagtgccatagccacagcccatgcgctgttccaagctcagctggcacgccatgtcacgcttcacggcccatgcggcgacggccttcatcatcggcagaggaccgcaggtcagaatcaccggcttgagtcccgaatccatcaactcgccttcgatgcggtcaagcaaggtgatcacgttgccttcgctctcgtcgatgctgtacaccttgtcggcatacttgcccgcatattcgtcgccgaaacgcacgttgcggtagccgaacaccgcggtgctgaccgcgccttcgatgccggcgatatgctgtgccgcatgcacgagcggaggcacgccaagacctcctgccacgagcacataattggcgggctccttggtcttgaacgaattgccgagcgggcccatcacacgaatggtgtccccagctttcaatccggcaaattctgcggtgcccttgcctaccacggcgaacatgaggctgacttcgtcgccgttggtttcgcaaacgccgaacggacgcggcatcagcttgcttggatcgttggaatatacgtcaacgaattgtgccggctttgcatggctggcgatgtattcgtcacggaacgtcaaacggtacacgccgtcagtcagttcctgattgtcaacgacctcgacttcatgccggctcgggaaaaagcctgccgcagtcgcttcggcaacggtcggaacgaacgttgttgcggtggtcatgaactccctctctgttacgttcgatggtttggtggttgtttttctttcagattgaacagttggccagtcggcaggttacggcaagaccgcacgcagattgtcacgcatatctttggctgcctcacgggctgattccgcaaccagatccagagcatcgtcggcgctcatggattcagaatacttgccggactttttccatgcaccgataacgccacgtgacgagttgacaagcgcacccatgccgtcacggtcgaacatgccggccacaccttgcgcggtgccgccttgagcgccgtatcccggtacaaggaagaacgtgtgcggcatgcgtgcgcgcaatgccttgccttcctctgggtgcgtggctccgaccactgcgcctacacgtgaatagccgttcttgccgatggtttcggctccccagccttccaccagatcggcgacatgctcgtatacgcgttcaccggaggcgagttcgagttcctgcagttcactgctagacggattggaggtgcgtacaagcacgaaaatgtctttgtcgttggctgtggcggcgtcgacgaacggtgtgatgccatcggtgccgaggtatgggttcacggtcaccgcatcctcatgccatggatcataggcggtgtcgtccaatcctataccgctgaggtgatgagcatatgcagccgcggtagagccgatgtctccgcgcttgacgtcgccgagcacgtacaggccctgctgcttggcgtattcgcaggtcatggtgtaggcgtcgatgcctgccggaccgagcgtctcatacatggcgatctgcggtttgaccgcaggcacgatgtctgcgacggcgtcgatgatggcgcggttgaattcgaagaaggccacggaaagctgcatggacggcgcttccgccggatcttcaacctgttcgctgatttcctcggcaaagccggccacgatttgcgctggcacgagcgcttcggtcgggtcaagtcccacaacgctcggattctgcttggcttcgattgcttcgatcaggcgatccatcaatcctccttgttgatacggctgaagactagtttcgagccgatgatggtggcgagcggacggccggtgacctgccatccaccaaacggggtgttacgagccgaggaatggaatcgttcaggattcacggtccatgcctcgtcggtgttgagcaccaccagatccgcgcggtcttctgcaggaaccttgacgaggtccagcacgcgtttggtgtcgtcgtctccggggacggcgtctgcgtattcgtcaagcaacgctgtgacgtcggccttgctgtggcccataagttcggctggcgcagtcgacatgagttcaatcaggcgttcgtcggagataaagccaccgtccacaagaatcttgtggcatacgccatacgcgcattcaagaccaatgatgccgttcggagcatcgaggaaaccaaggtccttctcttccatggtatgcggtgcatggtcggtggccagcagatcgacggtgccgtcagctacggctgcgatggttgccttgcgatcctcttcggagcgcaacggcggattcatcttggcgagagtgccgtatttcagcaatgcttcatcgcacaacgcaacgtagtgcggtgcagtttcgcacgtgatcggtaagccttcagctttggccttgcgaatcgcgtcgaaagaaatcgcagtgctgacatgctggaagtgcacatgcacgccggttttgcgcgccatctcgatatcgcgttcgacgattttcagttcggtatcttcgggaatgccgggtacgcccagttctcgtgatacgggaccttcattgaccgccccggtgtcgtggtgttcgcaatgctcgatcaggtataagcctgatttcttgacgttgtcgaacacttggtcgaggatttccggtgttaccgcggaaccgtcatcgctgatggcggtcaccgggtggcacagctggtaggcgtccttgttgtcgtcatcgtgttcaggcaggtagccgatccagtcggccacgtcggttgcttccttgcctgcacgccctttggaagcgcatacgcacaggtcataacgcaccggcaaggtcacatcatgggcttgttcgtaatgctgcaaatagtcgatgaccgtgtcgaaaccggcgtcgagcacttcactggcgcccggttcccccgccgtcaccttcacgccatccatggcgggaacggtgttcggcatgatgagcacgttcgtatacccgccagaggcggcagccgcgcaaccggaaaccatggattccttgtaggtctggcccggatcgcggaagtggacgtgggaatcttcgaatcccggggcgatggtcatggccgaagcgtccaccgtttcatcagcgtcagatgggacgatcaggtcgatgacttcgccggtgttccaaaccttgatgtcgtgaagggtgagggtcatgggtcagaacttcgcttcctcgtcacagtagtcgcagcggtattcctgacggtcggaatgcaccaggtggaacatctgtacggccggctcggtggtagtcacgcagcgcgggttcacgcatttgatgatattgaccacatgttccggcagtgtaggctgctttttctctacgattttaccgccgcgcacaatgccgacggttgcggtgcgtgccacaaggccgagcacgtcaaggtcgatggtttcggcttcctcttcgctttcgattttgatgatgtctttggtgccgaacatgtggctgtcggtgttcatgatcagcgcgagcttggtcttagccggatcaattttcaggtattcgagcaccttgagcgcggtgccggcaggcacatggtcgatgatgatgccgttctgaatgctggtgacttccatcaggctgcaacctccttggattcaagcggttcatatcccggcagttcgtctccgaccaccgagctttccaatgccatgcgcataagcatgccgttcttgacctgttcgaagtaggcagcgcgtgggtcgtcatccacttcgacggcgatttcgttgactcgcggcagcgggtgcagcacggccatgtctttcttggcgtaagccatcttggcttcgtcgagaatgtaggtgtcgcgcagtcgcagatagtcgtcttcgttgaagaagcgttccttctgcacgcgggtcatgtacagcacgtcgagatcgccgatcacggaaacgagatccttgacttccgtgtaggagcaggagtcggtggcgttgatgcggtcgagcacatactgcggggtcttgagctcatccgggctgatcagcacgaagttcacgttgccgaaacggcacagggtttcgatcagggaatgcacggtgcgcccgaaagtcagatcgccgcacagtccgacagtcagattgttcacgcgaccgaagcgcgactgcatcgtcgcaagatcggccagagtctgcgtggggtgcatatgtccaccatcgccggcgttgatgaccggcacggaggctgcacgggacgccacgagcgcggcgccttccttcgggtggcggatcgccaccacgtccacgtagttggacacggttttcagggtgtccgaaatggtttcgcccttggtcacggaagcgagctgggcgccggcgaagccgatcaccttgccgccgagtcggagcatggcggtttcaaagctcagacgcgtacgggtgctgggctcataaaataaagtggcgagcaccctgccgtcgcaggtgtgcgccacttctttacgatgagaatcaatgtactgcgccttgtggagtaattcttgaatctggcgaatggaaagatcatccaatgtgatgacgcttttcccgaccatcggcgtttcaaccgcctgttcgagtactgaagacaacggctcacctttcatgcaacttgtggttgaaggtggccactcgaagtgacctagccaactatagcctgaaatgcagaccctgccagttcaccgcgtgttcacaagtattcgtggcgcaacctccatccttccatgcacgaaaccctgaatcagcataaccgtcagagccgtataacttcggtccgacggccacaccatgctcctagccgttcaaatggcacgactcacgaacgaccgtagaacaggcgttccgttacgtcacgggctttgcgtatcacggcgagcaggtcgttttcgaaatgttggccgcgattcgcatcgtaaccgagatacacggcgatgcctcccagcgaatatgaatcgtccggcaaaatatcagcctgattgacgcgtccgctccacagataactgccgttgcgcgcggccgtgcacatacgccatgccttacgcaacaccacagcatcgccagcggaaatcagcttgcgatgttccaactcgttcaatgcctgcaacgtaccgttgacacgcaagttggcattgtctcccgcatgctgcaattgcagcaactggatcgtccactcaacgtcagacagtccgcccttgccgagcttcagatggcgatccctacgtactccgcgcggcagacgttcagcttccatacgtgccttgagtttgcggatttcggcgatctgcgtttccgtaagatcgattttcggataacgcaacgggtcggcgatgttcatgaggaaatcctcggcaagagacgcgtcgcctgccgcatatcgtgcgcgtaatagcgcctgatgctcccatgtgcttgcccaggatcgatagtattcctcgcaggatgcgtaggaacgtacgagcggtccgtttttgccttcaggcctaagatccatgtcaagttcgatttttggttcgaatgtggttggaccttgcaggatcgcacgtaggtcttcctgcacttttcgtgcgaaaaggttggcttggtcgtcatcggcaccttcggccggcctgtagatgatgatcacgtcagcatcagagctgaagttcacttccctaccgccgtaccgtcccatgccgatgatggcgatcgccgccggagcttcgtcgatctgtatgtcgttgatgcgatgctggatggcccactgcagcgatgcttcgatggccgcgtcgtatacgtcggtcatgccggcgagcgatgcttcatcgtcgatcacgccactcatccaagcgagaccgatgcgttcgatttcgtgtctgcgcatggctcggatggagttggcgaaatcgttgatgttgccggcattgcgttcaagcgtcgccttggtttgaatgtcgaggctttctcgcgaacgtggttgcaaagagtcgtcgttgccgagccatgtgactgattcgacggatttgttgagtgcgtcgccgaggaatcgtgagttggatagtacgtggcataggcgttgtgccgcggatggtgaatcgcgtaggaatccgaggtatccgctttcggagccgaagttttcttcaagtttgcgccagttaagcagtcccatgtcgggattctgcccttcgccgagccattgcagtactgcggggagcaggatgcggttgatttttgccgcacgggagatgcctgcggtgagcgcggtgacgtgccgcatggccgcgtcggcatcggcgaatccgatggattcgaatcgttcctgcgtggctttcgtggagagttccacctgttcgtcgtcgagtcccgcgttgatgggcagcatgggccggtaatagatgtccatgtgcaggtgacgcacctcacgacgtgtctcatcgtatttgttgacgagttcttcgggatgcatgtgaaatgcgcgcgcgagtcgacgtagttcgggattttggttcagctcgtcgatggtgatgtctcgtttgcgttcaagaccgccagcgttggctttgccgaggtctgggaacaggtgggtgcgtttgagcgcccacatttgctggcggtgttccatcacacgttcgaatcggtagtcccatgaaagtttcttggcttgtttgcgtgagacgtacccgccttcggccaaggcctgcagggattcgagtgtggagctggtacgcaatgcttcgtcggagcggccgtgcacgagttggagcatctgcacggtgaattcgacgtcgcgcaagcctcccctgccgagtttgatttcgcggtctttcagcgggttgggaataaggtcttcgacacgtttgcgcatctgctggcagtcatagacgaagttgtctcgcttggaagctgtccaaacgaacggtcgggtcatatccatatacgcttgtccgaggtcggtgtcgccggctaccgggcgggctttgagcagggcctggaattcccagttttccgcccattgctcgtaataggcttcgtgggattcgagtctgcgtaccagcggaccgtccttgccttcggggcgtagtccaccgtcgatctgccagagtgtcggttctgcgacgcccatgatgacggattggcatacacgttgcagcgtggtggccattttggtgccgattcggctgagtgccatgccgttggtgtccatgtcggcgggttccaccacgtagatcaggtccacgtcggatacatagttgagctcctgtgcgcccagtttgcccatgccgatgatggcgaaacgcacatgttcgctgccgtccacttcatggcgtgcgatggcgagcgcgccttcaagcgccgcgtccgcaaggtcggaaagttcggtgctgatgcgcggttggatttcgatgggatcgttcgccgtggcgtcttgcgccatgattgcggcgagttgtttgcgataggttttacgtagcgccgtcgcagcttcggcaagtggcaggcttgcggtcggcatggtgtggtcattgggatcggctcctaccgatttgagcacatgcgctctgcgctgttcgtgattgtaaaggtggctttcgcaggcatcgttggctgcggcctccacgagttccgggcggaatcgcatgagcttgcccatttcatcggatacgccgagcacggtgatcagtcgcacgaaagagttttcatcggcgatgatgttggtgaaatccttgccttgactttgcatcactttgatgatgtccaccaggttgctgagtgcgatgtcgggatcgcacgctttttccagcgtggctagtagcagccgcatcctgtcgccatcgatgccgtcattgtgcagctcgtcgaacaacgtgcgagccctgtcgagatcttgcagccctgctcgaatcagatcaagcgccccgaacttgtgttgcatggaagtcatggtttctatagtaaccgctgataaaaccaagggcagttgcgaaatacccgcaaccacccttgatgtttgttgcatcgcctgaaatcagacgaagaatggtttgacgttggaccaaatacgtctgctgacgcatggatggttcatcgtatacaggtgcacaccgtcgacgccccgcgccaccagttcgcagatctgctcggatgcgtaagcgatacccgcctctttaagcaaagccttgtcgcttccccatttatcgagcataatgccgagtttttcggggatcttcgactgacatttgctcgacatgttcaacaccgatttcgcgttcatgactggcatgatgcccgcttcgatcggcgcatcgatgcctgcggccctcgctttgtcgaggaatctcaggaaatcctcgttgtcgtagaacagttgcgaaatcagatgcgtcacgccggcatcgactttctttttgagattgtcgatgtcctcttccagcgttgccgactgtgggtgcttttccgggtagcaggcgccgtagattttcatgtccggacgttgctggcggatgtatacggccagatcgctggcatgttcgaacactcctgccggttcggcaccgtcgatgcggtcgccacgcaaggcgagcacgccggagaccttggcctgttcgaacatgtcgagtgcctggtcgacgtcatccttgttcagatactgcgcggtcagatgggccacgctggggatgccgtattcgcttaccgtgtgggcgatgcgcgcggtcaatgtacggtcggatgatttgccggtgccgtaggtgacggaaatgaaatcggggtccaacccctgcaggccatccaacgtgtcgtagatggtgcctacaggggaggttcgcttcggagggaacacctcgagcgagaacattggcgaatgcatggctgtcgtcttgttcctaacgtttcgccttatttggtcagcttggcacgcacagcctgggctgcggccacgaggttttcgaggcttggccaggtttcggcgttgccgcgggtcttcaaaccgcagtcggggttgatccacaccttttcgacgtccatcttcttgaggatttcgtagatgcgttcctcgatttcggcttcggacgggatgcgcggcgagtggatatcgtagacgcccgggccagcttcggtttcgaagttggcgtcgtgaatggcgtcgagcaccacgagatcgccgcgggaggcttcgaaggagatcacgtcggcgtccatggcgtcgatgtcggtgatgatgtcgttgaactccgagtagcacatgtgggtgtggatctgcgtggtcggcttgaccgcggagtgcaccagtcggaatgccggaatggcccagtcgaggtacttcttgtgccagtcggtcttcctgagcggcagcttttcacgcagggcggcctcgtcgatctggatgaccttgatgcctgcggcttcgaggtcgagcacttcgtcgcggatggcgagggccagctgctgggtctgctgctcgtgggtgatgtcctcgcgtggccaggaccagttgagaatagtgaccgggccggtgagcatgcccttcatcacatggctggtacgggactgtgcgtaggcgctccattccacggtgatcgggttggcgcgggacacgtcgccccatacgatcggaggcttcacacaacgggtgccgtaggactgcacccaagcgttcttggtgaacaggaaaccgttgaggttctggccgaagtattcgaccatatcgttacgctcgaattcgccgtgcacgagcacgtcaaggccgatctgctcctgatgcttgatgcaggcgtcgatctgcgccttcatgtattcgtcgtattcagtcttggtgatttcgcccttgcgcagtctggcgcgttcagcgcgcacttccttggtttgcgggaaggatccgatggtggtggtcggcagcaacggcaggttcaacgcctcccgctgtgccttctgacgttcggcacgtgccggctgacgcacgaagtccgagtcggtcagagctgcaagacgttccgccacgttcttgtcggcggcgacgcgggtaccgtcgaagagcgcctggttggcggccaatgccccggatgccttcttgtcttcctcgctggcgtcggcgagaaccgcgaggtcgtgcagttcgccgagcttttcaacggcgaaggcgaaatgcttgcgcacatcatcggcgagaccgtcctcaccttcggtgctgaacggcacatgcagcagggagcttgcggtggcgacggccacattgccggtgaccttcttcagcgcgtcgacgagtccaaggctgacggcgtaatcgttacgccagatgttgcgtccgttgaccacaccggcgaagatggtggtgctctctgcgacgccgaacttttcaacggcggcgagattctcgtccttgccttcgttgaggtcgagtccgatgccgtcgaagccgagcaggttgacggtctcatacacgtcggcgatgtggccgaagtaggtgttgagcagcaccttgatcttgccgtctcgtgcgggcaggatcttggtgtacaggctcttgaacagttcgacgtcgcccggctccttgtcgagcacgaggtacggttcgtcgatctggatccattcggcgcccagctcggcgaacttggccacgacctcggcgtagacggcggcgaccgcgttgaccaggcccttgtcgtattcgagttcttcggcctgcggattgcgggcgagcttgaggaaggtgtacgggccgatgagcaccggcttggtggtgatgccgagcgccttcgcctcgttgaattcgtcgaacggcttggtgctgttgagcttgatgtcggtggcttcgtcgacttccggcaccagatagtggtagttggtggtgaaccacttcttcatcggcagcgcggtgacgtcgcccttgtctccttggtagccgcggcccatggcgaacagcgtctcttcgggattgtcgaaggcgaggcgctggtagcgctgcggaatgacgttcagcaggatggcagtgtcgagcatttggtcgtaatagctgaagtcgttgctcggaatcaaatcgattccggcttcctgctgcagcttccaatgcttggcgcgcagctccttggcggtggcgcgcacgtcgtcgagcgttgcgacacccttccaataagcttcgataatcttcttcagctcgcggttctggccgatgcgagggaaaccggagacggaagtgagaacggacatgaatcctccatctgatatgaacaatgcaacccgctcaagctaccacgaaatcgccagctataactcatcaagaaaatttaagtgtcgctataagcacgatttatatcagttggcatggcaacatttcacgcctctcagcatcatgccgagaggcgaaggaatcattcaaaatccttggccgtcagcaatgcgatgagttcgccactgtgcagctgccattggttgaatggctcatttgatccgaacacggcgagcgatgccggcgacatgcccagattcagcatgtcgagcagcattgcatccgattcggagctcgccagccattggcatgcgatcgacacagtgggctcatggccgagcaccaacagctcgcgatgcttctccttggtctgggcaagctcgtcaaataccgactgcaccccaccttcgtacagactctgacgatagtcgaccttcgggtcgtcgccgaacaccttaagcatgcgatcgcaagtctgcctggccctggtggcgctggagcacgcaatgcgcgtcggcaccatcttgtgcgcggccaggcctttggcgacggctttcgcctgcttacgccccttgtcggtcagctcacgcccggcgtcgccaccgtcaccaaacggctcggttttggcgtgacgcatcaccagcaacacatacttgtaatccttggcttttttcgcaaccttcttgaggctcgttcccatggacgaatgctccaatccttaacgatccagcgtatgtaccaacgcaacgcgctatgactattgtctcagaacaacggcaagaaacaccgtatcaatcgccgatagcctcgacctgcgcgtcgagatcacgcagcaccttacgcaacttgcgatcggaaatatcccgcaactcaagatcttcgagctgttcggcacgttcttcggcgctcagcgaatcaatatcggtggtcgtgtctttcgtggcacggtcacgcttgcgcaacgcctgaaatcccggcgccatagcccgcgaaaccataaggaagccggtgtgtccgatcatctgatggtcgggacgtatcgccaatccctgaaccttccagtcgcgttccagagtctcctggatatccggttccgtccagcagccagcctccctcaacgcctccgccatacggcttagctgcgtagtagtggtcacatacgccacgagcacaccgccgggcgcaatcactcggtatgcctgctcaagacggttccaggggtcaagcatgtcaagcatgatgcggtcgaaggaatgctccggcaatgtggcggcgaccgaatcgaaatcaccgattttcagatcccaccatgcggggcgcccgccgaaatagaccgtggcattcgcttcggccacgcgggcgaattccgaacgcatctcgatggtggtcagtcttccacgctcccccaccgcgtccagcaggttgacgctcatggcgccggatccggcaccggattccaacacgttcatgccggaacgaatgtcgccaagctgaatcacttgggcaatgtccttcggatacatgatctgcgcgccacgaggcatcgacagcacataatcggccaaccgagggcgcatcaccgcgaactgccatccgccaatggcgcgcgttcccttccaaggcttgttggcgtcgcgttccggatgatcctgattgatctgcgcctcacgtttggcgctcaccgtcaccaccacggacccttccgactgcccgatcacatcgtcatgcagaatgatgccgtgcgaggtctgcgtcacaccgcccggcaccaattggtcggtgatcttattggatctgcgatccgtgaactgtaccttctcacccgccgtcaacggtcctcgacgcatcaatcactccttcatacccacacggattccaccatcacgacagcacggaaccgaatgactcctgtccgacgctattcatgctacagcatattccggcgcacacagcacccgttaccgcgcgtacgcgctccaacgtccattcgcatgcgtcacctcaagctccaaaccgaacacttcgctcaaccgttccgaagtgaaaccgtgttccagatcacccgagtacacgatggtgcccggagccggatcgttgcctgcgacattgtcggcgtaggcgtcggcctcgctgccggtgatcctgcccatgatcgccacatggtcgaatccctgcggaatctcctcaagacgatgcgtcaccagcaccacggcacgatccgactgctcggcgccgacacggctcaacgcacgaagcgcaatctcacgaccgcccaaatcaagaccggtagtcggctcgtccaaaatcagcagatccggatcagccatcaacgcacggcagatcagcacgcgcgtacgctcaccttccgaaagtttgaacatcattttaccttcgagatattcgataccgaattcacgcatcagggaacgcgccttggcatagtcttcgtcggtgtaggtgtcgcgccaacggccggtggtcgcggtcaatgcggtcacgatggcgtcgagcggatcttcttggggagggaacgcgcgactcagttccgcggagctcaaaccgatacggttgcgataggagaacacatcgaccttgcccaagcgattgccgagaatgtcgacggtgccttccgacgggaatcctctggtgctcatcatttgaaccaagctggatttgccgatgccgttgggtccgaacagcacccatttctcgcccttgttgattttcagattgaccttggtgagaatcacgcgtccacggcgacgaaattccacgtcagcgagttccagtgcgatgttctgctccggcattcttcctcccctatcgttgttcggcttgtagatatggaaacgccttccgccagcataatgctttccgcggaaggcgttccacgcatcgtctacgtggtgaactggttattcggcggttttgccctgctcggcaagcacgtcttcatagaccttgacggtcttgtcggcgatcgactcccagctgaagtggtcgcgcgcacgctcgtaaccggcctgtcccatctgcttcgccttttcaggatcggccatgatgcggttgatagcgtcggccatgtcatgcacgaacttgtctggattggtcggagtgccggtgccgtcgtgcagctggtcgacaggcacgagatatccggtttcgccatcgacgacgacttcgggaatgccgccggtcgcggaggccaccaccggaaggccacacgccatggcctccaagttcacgataccgagtggctcgtagatggatgggcagatgaacgcgtcgcaaccgtgctcaagcgcgttgagctccggcttcggcagcatctcctcaatccagatgatgttgccgcgctcctcgtcaagcttggcgaacgcggttttgacctcgttcatgatctccggagtgtcgggcgcgcccgcgcatagcacgatctggatgcccggatcgacgaaatgcaacgcctgaagcaggtatggcaggcccttctgccgggtgatacgtccgacgaacagcagcgtgggcttgttgcggtcgatattgtagcgttcgaacaccttccagcccggatcgtcgtcggatggggtttcgaactggctcatggtgataccgttgtgcaccacgaccaccttgtcggggtcaagattcggataggcgctcaggatgtcttcgcgcattcctgcggacacggcgatcacgcggtcggcatgctcgtatgcgtcacgctcggcccacgagctcaaatcgtagccgccacccagctgttcacgcttccatgggcggaacggttcgagggaatgcgcggtgatgaccagcggcgttccgtgcagcatcttggcaaggtatccggccaagcatgcataccacgtgtgcgcgtggatgatgtcggcgtccacatcgtcggcgatctgcagatcgacgccgaacgtcttcagcgcgccgtttgcttcctggagttccttgggaacgtcgtatccgacgaccttgagcgaacctttcggattgtcacccgggatttcgggaatctcattctcggcacgtggtccgtcaaacgcacggaccgtcacatccacgcgttccgccagaactttggaaagctcctccgcgtgcacgcctgcgccgccatacaccttgggcggatattcacgggaaaggatgtcaaccttcatatctgtgctctcctcttcgagtcaggcagttgttccatcactactgtaaggcaatttttcaatgaaacgcctgattgtttcattcgtgtcacaaagttttgcatctttcctaaaaatgcaggcaaggaggtcaataaaccaggaacgaatagtgccgtcattcgtgactcgcatgtgaaagcggggctgcatccttccatcggatgcagccccgctttacgttcatcgccttgctatcagacggccgtaccattctgatcgaggttcggattatgcttcgggttacccgccgtgaagaacaggctaagcacaccgacagcgaagacgatggagaccgtggcgaccaaccacatgggatgtgacggcagccacatgatcaccaggaatgcgattgcggacagtgcgatgagcagccagctgatcacgcggaaccattggcgtgcggaatgcggtgccttgaacatcttcgggttcgtgtagttcgggctggtggtcagcaggctttcggtttcttcgatggtgccgccggtcggcttccaaggtccatcggtaccgtcttgcagtcggcgggacttttcctgcagctggtattcgtccagcattccggaacgtgcgcggccatgggtttggtcgtactgctgcggcactcccctgcggttgttctttgcctgcgctcgacgttctgcacgatttggcattgggtcactcctttgttgcgatgtgctgcagttcactttactgcatgactgccggtttttcgccgaacggcacgtcattcggacgtttatgccacgtctgtattgttcgaggttccgggaagtggggatatgaaaaatcgtccgattccgttttggcggagaatcggacgatttttctgttacgttaactgcttatgttcagcgcggcagcatcatcggccttttggatgcgacgatgggtgccggcagttcggtggcgccggtgaggtattcgtccacggcggccgcgcaggaacggccttcggagatggcccacaccacgaggctctgaccgcgtccggcgtcaccacaggcgaacacgccgtcctggctggtagcgaacttgtcgttgcgcgccacattgcctcgtccgtcaaggtcgacgggcagctggtccacgagcgtggtggtgtccgggtgcaggaagccgacggagatgagcaccaaatcagccggaatcacgcgttcggtgccgggctggcgggtgaacggtccgttttcgccgggtgcaacgttcactaccttgagaccggtcacatgtccgttctcatcggccacgaagccttcagtagcggtggagtgctccaccttcaccttggcctgttcctcttcggtaccgacgaagttcacagaatccgtgctgtacacgtactcggcgcgctgggtttcgaagccttcttccatggaggaggtcttctggtacaggcgcgcgaaggtcggccatggctggttggccgggcgttcgcttggttcctgcggcatgatctgcagcacagtgacgtccttggcgccttggcggatggacgtgcccaggcagtcggatccggtgtcgccgccaccgatgatcacgacgtgcttgccttcagcggtgatgtcgttgactggcttgacgccgtagacgcggcgggtcgcgtcgggcaggaattccatggcaaagtggatgcccttgagttcacggcccggaatcttcatgtcgcgcggcacggtggagccgatggcgacgaccacggcatcgtagcgggatcgcagatcgtcccatgagatgtctttgccgatctccacgccggtgcggaacacggtgccttcggcttccatctgttccacgcggcggtcgatgagtcgcttgtcgagtttgaagttcgggataccgtagcgcatcaggccgccgatggcgtcatcacgctcgtatacgaccacggtgtggcctgcgcgggtaagctgctgggcgcatgccagaccggacgggccggagccgaccacggcgacggtctggtcggtcaggcgctgcggaggcaatggcttgacgtagtcgagttcccaagcctgatcgatgatcgtgcattcgtcgttcttgatcatggtcggcggctggtgaatgccgagcacgcaggccgcctcgcacaacgcggggcagatgcggcctgtgacttcggggaagttgttcgtttcggacaggcggttgtacgcgtcctcccacttctcctggcgcaccagatcgttgaattctgggatgatgttacccagcgggcagccgctcatgcagaacggtgtgccgcagtccatgcatcgggccgcctgttcggtggtccaaggctgcaggccggattcggcgtggacgtcgaaccaatccttgattcgctcctcgacggggcgttcggccagttcgcgacgggtacggaccttcaggaatccacgtggatctcccatgtcagcgcgctccttccataacctgctcgtacacctgttcccagacgccgggcgtattgaaatcgatgttgttctcttcggcgttcttcatcgccttctgcatggcgaggaagtgcttcggaacgatgtgtgtgaatcgcttggatgcgttctcccagtcggcgagcagtccggccgcgaatgcggagcctgtttcttcggcatgctgcttgaccagaccgtgcacgatttcgttcgactcactgtcgagcggttcgaacagcaacgcgccgttggcggcggcagccgggttgacctgcttcatgtcaaggtcgagcacgtacacgtggccaccggagaagcctgcgccgaggttgcgacccgtgggaccgaggatcacgacggtgccgccggtcatgtattcgcaaccatggtcgccgacgccctccaccacgaaggtggcgccgccgttgcgcacgccgaagcgttcgcctgcacgacctgccacgaacatctggccggaagtggcaccgaagccggtgacgttgcccgcgatcacgttctcatgcggatcgaaggtgatgcccgcctccggacgcacgaccatgcgtccgccggaaagtcccttgcccgcgtagtcgttgacttcgccgtacacgcggatggtctcgccacgcggaatgaacgcgccgatggactggccgcccgcaccatggaacgtcatgtcgatggtgtcgtcaggcaggccttcctcgccgtaacgcttggtgatctcgtagccgaccatggtgccgagcgtacggtacacgttacggatcggcatctcgatgcgcaccggctccttcttctcaagggcgggctgcgcgagctcgatgagcttgttgtcgagcgccttgtcgagctcgtggttctgctcgatggtctggtgcaggatggttcccggcaccggtcccggctgcatgagcacgttgctcaggtcgatgccgtcagacttccaacgcttgatcgcttcgttctggtcgaggcattcgacatggccgacggcctcttccaaggtgcggaagccgagctgggcgagcagctcgcgtacttcctcggcgatgaacatgaaaaagttgatgacatgttccggcttgcccttgaagcgtgcgcgcagttcgggatcctgggttgcgatgccctgcgggcaggtgttcttctggcaggcgcgcatcatgacgcagccttcgacgatcagcgcggcggtggcgaaaccgaattcctcggcgccgagcagggctgcgatcaccacgtcgcggcccgtcttgagctcgccgtcacattgcacggtgatgcgggaacgcaggccgttgagcacgagcgtctgctgggtttcggacaggccgatctcccacggggtgccggcgtgcttgatggcgttgagcggagccgcgccagtgccgccgtcgtagccggagatcagcaccacgtcggcatggcacttggcaacgcctgcggcgatggtgcccacaccgaactcggaaacgagcttgacgtgcacgcgggccttcggattggccatcttcgcgtcgttgatcagctgcttcagatcctcgatggagtagatgtcatggtgcggcggcggggagatgagctcgacgcccggagtcgcgtgacgcaccttggcgatccacggcggaaccttggcgccaggaagatgtccgccttcgccaggcttggcgccttgggcgagcttgatctgcaggtcggtggcgtgcaccaagtagtcgctggtcacgccgaaacgtgccgatgcgatctgcttgatcttgctgtagcgcagcggatcattgatgcggtcttcggattcgccgccttcaccggagttggaacgtgcgccgatggtgttcatggcgatcgcgagggtctcgtgcgcctcctgggagatggagccatagctcatggcgccggtggagaaacgcttgacgatctcgctggccggttcgacctcgctgacgtcgatcggcttgcgaccggacttgaacttcatcaggccgcgcagcgtcatcaaacggttggaggtgtcgttgatgtgcgccgagtacttcttgaacatgtcgtagtcaccgcgctgggtggactgctgcagcaggaagatggcttcagggtcgttgaggtggtcttcgccggtacgacgccacttgtattcgccgccggtgcgcaggttgcggtgcgggcgggcggtccactgcgacgggtaggccacgcgatggcggatggcgacctcttcggccagttcgtcgagtccgacgcctccgacgcgggaggtggtgccggtgaagtattcgtcgatgacgtccttgttcaggccgatggcttcgaacagctgtgcgccacggtagctcatgatggtggagacgcccattttcgccatgatcttgagcacgccggtcgacaacgcgttggtcaggttcttcaccgcggtttcggcatcgacgttgagatagcccttgcgggacaggtcttcgacagattcgaacgccagatacgggttgacggccgccgcgccataggcgatcagcagagcgacatggtggatttcacgcacatcgccggcctcgacgaccatggagatctgggtgcgcgtgtgtctgcgcagcagatggtgctgcaccgcggaggtgagcagcagcgacggaatcggtccccacgtgtagttggagtcgcgatcggagagcacgaggaagttggatccgttttcgatggcttcgtcgacttcctggaagatctcgtcgagacgttccttcagcgccttgccgccgccagcgacctgataaagacccttgacgacgaacggcttatagtagccgccgaggatcttggcgcggtcgaggcgcttgagctgcgccatctcgtcggagttgagcaccggcaacggaatgaggatcttcttggcatgcagttcggaatcggccagcaggttcggctcgggaccgatggcggattcaaggcaggtcacgatcttttcacgctcccagtcgagcggcggattggtgacctgcgcgaacttctgggtgaagtagtcgaacagcatgcggctgcgggaggaaagcgcggccataggcgcgtcattgcccatggatccgagcggctccttgccggtgttggccatcggggcgagcagcagcttcagatcctcttcggtgtagccgaaggcgcgctggcggcgttgcacggactggccggagtggttgacgtgctcgcgcttgggcagctggctcatctcgacggtgttgccttcgacccactgacggtacggatgctgggacgcgagggacttcttgatctcctcgtccgggatgatgcggccttccttggtatcgacgaggaacatcttgcccggttccaggcggcccttggacacgatgtgttcctcggcgttctccgggagcacgccggtttcggatgcgagcacgatgtagccgtcgtcggtaagctgccagcggccggggcggaagccgttgcggtcgagcagcgcgccgacctgggtgccgtcagtgaagatgatgtgcgccggaccgtcccacggttcgatcagcgtattgttgtattcgtagaacgccctgacatcggggtcaagctggtcgttcttctcccatgccggcggcagcatcatggagatggcatgtggcatggaacgtccggacaggtgcagcagttcgaggcattcgtcgaacgtgccggaatcggagtagcccggggtagcgatcggcagcagcggcttgaattcgccgagcagttcggagcttaggcggccttcacgtgcggacagccagttgcggttgccctggatggtgttgatctcgccgttatgggccagctggcggaacggctgggccagcggccagctcgggaacgtgttggtggagaagcgggagtgcacgatggcgatcttcgccttcatgcgctcgtcggaaagatccaggaagaagggcttgagctgcatggtggtgagcatgcccttgtaggtgatggtgcgtgcggacagggacgcgaagtagatgcccacctcgtgttcgacgcgcttgcggatgcggaaggtcttgcggtccagttcgatgcctgcgagctggccttcggggtcggccacgaccagcgtcttgaacgcgggcatgctggcgagcgcctgcagtccgagtccgtccgggttggtgggtacgacgcgccatgcgagtacttcgaggccttcttcgcgcacgattttggcgatggcttgttcttgttgtccggaggtggcgatgtcgcggtcgaggaatgcgatgccggcggcgtagtggccttcttcgggcagttcgacgcctgcggtggcgcgcatgaattcgtcgggcatgctcatgaggatgcctgcgccgtcgccggtgttttcttcggcgcctacggctccgcggtggttgaggttgacgagcacttcgatggcgtcgtcgacgattttgcgttcggggcgcttgttgagggtggtgaccatacccacgccgcaggcgtcgtgctcggcgccgggatcgtacataccttgggaatcatggatcgtgagatctaacggggcgtggaaagtcaccgaaaccaccttcaatgtttttgggcaagaaaagtcttgcggttctttaatgcgtggtttagaataccgcgcccctgtatcaaatacgtttcgcgtgtccatataacgaatactcggaaaagtcaagactgttttttcttgggaaaatgtggaggatatgtgttgggttgtggtggttgccggtatcgatgcgtgtcgttatgctggtggttgtccgaagagtacaggggagccgatgtggctgagatgggcgtttgcccggacccttatgacctgaacagggtagtgcctgcgtagggatgttacgaacggtgcgcgtgcgcgtcttctctgtgctgacggctggtgtttggccgtgtgtttcgtggaaagagaagggatttggcgtgtctgatgcgtcgcaggtgcctgagcagcttggttcgggttcgaagaagttgactccgaagaatgtgctgctgggtttgcagcatgtgttggtgtccaatgtgtggcttgatccggtgtttgtggctggtgccattggcttgccgttggcgttgtcgtcaaatatggtgaatgccattttcattgtgtctggtttggtcacattgattcaggccacgaggttggtgcgtttgccgattgtgcagggtccgtccgccgcgttcgatgcgttgatgatcgctgcgggcactgctggttcgttggctgccgctggtacgtcgatttttgtcagttcgctgattttcttggtgctgtgtctgacccgtgtgattgagaagatgcgttttctgttcgcgccgatagtgtcgggcgtgattatttttctggttggcgtttcgctgtcgagtttcacgttgagcgagtttcttggtggcgctcccggcgatgatggttttgccgatccgaagacgttggccgtgtctatcgtgacttgcgtgctggtggtggcgctttcccagttcggcaagggtatggtcagggcgctttcctatctgattgctctggttgccggcactgcgctttcgatggtatttggcatggctgatttttccggtgtcgcgtcgaagccttggtttggtcttcctcagattatgccgtatggcggttttgactttgatgcggcggtgtttgtgccgttcttcatcgcatatatggttgcgattatggaggcgcttggcgtgtatcaggcggccagtgagatccagggcgtcaagcttgaggatcgtcaggttcgttatggtttggccggcgaggctgccggttccgcgatttcttcgatgatcggcggtttcaccactaccgcgtatccgcagaatgtcgcgttgcttaaggtcacggatgagggcaagacccgtacccgtgtgccggtgatcatcgcctgcgtggtatttgtggttcttggtttcattccgaaggccggagcggtattgtcgttgattccttcccctgtgatcggcggcattttcctgccggccgcggcaagcctgatcagcacgggcttcaatacgctgcgcaaggtggagtcgaacgaccgttcccaggcggtcattggattgtccctgctgttgggcatcgcgctgccgagcgcgttgagcggcttggagggcggcgctcacgtgttcttctccaattcgattctggttggggcgttctgtgtggtgattctcaaggcactgctgatcgacctgccgaatctgatcaatcgtcgtaaaggaaacagcgaagctgaagttccgtcgcagatctgatttgctttcgaatatcagtatcgtttatagaaaggaataccgcatatgacatcaatgtcgttgggtgccgacgcgcaggaagtcaaggcaaacgtgcttgagttcatcgaaaagtatggttgcgaggtcgctccggatgaggcgttcgacgcgctcgcacataagattttcgctttccagtttgcccataacatgcagtatcgcgcgtattgcatgtctcgtagggtgactccgcagatgttgtcggattggatggatattccgccgatgccggtggatgggttcaagatgctgacgctcacttcggtgcctgaagatgattgcgaggcagtgttcatgaccagcggcactacgcatccgggtcagcgtggacgcaactatcatcctgatcttgaggtgtgggatgcgtcgatgatcggcccgttccgtcatttcatcatgcctgaccgtgagcgcatgcgtatcgcggtgctctcccctgcctgggagatgaatcataatggttcgttggcccgttatctgacgcgtgcggtggagcagtgcggcagcgagggcagcggcttcttcttccatgaggatggtttggacttcgctggtgtggaaaagttccttgatcagtcggtggcagacggcgagccggtgatgctgatgggcgcttcgtccgcgtatctgtatctgcttgactatcttgccgagcggggcaaaacctatgcgttggcgaaggattcgcgtgttttcgataccggtggtttcaagagtacgaaaaccgatatgaccgtcgatgatttgtatgcgaagttccttgaggtgtttggcgtcgcacgcacgcattgcgtgaacatgtacggtatgacggagttgagttcgcagatttacgatcagaatctgctgtcgtactatacggatggttcgtcgaattatctgaaggcgacgccgtcgtgggttcgttccgtgttcctcgatccggcgacgctcacgcctgtcgccgatggcgagcagggggtgatcgcgcattacgatttggcgaattggaattcctgtctggcgattctgaccgaagatcttggcgtgcgcaccgattccggttacgagctcaacggtcgtgcgaagggtgcggaggcacgcggctgctccatcgccgtcgacgaggtgatggcggcaaacgcatgagcgtcatcgacattttccatgcgccgcgcggcttcgtatttgaggatttcgaaacacgcggcgttctcaccgaccgcggtgaggtcacgttgcgttatccggtactcacgcctgagactgtccaagatttgtgcgagacaacgcgttgcaatcgatcgcagacattggcagcatattccgtcgaacacatcgtcgacatcatcggcgaggcggtggaattgtggacgaatcccgattatgagggtcgccagatagcggagtctctgattccctccatcaccggctatgacgcgacgatgacgcgtatcgaactgaaacgttacatgcgcatgttccgcagacgcgaactattgcgttttcttgatgacgaactgccaagcccgcgcatgctggacgaataccgaccgaacaagtccggcggatacacgcgcctgtacgggccggacttgacattccacgtgttttccagcaatgttcccggcattcccgtatggagcatgaccatgagtctgctgacgaaaagcgcgatcatcggcaaatcatcgttcgacgaaccgctgatgcccgtactgttcgctcgttctctgacacagatcaacccggatctcgccgacgtattggccatagtgccgtggcgcggcggcacagtagagcttgaagacgtggcgatcggcgaagcgaacgccgtgatcgcctacggttcgtcgcacaccaccgaggcgatccgtccacgcgtgagcgcgggcaaaccgttcctcagctatggcgcacgcatcggcttctcactcatcggacgtgaagcgctacgcgcggacactcacgtgcaaaccgtgcaccgtatggccgtggacgtggccacctacgaccagcaaagctgcctggcgccgcaaaccatcttcgtggaacgcggcggagccatctcccccgctcagacggcggaactgctcgccagcgagctcgactcgcaacaacgcaaatatccacgatcaaccccttccgacacggaatccctcgccatccgcagggcacgctctcaaaccgagatgcaagcgctgttcatgacgtccatgactccagacagcgccgcacaggccgacccacaggcaccgttcgtcatcgaatcgccgcaaggcaccgactggaccgtgctttactaccccaataccagcagtctcccctcgttggggacaccgctcaaccgcaccattaacatcgtcgccgtggaccaactcaaacacgcgctgcccacactgaaaccctaccgcgagtggctgcaaacctgtgcgatcgccacaagctcatccagactgttcgcactcgcgcaacaagtgggcgaatacggcatcgaccgcatctgccccgtcggagaaatgaaccgcgcgaaatccggatggcaccacgacggcggattcaacatcctcgacctcgtcagagccgtcgacatcgaacgcaacaccgaccgttacgccgacaccttcgacatcgactacgaataatcccaaaggaccttacgtgaaccagcaatccgaacaccggacactcaccggcaaaaccgccatcatcaccggcgcaagccgaggcatcggcgccgcaatcgcactcagactcgcacaactcggcgccaacgtgaccatcgactacctaagcaacgacgaacgcgcccaacacaccaagcaacacatcgaaaacgaagcggacgcacaaggacgcgtcatcacatgcaaagccgacgtgaccgacgaaacccaagtcaacgaactcgcacaaaccacagccaacaccttcggcggcatcgacatcctcatcaacaacgcgctcagccactactcgttcgacccacgcaaccgcaacaccttcagcaacaccagctggaacgactacgcgacccaactcgaaggatgtctcaaaggcacctacaacacctgcacgaccgcgctgccctacatgcgacgccaatcatggggacgcatcgtcaacatctccagcaacctcgtagacagcccgatcgtcccctaccacgactacatcgcagccaaaggagcactcatcggattcacgcgctcgctggcgcaggaggccggagcgtggggcgtcacggtgaacgccatcgcggccggtttgactgtgggcacggattcgagccgcgccaccaccgaagacgtccgcgagcgcatcatcgcgcagacgcctttgggcaggcttgccacggctgatgatattgcgggcggtgtggcgatgctggttggcgaggacgctcgtttcgtcaccggtcagacgttgcatgtcgatggcggactcacgatgcgctgattacgaacatccggtgacagcctcgttctaagctctatgccatcgggcctggaatgcaacaacctgcatccgaggcccgtttcaatctgcacactgtatccacccataccaagatggatcatctaaaaccaattcgtcagaggattatcggcattacaacgagcaggcgtcgaagaaacgctcgatgacggtgtcgttgagcaagcgtccggttcgggttggaatcacacgtccgtcacggataacgataaggccttcgtcttccatgggctggatgcgagccatatcaaccatgtttccaaggcgactcaaatccagaccctcacgtatgcgcagaccaagcatgatgatttcttcgaggttctcctcgttggagattcgttcgcttcccgaccatggcacattatcatcgttgatagcctgcccccacatgcgaggatgcgcaatatcccagctgcgcaagcccgacgatttgaccgtttcagatgtttcagccgacgtggactgttcaacatccatcacattgccgtaatggctgtgtgcgccgggaccgagccccgcccaatcaacattgcgccaatagccaagattatgttgcgattcataaccaggacgtgcccaattgctgatctcataccattcaagaccggctgcgctcagtagatcgtcggcaatctcatacttggtcgcctcatcgtcatcatcaggcgtaggcaaggttccaacagcaatctgacgtcccattttcgtgttcggtgcgacggtcaacgcatatgccgaaatatggtcaacacccaagtcgatcgccgtccgtacggaaacacgccaatcgtcgagactctcccccggcgcaccgtaaatcaaatccacgctggaacgcatgccggcagcatttgccgctgcgattcccgccgccacattggccggggtatgcgtacgatccaatgttttcagcacgcttggcacagccgactgcatgccgaaagagatgcggttgaatccgccgtccgcgagttccttcacgtaatcggcgttcaccgtgtccggattcgcttcggtggtgatttccgcattgtcggcaatgccccacgtgtcacgcacggcattcaacatggcgaccagatccgaggctttcagaatcgtgggagtgccaccgccgaaaaagacggtggccgcttccggttcgttaacgccatgcgcgatctgccaatcatggacgattgacatctcgcgaatcaccatattggcgtaattgccacgcgaagcgcccgctcccatgtcgacagcggtatacgtgttgaaatcacagtacccacagcgccgtatgcagaacggcacatgaatgtaggcttcgaacatcagccttcggttttctgggcggcgcgaatcttgtctttggtgtcgcggtcgttgcctgcgtctccggtcgacaatgcggcgatgaacgcctcctgcggcacctcgacatggccgagcatcttcatacgcttcttgccggccttctgcttttcgagcagcttgcgcttacgggaaatatcgccgccataacacttggcgagcacgtccttgcgcagtgcgcgaatgttctcacgtgcgataatgcgggagccgatggcggcctgaatcggaatttcgaactgctggcgaggaatgagctcacgcaacttcttcgtcatcatcacgccgtaggaatacgccttatccttatgcacgatggcgctgaacgcatcgaccttctcaccctggatgagaatatcgaccttcaccagatcggcggactgttcgccgtcctcatggtagtcgagcgacgcatagcccttggtgcggctcttcaactggtcgaagaagtcgaacacgatttcggccaacggaatgcgataatgcatttccacacggtcggcggaaatatattccatagtgcccatctgtccacgatggtcctggcacaagtccataaccgcgccgatgaattccttcggagtgatgatgtcggcggcaaccaccggttcgacgatctgcttgatcttgccgtcggggaattcgctcggattggtcacacgatgcacggaattgtcttccgcggtgacctcgtatggcacgttcggtgcggtggagatcaagtcgagatcgaattcgcggctcagtcgttcggtcacgatttccatatgcagcaggccaaggaagccgcagcggaaaccgaaacccaacgccacggacgtttccggctcgtagatcaaagccgcgtcgttgagcttgagcttgtcgagcgcctcacgaagttccggatactgcgcgttgtcgattgggaacaggccagcgtagaccatgggctgcgggtcacgatagccttcgagcggatcggccgcaggcttgagcgcggaagtgatggtgtcgcccaccttggactggctgacgtctttcgcgccggtgataacataaccgacctcacccgcaccaagcgccttcgtaggcatcatgtctgggctgatcacgccgatttcaatcggatcatgggtcatgccgatacccatcatgtgcagtttctcacgggaacgcaactcgccatcgaccatacgaatgtaggtgacgatgccgcggtaggagtcgtagacggagtcgaagatcagcgcacgcgcgggagcttccggatcgccggttggtgcaggaacgtcggcaacaatgcggtcgagcagttcggtcacgccttcaccggttttaccggacacgcgcagcacttcggaaggatcgcaaccaatcagacctgcgatttcctcggcatgcttgtctggttccgcgctgggaagatcgattttgttcagtacaggaatgatggccagatcatggtcgatggccatatacaggttcgacagggtctgcgcttcgatgccctgcgtcgcgtcgacaagcagcactgcgccttcgcatgcggcgagagcgcgggaaacctcataagtgaaatcgacgtggcctggagtgtcgatcatgccgagggtatattcggtgccgtcgaacgtccacggcacgcgcacagcctgcgatttgatggtgatgccacgctcctgctcaatatccatacgatccaggaaacgatcacgcatctcacgttcgggcacgatgccgctgagctgcagaatacggtctgccaccgtggacttgccgtgatcgatatgcgcgatgatgcagaaattgcgaatcaacgactgatcggtgaaaccgggctggttatgctgctggcccacgccatcctcctcttgaaatattcgacgcaaacgattctaactgctagtatcggcatggtgagtcgcgacactcctaagcccgttggcaatttatccgcgcgccatgttatcatcatcgtttgtatgtccttatagaaaacgtcgtttggagaaatagtggcaaacattaagtcgcagaagaagcgcgttctcaccaacgagaaggcccacaagcgcaacgtggccgtgaagtccagcctgaagactgccgttcgcgccacccgtgaagctatcgccgccggcgataagtccgcagcagaagccgcctacaaggtcgcagctcagaagctcgacaaggctgctggcgctggcgtgattcacaagaaccaggctgctaaccgcaagtccggtcttgccgtggccatcaacgctctctgagttttagaagctcacagctaacgaaaatcccgcaggtttttcctgcgggattttttgttacgcaaatgtcttccgtttaattaccatctcactgtcgctacctacgcttgtcacacttgcgtttgtcggaatccttatcagaatgaatgaccggtcgtttcaaatatttcgcttcacttggcagatatgtattatgacgcaccaacgctcccggaagctgaatgtcgaaaatcaccgataccaatcgcatgctgaccatcaatgcgacgatcagcagatcaagcaccacttcggctggaaaactgacgattccagcgtccacgcctttgcagacaagcaccgtcagtacgcaccccacggcagatggaaccgcataccaatgtttgtcacgaatcaccatcggcacttcgttgatgagcatgtctcgaatcaggccacctccaagcgcggtgaacatgccgagaaaaaccgcggtcatgcctgacgtgtggtacatcatggctttgctggtaccgttgaccgcatacaatcccaatgccagagcatccaacgacagcatggaccatttgagcctgttgatttcgggatggcacaccgcgacggccaccgaagccagcagagcaacgatcaccagtcctttatccgacacgcctaccggtggcgcgatgcccagcagcacgtcacggatgattcctccgcccaatgcggtgagccatgtggtgacgagaatcgcgaagatatcgtagcctttgcgcacggcggcaagtccgccgcacatgccgcagcagaacgtcgccaaatattcaatcccccaaaagaaggcattactctccaacgccaccgacatgctttcccatccttttcccttccctcacttcccccactctcggatttcgcgacttcccatcgtacacaataagccgaggggcggggaacatggtgttcgaccgtaggcttggccgaacggccttgagtgtgccgaataccatgttccccgcccctcggcggactttgaactataagtcagtcgcgaaaaatcagcagaccttccacatccagttgtgcggatcctcgatctcgccaagctggatgcccagcagctggttgcgcaggttcacggtgaattcgccggagttgccgtcggcaacggtcacgtcgaacttctcggacttgaaacgaccgatcggggtgatgatggctgcggtaccgcaagcgaacacctcggtgacttcgccggacttgatgtcttcgagcaactggtccagagcgatcatggtttcgaccacgtcgtggccgttgtcctggatgagctgaatcagggagcgacgggtcacgcccggcagaatgttaccggtcagagacggggtctctacgtggccgtccttgtgcacgaccatcatgttcatgccgccaagctcctcgaggtaggtcttggtagcggcgtcgacgaagcagacctgctcgcagccgtggtcgatgccggtgtattcgcccagcagggatgcggcgtagttgccaccgcacttggcgaagccggtgccgccagggccggtgcggaaccacttgtcttcaacccagatgctgaccggcttcacgccgcctgggaagtacgggccggacggggatgcgatcacgcagtagtccacttcctgcggagcacgcacgccgaggaacggctcggaagcgaacatgaacggacgcatgtacagggtgtactcgcggcgggtcggaacccagttcacgtcacgcttgacgagggcggccacggaaccgatgaaatcgtcgatcggcagttccggcaggtacagacgcttggcagagttctggaaacgctcggcgttcgcatccggacggaacagccaagtggagccatcggcatgacggtaggccttcagaccttcgaagcattcctgagcatagtgcagaacggatgcgcccggatccatcttcagcggcgcatacggctcgatgcggcggtctccccagccttcgcccttggtccaagtcatgtgggccatgttgtcggagaagacctgaccgaatgccggcttgtcgatgagttcggcacgtttggcgtcggatgccgggttgtcgttcgggagcacggtgaacttctcggtgagcttgtcaagctctgccggatcgtgatgattctgttcagtcattctttacttcttcttgttgcagccgcccgaaagcggcccgcggttgttggtatcccagtgcttgtggcaccggttctggttagtaactttcccacatcataatctctttcgattacaagcgttcgcgatatgagataggaagaaacatcctgcgaaaaagtcgccgccctcacgcctgattgatgctccatagactcggaacgtattctgaattgttcaaaaaatgactgtgcctcattccccaaaacaccattatgacgttcaggtctctgacagcgggatgtgggtgagaatgatggggcgagtagtttcgacgtcgtagcacaacatgccgctgtcgcctattggggtgaggagacttcatggcggaaggcgctggaaacgcagccttcccaacgctcgtcgcgttctgcgtgttccgttcgtcgcttccggtcatgctgcgatcctttcgggtgaagcatgcaagccaaccctccgatgtattggcggatactcgaaaaagcagtaccaccgtcattagacggggcaataagattgttggcgtcacgatgcttgtttcagcggcgttctcccggattgcggatctgcatggccgcgccgtcttccatgattgagaagccgtgcttctggtagaaggtggcgttcttgctttcttccggcatgacttcaatataaaggtagtcgcgatatctctctttgaccatgcccaccaggtggcctgcgatgccatgaccctgatattccggatcgaccagcacgtaatgcatataagccaccatctccgtgtcatcgagcacgcgcaccaagcctaccaagcggtcgccgtcccatgcgctgaacacggtggacgatcccatcagagccttgtacagacgttccggatatttgcctgacacccatccgacggatcggaacagttgctgcgtccgttctttggtgaacttcttttcatcggtatacgtgattcccatagccccgagcgtggttgcatgctacgcgcggactgaagccagtctctgcattcggacgtgattttggaatcacgtttacgttggctcaggccagccagtaaccgcacgcaacggccatgacgggcacgacgatcgaagccagcgcatagccgatgaaacaagcgattttcccattgcgcaggagcgtaaccgtctcgttcatcatggttgagaacgttgagaaaccgccgagaaatcctgttgcgagcagtaggcggcagtcggggcttatggtgttcgccgcgaacaatcccgccaccaagccggcaagcagaccggccacaacattgatggcaaacgtcgaaagcgggaacgttttgcgccacaatgccttgatatacgaatcgcagatatagcgtgcggccgcgccgacgccaccgcatgcgcatacgccgatcgcaagcattgcgctcatcgaatcgcctccttgtcagcatgttcgtctttgtttcgttccgccaaccacgaaccgcataaggcaccggcgtaggcgagcgaaaaaccgacaatgaacgttgcgcagcaataggtgaggactctgggaatcgcatgatcgtcaatcatcatgaattcttccaatgcgagcgtggacatggtggaaaggcctccgcacatgcccatgccgaatccacgattcacgtattcttttgcacggcctttcaacaggctggaagatcccagccatgcggaaagcgccgcatatacgaagcaggccaccatattggccgcgaacgtaccgacatggaagccgcccacgtccgcaatggacgagctcgcataccgcagtcccgtgccgacgcatccgccaaggaataccaccgtcaccacatcaagccgaataatatgcttattcaaatgtttctctcttccgcaccgtctcactttgtctctcgtgcattgtttccatgcatcgtcagtcatgctagtcgttattcgattggaatgctgatgcatgtgacgtatttgctggaatcctgcgtcagatcattgtcgatcagtgtgatctcacgtgggaagcctaccaccgtcaaatgatgattctcgatatagtccattaatgtgcggcatcaggatggctgccgggaaaacggatcgtcacgcagtccgtctccggcagtacgcaatcgctcccttcgtacccgacagtgccatacgggttcactgaacgtataggcgagtataatccgtatccacccgttgtatcaatattgcgtaaggaatgcaggatttgccgtcagtctcttatgtcttccagctcatagaacgggtgttgccgggtatgaaaaagcccatgtgcgtctgagcacatgggcttttcatcatctcttacggttgttcaaaaccgtaaaatggaagtttgcttccttaagctatctgaactcactcagcgttttcagccggagcggtttcgaccggagcagcctcatcggcagcgtcttccggcacctcgacggtgacgacggactcttccggatcctcgacgtcgagcacaacgccttccggcagcacgacgtccttggcgaagaccttggaaccgtcggtcaggccgtcaacgttgaccacgatcttctccggcaggttggcgacatcggcgcgaaccttgagctcctgaatgtcgacgaatgcgacggcagcgcccttcggggtgccctcgacgaacaccggcacctcgacgtcgatcttctcgccggccttgacctcgtagaagtcaacgtgctcgacgatgcgcttcaccgggttgcgctgaacgtccttgacgacggccatcttggtctcgtcaccgaacttgatggtgaacagagcgttggtgtgacgcagggacagggtggtttccttcatcggcagctgcacgaagaccggctcttcgccgcctgcgtacacggtggccggaataaggttggcgacgcgcatgcggcgggcagcgcccttgccgaactcggtacgggcagcgccttcgagggtaatggtggtagccatgggctatttctccttatgttttattcgttcattctgtttcggcgcatcaacgagccgtgaatcaacccacaaggagcctacaatcacacgccgagtcgattacggaagccatacgcttccctcgccaagacaacagttaactagtatacggcgagggcggacattatcgaaaaacgtctcacatcaaaaatgaaaaaatctgtcaaagcccacgaaaacgccgtacgcacgtacaatcgatagtaattgtgaacaatccgtcaatcgcaaggaaacgagacagcaatgaagcatgacaatgacacaatcgttcgcgacatttgcatcgccacgggagccgtgacggctgcctgtatcgcatcgttggctacgactgcgaaatacctgttccatttctgcatcgatacgcaatggaaacgttccgttttccatcaatcgctgattgcgccggagcgtatcgaaaaacttcagcagggtgaggcacaggaagcaggagaatggttcgcgcaagccaaacagcctgtgacgattaccagcgatgatggacttcgactgcatggatggctgttcgatccggattgcactgcgccaaaaccacacctgtacgcaatctgcatgcatggttataccggtgtaccggaggaaaccgcgaaatgggcacatcgttacgcccgcatgggcttcaccgtattggttccgtcacagcgtgcccaagacttgagcgagggacggtacgtcggcatgggctggcttgaacgcaatgatctactgaattggatcgaccttatcgcgtcgagtgacgccgacgcccgtatcctgctgtatggcggttcgatgggcgcggcaacggtgatgatgacgacgggagacccgcgtctgccgcgcaatgtggtgtccgcgattgtcgatagcggctacacgtctgcgcgcatggtgttcatcgacagccttcggcattcgtcgcgtctgccgaaaccgcttgccgcggtatgtgtggatgccgcgggattgttctgcaaacattatgcagggtacgatttttcggaagccacctgtctgcagtcgctcagacatactgtcattccgatgctgttcattcatggcgaacaggacgacatcgtgagctcacgttttctcaagatcaattacgaagcgtgctcgagcatcgatcgagaaaagctcatggttcccgacgcacgccatatggaagcatccgtcgtggatcccgaactgtattggaacaccgtcaatgccttcatcaaacgcgcattcgaattgtgagccatgaaaactgtgtcaaggttcacatgagattttcctcatgcttatccccaaggtgaacatacacaatgttcatttgttggaaaatccaatgaaatcaacggcttacccacttctgccgcctcccggcacgctcaaggccacggaatacttcaccattatcttgttgtttgttcgtcgcagggcgaacaaacaacagagaggaacgaatattacatggccaatcaacatccttggcatgtcggccgtcttccttggacccttcgtcgaaaaggacatcaagaaatcggctttgatctcaacggtctgcttcgcctgcaggttcgccggtaccggagccagtatcgcggcaggatgcccccggcgtgctcatcttctatggcgtaatcatgggcattggattgggcgtcggctatctgacgccggtgaagaacctaatgctgtggttcgccaaaggtctcgccaccggcatcgccgtcgcgggattcggtctggccaaggccatcgcgggaagcatcagcgtcatcctgaccgtcgatgccgtgttcaacgctgccggtgctgcttgagcagcactttggcatgaagtcagtgtccaccgtgcacggactggctttgagcgcgtgggcgttcgccggattgtccggcaaccagttggcatccttcgtcgtctctcatgcgacggatgcggcccaccgatacagcgcgctgattccgatcatcaccgtactgtacgccgtcgctctcgcgtccatcatcgccgtgacgctcgccacgaaaggcaagggcgccaacgccttatcatcacgttgagcggcatgatacatcgttcaacacgctgacacggcggatgagcccatcaacgccttatgcggatgttctgggcattcgcttgttagccgccctgcgccggggaacagactttggttccgctccccggcgaacttcttcccattgatatatacgatgtatatgattccttcctttcccaatccatttccccgtattccaccgcatcgccttccgattcacgtacgctgacggtagccgtgaaaaacaatggcatcccctccgttgcggtcgaatatatggatcagataccacaattgcagcaataccatgacgaacaaggttcccctgcccgcgtgttttccgccacacaggtactgtagtgggtatggaacaatcatctggagctttcccgccgtcccgcatcgaagtgcgcggtgcctgcgtacataatctcaagaacgtcgacgtcgacattccgttgaacaaattagtcggcatcgccggtatctccgggtccggaaagagctctctcgctttaggtgtgctatacgctgaaggatcccgacgttatctggaggctttgtcgacgtataccaggcgacgtctcacccaagcgagtcgagcgcaggtagtcgacatacgtcatgtgcccgcggctctcgccctccatcaaagaccttcagtgcccggcgtgcgttccacgttcggcacgatgacggagctgctcaacagtctgcgtctgttgttctcccgttgcgcctcacatgtctgcgagcattgtggcgaacgcaaccgtcccacaatgaacgtggcggccgagttgcctatacgatgcacatcctgcaatcaactcatgcacccaccatccgccgaacagctgtcgttcaattccgccggcgcatgcccgacctgctccggaacaggcatcgtgcgaaccgtcgaccgtgcttccctggtaccagacgagaccaaaagcatcgacgccggcgcagtattaccatggggatcgttgatgtgggatctgatgaagcaggtgtgcggcgcgatgggagtgcgcacgaacattccattcaaccagctgaccgacgccgagcgggacatcgtgttcaacggcccggccgtcaagaagcatattctatacaaaccgaagaaaggcaatgatttcgccgaacttgacttcacgtacttcaacgccgtgtataccgtggagaacgcgctcgccaaagccaaggatgagaagggtatcaaacgcgtgtcgagattcctcagcgagcaaccatgtccggattgttccggtacgaggctttcacagcaggctcgtcaaccgcagattctcggtattaatctggcacaagccacggcgatgacacttgacgaaacgatacgttgggtgcgttcagtacccaagtcattgccgcaggagatgcgtgcgatggccacagccatctgcgaatcgttcgaggatacggccgagcggctcgtggaactcggattatgctatttgtcgcttgaccgcgcaggtgcgacactgtccaccggcgagcgccaacgtgtgcagttggcccgttcggtgcgtaaccgcactacaggcgtgctgtatgtgctggatgaaccgtctatcggattgcatccggcgaatgtggatggactgttgggcgtgatgcgcgatttggtggctgacggcaattcggtggttgtggtcgatcatgatacccgtgtgcttgccgcgatggatcatttggtggagatgggtccaacggccggtgccgaaggcggtcatgtgatcgctcagggtgcggtggcggatgttatgacggcacctggttctcagatagcgccttttctgcgtgatggtggcaaaatacatgagcgggcgcggccgcagattgacttagatgcgatgttcgccaagggtcggattcatttggagacgaataccgtgcatacggtgcatccgttattggtggacattccgcgaggacgtctcactgtggtgtctggcgtgtcgggttccggtaagacgacgatggtattggagacactggtccctgcgttgcgctcggccgctgatggtaccgtttccccgagctcgattcgtctgattgacgcggatggcatttcgaaagtggaactgatcgatgccacgcccattggagcaaacatccgttcgaccgtggcgacatattgcggtgttcacgatgatctgcgtcgtgcgtttgcgaagacttccgatgcccataagaagaatctcaaacctggcgcattctcatacaacacgggcaagttgcgctgctccacttgcgatggaaccggtaccatttcgttggacgtgcagttcctgcccgatgttgacgtcacgtgtcccgattgccatgggacacggtatgcacagaccgccgatgacattcgattggtttgcgcggacagcgtcgcccgttcactgccggaattgatgttgctaagcgtcgacgagatgatgcctctattggatttcctacgccccgttcgatcgaaactggccacactgcatgagcttggcctggggtatctgacacttggcgagccgactcctgcgttatcaggcggcgaagcgcaacggctgaagctggccagcgaaatgggacgcggacagtccgattcggtattcgtgttcgacgagccgacgatcgggctacacccgttggatgtgctggtattactacgcgtgttcgactcgttggtggcttctggggcgacagttgtagtaatcgaacatgatcttgatgtaatcgcgaacgcggattatctcatcgacatgggtccgggcggaggcatggccggcggtcgcatcgtatgcgagggaacaccggaaacggtccgtgcctgtcctgacagcgtcacgggcagatatctgcgtggatgatccgacgcgaactcgcccgtgacggtttcccatagctgctttcctcggggttgtctgggatacagtcagaaatcccagtcatcgtcgtcggtctcgactgatttgcccattacgtacgagcttcccgaaccggagaagaagtcatggttctcatcggcgttcggacttaacgcggcaaggatcgacgggttcacgtcgcagatctcttgtgggaaaagcgctggatatccgagattcatcaacgccttgttgccgttgtatcgcaggaacttttcgacatcttgcgtcaatccgacaggctcgtagaggctgcgcgtgtactccacctcgttgtcatacaactcgttgagcaggtcgtaggtgtagtcgcgcagttcgccgcgtttgtcctcgctgacccgctcaagccctttttgatatttgtatccgatgtaataaccatgcacggcttcgtcgcggataataagacggatcacgtcggcggtgttggtgagtttggcatgcgcggagaaatacatcggtagatagaagcctgagtagaacaggaacgattccagcagcgtggaggccactttgcgcttgagtggactatccccctcgtaatagtcgagcacgatgcgcgctttcctttgcagatactcgttctcctcactccaagagaacgcctcgtcgatctgtcgggtggaacacaaggtggagaaaatcgaggaatagctcttggcgtgcactgactccatgaacgcgatgttcgtatagacggcttcctcatgcggggtaagcgcatcgggtatgaggctgaccgcgccaacggttccctggatggtgtcaagcaaggtgagaccggtgaacacgcgcatggtcaacgtatgctcggcctcgctcattgtgcgccaaacaggcaaatcattggagacgggcactttctccggcagccaaaaattgccggtcaacctgtcccatacctcaaggtccttgtcatcctcaagtttgttccagttgatggcactcacacggtcaatgagcttaatcctctgtcgaggtacggatatcggcgccatgatggtcgtcctttctaatcgtcgtcttatcgtcgcggccgtataaccgcctgtattcgtccggagccgtcagacgaagcatcgcgcggtaaaccaaacgagacatgtcttttcttttcctttcaagtcacaggtttcacaacatgcaactgacgcagccttgtacttcggtgccagacaacgcctgctgacgaatgcggatgtaatacagcgttttgatgcctttgcgccatgcataaatctgcgccttgttcaaatctcgggtagtcgccgtatcggggaagaacaaggtcaacgacaggccttgatcgacatgccgcgttgcctcggcatacgtatcaacaatggccttccatccgatttcgtacgcatccgcgaaatactggagattgtcgttggtcatatacggagctggatagtagatccgtccaatcttgccttccttgcgaatctcaatcttcgaggcgataggatggatggaactcgtggaatgattgatgtacgaaattgacccggtgggcggcacggcctgtagatattggttgaagataccgtcacgtatgatgtcgtcacgcagacgacgccaatcatcctcgtcggggatatggatgccccgccgtgcgaacagcgacgcgattttcccggtcttcggcgccagcgagcgctcgccgttcgtatatttgtcgaaatagttgcctgcgcctgcaggcttcgcataggcggaccgttcgaagcctgcaaaccgtgttccgcgttcgactgcgagctcatgcgaggcacggtaggcatggtatgcaacggtcatgaagtacatgtcggtgaagtcgagggcttccggtgaaccgtacatgatcgattctctggcaaggaatccatggaggttcatctgtcccaggccgatggcatgaccttcgtcgttggcgcgtcggatggatggcacacacgcgatgtccgtatgttccgacaccgaggtcaatgcgcgaatcgcacgttccacggttcgtcccaaatcaccgtccatcgctttggcgatgttgagcgatccaagattgcaggacacgtcacgtcccacgtgattgtaggacagatcctcatgataggtgcttggctcctgcacttggaggatctccgagcacaggttgctcatggcgattcgtccgtcgatcgggttggctcggttcacagtatcttcgaacaccatgtacgggtatccggattcgaattgcaattcggccaaagtcatgaagaactctcgtgcgtcgatgtaggttttcccgatgcgttcatcgtccaccatattccggtagttttcgctgatggagacatcggcgaagggtctacccatgacgcgttcgacgtcatatgggctgaacagggccataggttcgtgtctcttcgccagctcgaatgtgatgtcgggtatcactactccaagagccaaagatttgatacggatcttctcatccgcgttctcgcgtttggtatcgaggaaatgcatgatgtccggatgatgagcgttgaggtacaccgcaccggcaccctgtctagcgcccaactggttggcgtagctgaaagagtcctcaagcagtttcatcacaggcacaacgccgctggactggtgtttgatgcgcttgatgggcgcgccggcctcgcgcagattgctaagcaacagcgcgacgcctccacctcgtttgctcaactgcaatgcggcgttgatgccacgcgatatggactccatgttgtcttcgatacgtacgagaaaacagctgaccgcctctccgcgctgcgccttgccgaggttgaggaaagtgggcgtcgccggttggaaacgtcctgatataagttcttcgaaatacgattcggcggccgcatggtcgccggcggcaagcgcgagcgcaacggcggccgcgcgttgcgggaagttctccaggtactgtttgccgtcaaaggttttcaatgcgtatgagcggtgaaacttgaaagctccgaggaatgtatcgaattcgaatccgcagtcatccacgttgcggtagaacctgtcaaggaattcggcatcatattgggcaaatacggattcgtcgtaatagccgtctgcgatgagccggctgagtctgtcttgtgtggagttgaaacggacggtgttcggcagcacgtgcttttcgacgtactcgcgtacggcttggatgtctttatcaaattggatgcgcccctgcttgtcgtagagattcagcatcgcgttgagcgagtgccagtcatgggcgcgatcgtaggaggctatgacgtcggttactgcgtgtggtgtcgttgaatcttctggcatggttatcgttgttcctgttgtgtgtattcgtcgaaaaatctgcgcagtccttcgcgcacggtcgcggtgtcttctgaagtgcccatcagttcgaaccggtagagtagcggcacgcggcatttagccgcgatgatgtcgcctgcgatgccgtaggcttcgccgaagttggtgttacccgatgcgatgacgccgatgatgccactgcggttgcgttcatcattgaggaatcgtttgacttgcacgggcactgctttgccgattgttcctccgccgtatgtgggtgtcagcaagacgtagggctcatccacatgcagctccggctcgtccggccgcagcgggatgcgcattgtatgaatgccgaattcatccaatcggcatccttcgacgaagcgtgtcgtattgcccgatgccgacgagaagtacaccaacgcactcaccggcagcgagcctccagctcgtggattttgtcgggacgatacccggaccaggattcgtcgtctgcgatgatgactggcatctgccgccatccttcgttccgcaatctgtcggaaatacgtgcgttggccgtaatgtcgacagtcgtatagggaaggcctcgtttgtccaattggcgtttcgtcgccgtgcattgcgggcagtttgctttggtgtataacgtaatgttcatgttccacgtcctttcacgaccgtacgtcgttggtatgtggcacacattatccgaacgaaaataaaaatcaagaccacaacatacagtgtctcgtcacattttcaaacactatatacggcgtgtttccagtattggcaacagttttgaagttctagagcaggacgtgggccggatttgtgggatttttcacatcggatgcaatcgttcttcaccgaaagccccatgccataaaaaggcatataggaaccagggtcttattcccttcgggaacccagccgtcactcactcaagttgaccttggacacccaatcatgcaccaaccgcagaaaagacagacatcccgcaccccggcaacgcagattcaggtttcttcgcagaaatctgcagagattctttcggtacctcttcgaccgagctgggaagtgtccgacataccacaccgaccaacggtatgtataatgtcggtgtattcgactccatcatcgaaggagaggcatatggcgcgcaatgcgcaccctgaagtgacacgacagcgaatccttgacgccgcgaaaaagctgttcgcgcaaaaggggtatgagcgcaccacgattcaagatattctcgacgagctcgaagacctcagcaaaggcgctatctaccatcatttcaaaaacaaagaagcgatgctgcatgcgctggtagattccgacaacgaacgacttcttccccaggcaaatcaagaggatggctcacgaaacggattgcagaaactacgcaattcgctcatgatgcagattaccgacaccgaacatatgaccctcatgcgcgatgcgtttcccctgctgaacgacccgaaaatcctcgccgaaaatcttcgcatctggcgaaccgacagcaccaaaatcgcatacgacttcatccaggaggggttaagggacggttcaatcacaaccgaataccctcaagaagccgcggaacttttttcactgctgttcaattactggctagccccaaacttctaccccatcactaccctaagtgaattcaagcatcgcatccactgtcttggattgattatggactcgctcggagttccacttatcgatcacgacagtgatatggaagatcggcttgcggaaggcttcttcctactcgccagtaatccgcaataaaagctcggcaatgtcaatctatctttatttgtacctttttttacataccgtcagtcggtatcgaaaggaatagtcatgaaaaactcgtcagcaaagacactccaatccagcttgcgctccgcaaacttcatcctgcttgtactcggtcaaggcatttccttgttcggcaataccatgctccgatttgccatgtccatgtgggtactggacgaaaccgcatcatccacgaccttcgccaccgtgctggccatatccgtcattccgaccatacttattagcccattcggaggtgttatggccgaccgagtaagcaaacgtgccatgatggtggcgctcgatatcatctcaggaatcgtcacactgctcgcgactgtgtttttcgcactatccggattcaacattctcgccatcgccatcatgcaggtagtgttggcagtactcgatgccatggaaactcccgtcgtgcaatccgcactgccacaaatcatcggaagagagtcctccactgatcttcgccgaggcgcggccatcatcaaccaagtgcagcagctcagccaattactcccgagtttcctaggtggcgtgatgtacgggctggtcggcattcgaccgatgatgctcatcaccgcagcatgtcttatgtcggcagccatggttgaatgcttcatcagactcgcaaagcccctatcgaatcaagatgatgccggcatctgcctgctcgacgtcatcattggcgatatgcattcggcgaccgctttcctgcttcgcaaggagccgaccgtagcacgattagccggtgtttgcacatggatcaatctgatactgactggattcagttcagtaagctttccttacattattcgaactacgttaggctacgatgcggcgacatatggtctatgcgatggcattatcggcattgccggcatagcgggaacattcatcgctggctgtttcgccaaccgtttgaaatcacgaaacgccccttcgttgttgttcgtggaaagtcttatgctgctcccaccggccatcgccttcctgcttccatgttcaacgcaaaccaagctcatcatgctggtgctctgcactgcggcagtcataatcgccgttgatttcttgaacctcattctcgtaccatctattcagatgaggacaccaaccgcgcttacaggcaaggtcatggccattatttcatcattgacgatatgcgcccagccactcgggcaaatgctttacggatggctgcacgcacattgcacggtttggcttatactgctgatttcagcactggcatcactacccttggcatggttggctcgcccactgtttgcgcaccttgacgatacgatttccaagtaaggcagggtaatgaagccgatatacgaacgtccgtatgctgagaatgccgcccaacatattgcgattcggcttgaaatcagccttccttaaacgaatgcctttctgcttgcaacgaatcaccaccagcgcgacgatcacactgatggtctgtgcaaagattatgccaaggaccgcatctgccggaccaagctgaaaatgccccatgaacaggtagacgagtgcgatattgaaacactgattcccaagctggcaggaaccacttggctgaatcactatcttgagagcctgccgaatctggaagcccagaaacagatgtgcagacaagttatcagcatgcgatgttcaacggctgacatcagttatacaggaatgttcgatcggggttctttggcacggcatgtccaaaattgttacgcctatgcggattggacgtccacgctggtggaagtgaattacgtaaacgagaacttctgtctgtcattcacacagaagttcgccacagatagatacgtaaaagcatttcgcgaattgttggagcaatacggcatagcatgcaccgagatcgaagagacaaagttcatctgaacgttccgccattcaatctcggcacaaccatgatgcatacgctttgacgttcgcgatctgagaggccgatcagtcgccgattgaaaccggcctcccctcgtttcctcccgtctcatccgcgcttcccatgtatggacccatcagatcgatatatcccttcgcgtcatgagcgagaagcgcacgcgttgcacgcagggattcgatatcccttggaaaacggtagagcgcaaccattgccgacaaatccctaagcccgttacaggcgtccattaatcgtttcttctcctttcgcggtgcgaaaagcgcatcatccctactttccggttccgggaagcagatataccctcccaatgtcatcgccaaccccatccctttaacggattcagtcgttcgtctcagactttccactccctgctggaacatcttgtcatcacgagtccggaacccttcagtaaggggccgcgagccgactgcccccaacagcgacagggcaagatcatgcaggtacagcggatcctcccaaatgttcgtcacctgatacgcgcccttctggtaaacgcgttccatgatttgcgaagctgattcagtctgcttgttccacaaagcacgatacgcttccacgattttccccgcatcgtacagatatcgcgcatccatacacgcgggatattcaagcaacatggattcggcaaggtcggcattgcaagcatagtccagatcggcttgaattctaagatcgcgcagatggtcgcacagatttcgataggagaagtcttcatcgcatccggaatccactactttcggatcgtccctcagcatgcacatgccgataccgccatatccaagcaccatcaacgcaacatcggccgcacgcggctcttcctcaccccaacgtagcagactgtacgcggccagccaatatacttcctgcaaatattcagccatgcaggccagtctcttctttttgctggtagcgtattttccaccctttttcttgcttctccgaaacacatccttggtgtaggtcaatccaatctggaatggcattctgctgctgggcctttgcaaagccaccgctatcgaagcgtcattgatcatttcatagagccaaacgctcataccgtacttacgcacgatgttacggcatccatcaagaaaattcgcatcatgctcaaccagatcataatcgaacgaaatcatggcccacgccagattcgccacccatgatgtgctgcagaataattccttccccagttcacagactttttcgtcaaaaagcgaaagagatccgatctcaccgtattcatcgtggatttttcccaattccgcaagatatttgccagaactgtatccatcaaaccgcttgataagttcttcgatcgttgccaaaaatccctgttcatccatatggaacgggccagtgattatttccgccatgtgcaactcctttgttgtagggtgcacctactgtctcatattcaaatcatcttgcgccaccgaaccttgaaaatctgtggatatgtggaaaactccacccatatccacaggcgaataacgactgtggataactcacaattcgcatgcaacagacctgatcttacgaaaatcaccatatgcaaaaaggtcccttccctcaccggaagagacctttcaggaaaagcatcaacgcaacgtttcagctgttagttgatgagctccttgactgccgcgataacggcctgcaggcttgccttggcgtcgccgaaaagcatctgcgtgttgtcttcgaagtacagttcgttctggataccggcataaccggtaccgcgaccgcgcttcatgaccaccacattctgggccttgtcgacgtcgaggatcggcatgccggagaccggggtgcccggcttgcgtgcggccgggttggtcacatcgttggcgccgaccacaagagccacgttggcctgcgggaactgcggattgatgtcatccagatcgacgagctcctcgtacggcacgttggcttcggcgagcagcacgttcatgtggccaggcatacggcctgccaccggatggatggcgtaggagacttcgacgccgtggttcttgaggagcacaccaagatcagcaagctcgcgctgggcctgagcctgggccagaccgaagcccggcacgaagatgaccttttcggcgtatacgagctgtacggccagatcgtccgcggaagtttccttcatgctgccttccggaccctcaccagcgccagcggcggcattggcaccaccgaaaccgcctgcaagcacggacagcagcggacggttcatggccttggacatggcgatggacagggtcacaccggcggcaccaaccagtgcgccggccacgatcagagcgatgttattgatagccaagccggacatggccactgcagtaccggtgcaggcgttgagtacggaaatgaccaccggcatatcggcgccaccgatcgggatgacgaacacgagaccgtagcacagcgcgaacacggtggtgagcacggaccacagcagacgctggcccggctgcacgcacagcatgacgaaggatacgacggtcagtacggcgaacagaatgttccagaagcccttgcccggcaagttcagcttcttcacccacttgatgccctgcagcttgccggctgcgatcagagagccggagaacgtgacggaaccgatcatgatgcccaaaccagcggtgatcaacaccacgatggaaggcgtgccctcggaggtcagaatgtcgttcaaagccacaagcgcggcggcgccgccacccacggtgttgaatacggaaacgagctgcggcatgtcggtcatcttgaccttcttggcggaaaccacaccggcgacggcaccgatgatgatgccggctatcagcagcacaacggcaacgccatgctggaatccgttggagatctcacctgcgaacagcacaatgaacgccatgaccacggcaaggatcatgccgacagcggagaccatattgcccttgcgagcggtcttcggagagttcatcaagtgcaggccgataacgaacatcacggcggccagcagatagacgaaccattcgatgacgccgagcggcgtgctcagcatttcagccatggtacccatttacttggcctcctcttccttcttcttgcccttgtcggacttgaacatctccagcatgcggtcggtgacgacatagccgccgaccacgttcatcgtgcccagcactgcagccaggaagatgaacacccaggcgagcgggctggtggcatgcgcggcgacgataacaacgccggcgatgacgatgccgtggatcgagttcgcgcccgacatcaacggagtatgcaaggtggccggcaccttgccgataacctcaacgccgatcagcagcgcgaggacgaacagagtaatcgcaacaacgatatccattgcttactccccttccttcttggcttcctcgccgcggccggccacgaccatggcgttgtcaagctcttcgttcagatcgatggccagcttgccgtcacgcacgaaatgcgcaagcacatcggccacattgcggctcagcaggttggatgcggtagtggaaacgccgcttgacaggtacggagcgccgatgatggtcacgccgttttcagtgacttgggtgccgacggtggaaccttcgacgttgccgccgaggtcgcttgccgcgcagtcgacgatcacagcgccacggtgcagtccggccacgccagccttggtcagcagaaccggaggcttgcggccgggaaccttggcggtggtgatgacgatatcgaagccggcagccttctgatcgacggcagcctgctgctgggcctgctcttcggcactcagcgcacgggcatagccgccctcgccctgacccttggagaagtcaagacccagatccaggaacttcgcgcccaaggattcaacttcgcccttggaagccggacgcacatcgtacgcggtgacaaccgcgccaagacgcttggcggtgccgatggcctgcagacccgcgatgcctgcgccaagaataagcaccttggccgggcggatcgtgccagcggcggtggtcatcatcggcaggaacgaaccgtacgcgttggccgccacgatggccgccttataacccattacggaattctgagaagtcatctcgtccatagactgcgcggagctcaactgacgcggcagcttctccatggcaacaccgaccagaccggccttttcaatcgcagtgacataatcggcgtcggtgaacgaaccgagcataccgataatccaggtaccctgcttaacgcgtccgagcagcgcgctgctcggacgatcgacgaaaccaagcacgtcggcacgcgcaatcacttcatcggcggagacgacctgcgctccggccttactataatcctcatcaacataatgcgatgcgacgcccgcaccggattcgatcaggcagttaacacccgatttacgcaacctcgttacgatatccggtgtcagagcaacacgagactcgtgttcggaggtctcattgagaactccgaagaccacggtggcttcagctgtttcagccataggtgccctttcttcctcgttaaagaaatcaaaatgaacagatacagcgcaccagtgtaacgtaggtcacacctttgtatgaagaaaagttcacctattgaatggcatcgcatggcaattcctttacgcaggccccgctggatgcgcactttccctacgctaccgtaaggtgacgtgtcgcattcatgggtctatcattcctacagatattggatttaaatgtgtaggagagtcacgtgtccgtcatcacctctttgaacaagcgagctgcaaatcttgcgcagaaggcactgcgtttgggaggtgacttcgttcaccccgtcagcgacgattccggcaacactccggattacaacgatccgaacaacatcatctcccccgacggccatatcgaccttccgcacaccgtcgaatggggcgaaggattcccatccaccacgttcctcgatccggaaaccggtctgttgaccaccaaaaccgagggcaagccgccgctggacgagggcaccaccatctacgatatttacgccgatcgagccgagcgtatgggtgacgagccgctctacacctataagacgaacggcgaatgggtgaccaaaaccggcaacgaggtgctcgccgatattcgtcagatcgccaagggtctgatgcattacggtcttaagaagggcgacggcgtggcgttcatgtgccgtacctcgtacgagtgggatgtgttcgacgcggccgtcatggcatgtggtggtgtgctcgccacgatctacgacacggattccgcggagcagatccgtaatatcgtcaataattccgattcccgcctgctggtggtcgagaccaccgatatgcgcgccaaagccgatggtgccgataaggaatgcccggcactggaacacattatctgcttcgagaacggcggtctcgacgaaatcatggcctacggctccggcgtgagcgacgaagagcttgacgagcgcatcgcttccatcaagaaaaccgacctgtgctccattgtgtatacttctggttccaccgccgcgccgaagggtgtggagatgacccatgagcattattgcaccaccgcgttgaatcttccggcgtatatgccgaaactgctgcatgagaggaagaacagcgtgctgctgttccttccacaggcgcactctttcgcacgtgccatcaactacatttgcgtagccagcgaactgcatatttacatcgcgcagggcatcaagacgctgatcgccgatcttcaggtcgccaagccgtccgtcatgatcgttgttccgcgtgttcttgagaaggtgtataacgcggcctcgcagaaggctggtcatggcgccaagggcgtggcgttcgccgcagccgttgtggcagcccagaattacatgaaggaggtcagtgcgaagggtaaggccggagctttggccaaggctcgccgtatggcgttcgacccggtggtctacgcttcgctacgcgaggtgctcggcggacgtgcccagtggatcgtggcgggcggcgctcctcttgacccggaacttatggcgttcttccgtggcgccggagtgcccgtgtatgagggttatggcttgaccgagaccacggctccttgcgcgttcaatccgcttggtgtgccctatcatcagggttccgtcggcgtggctttccctggcttcgagctgcgtatcgccgaagatgaggagattcaggtcaagggtaccgccgtgttcccgaagtaccacaagaacgaggaagcctccgaggattcattcactgaagacggctggtatcgtaccggcgatttgggacgtatcgacgatgacggcttcctgtatatcatcggacgtaagaaggatctcatcatcaccgcaggcggcaagaatgtctcgcccggtccgatcgaagaggttatcaagcgttgcgaattcgtttcccaggccttggtgcttggcgacaagcgtccattcatttccgcacttgttacgcttgacgaggaatccttgcgtccgtggttggaaagcaaggggctgaatcgcgacatacccatggaggaggccgccaacaatgccgccgtccgtgcggaagtgcagaagtgggtcgatcaggccaacgaaggtgtttcccgtgcggagtccgtacgtaagttcatcattctgccggaggaattcactcaggagaatggtttgatgaccgcttccatgaaggtgattcgtccgaaggtcatcaagcgttatgccactttgctgaatacgcagatgtacaccaagaagaagtagtcttcgaaacagcagaatgaggtctgactcctacgggaatcagacctcatttattattttccacgcaatcgttgcgaagcggatcctaagcagatcagaagcctagcttctcgagctgtttggctgaaccgtcaaaaggacagtccagtggactgtccttaggtgaagtgagcagcttcgctgcgaagcggatcctaagcagatcagaagcctagcttctcgagctgtttggctgaaccgtcaaaaggacagtccagtggactgtccttaggtgaagtgagcagcttcgctgcgaagcggatcctaagcagatcagaagcctagcttctcgagctgtttaggatccgactgccatcccttggcaaccttgacatgcaaatcgagtttggctttctgtccaacaatacggttgaccggcgtacgcaacttcttcttgacacgcacaagatgttccgctcccttgccgatgatgatcggtttctgggaatcgcgttccacataaatcgacacaatcacgtgggctttgccatcgtaagcttcgccactatcgttgtcttccggatattcgatggaatccacgactacggccagtgaatgcggcaactcgtcatccaattcttccaggaaagcgccacggaccagttccgcaatggtttcttccggacgctcttcggtgatctgctcggccgggtacatttgcgggccttccggcatgttctcgataagcacgttcttgacttccgcaagattgtcatgcttcagcgcgctgactggcacaatatcggtgaagtcggcgaattcgttgatttcaatgagcttgttgatcagcccgtcacggcttaattcgtcaatcttggtaacgatggcaaccagcggcaccttccatttgaatgtgccatcatctcgcttgactgcgaaatcagaacgcagacggctcaaaatgcgcttgtcgccgggaccaatctcctgattactaggcagcaggaaagcaacggcgtccacgtcggcgagcgactcgtccacaacatcgttcagacgctgcccaagtagtgtgcgcggtcgatggatgccaggcgtatcaaccaaaacgatctgcgcattatccgtggttaaaatgccacgaatggctttacgagtggtttccgggcgagatgatgcgatggcgatctgcgtaccgatcaacgcgttgatcaacgtcgacttgcccacgttaggacgcccgaccacggcaacgaaaccggaccgatatggaacgggcgtggcggaatcggaatggtcggaagtcgtctcggttgttgctgcgtcagtcatgcttgtctttggaatccttatcgttgtcggatgccttttcggcatcatccgcatgttcttcgttacgtgtttcagtttcgtccacgccctcgacgtgggccggctccaccacaatggtcgacacttttttgcggcgtcctgcggagtcgaccgcggtcatgcgcaagcctcgagtgactgcggaggatccgacgatcggcacacgtcccaacagcttggtcagcaagccgtaaacggtgtcgacatcatcctcgtcaatgtcgatttcgaaaatctcttccaagtcggcgataggcgtgcgtgcgggcatgctccatttcttgtcaccgatccgttccggatcggcatgttgcgtgcgatcatgttcgtcttccagttcgcccacaatctgctcgatggcatcttcgatggtgaccatgcccgcgattccgccatattcatccaccacaatggcgacatgctggcgtgtgcgctgcatttggtggaaaagatcgtcgaccggcttggattccggcacgagcatggggtcacgaactatcgattcgacttcgcgtgtcatcgccgcatggttgaaggtcgtcgcgcgcacggcatctttcaaataagccacgccgaccagatcgtccacatcgtcgccgatgaccggcacacgtgagaatccggaacgggagcaaagcttaagcatattctccaacgtttcgtctcgctcgatgcaaatcatgtcggtgcgcggcaccatgatctcacgagtcagcgtttcggaaagcgtgagcacattgcgcagcatttcggaaacttcaggatcgaaatcgttggcttcgaccagacggtcaatggttgcccgtccttgttcgatctggattttttcgagctcctcgtcgtcggaaagatcactgccgcgacgcttcgcgcctttttgccccccgatttttgcgaatggggttaatagaaccgcaatggaaacagcatccacatgctgcagcataatgtcgactggcttggatgccccggcactacgcggacgcaccaacagcgaaatcaccgcaatgacgatggcaaaaacaaatccggcaagtaattcggcccatagtggagcgtccaacatgcccgcaatcaccgtcacgagcacaccatcaaccacattgcagcagatgcggaagaacgcgcacgatccggcggtggcatagcgatcggccaccaaccgctgaaccttatgaatgcgcctgattttcttgtcgcgtatgaattgcgaaagctcggcatccgtttgaatttcgagaataaggttattcaggctcgccctggtcacacgtcccacagcgccttcagtcgcggccattgaaagcgacagccagaccaacagcagcgccaccacggcgagcaccacgatcatcgcaatcattgttgcctgcataattcagcccccatcatgccggacgatatgctaccggcaacgtcaatcattatttggcgatctgccgtcccgtgccatgctgcctatcccattcggcgagcgcgtccggcgtatccggcggaaggatggcctgcgtccccgctccctggcgaagcgcgaagaaggtgagtagcagctgtcgctgcagaccgaacatctgacgctcctgttctggggtggcatggtcgtatccgagtaggtggaggatgccatgaatcgtcagcagcatcatttcctccatggtgttatgtccggccgcgagcgcctgctgcgcagccacccacgggcaaatcacgatatctccaagcacgccttccatcacagttcggccgtctcctgggcgcagctcgtccatggggaagctcatcacgtcggtggggccttcaagattcatccaacgcatgtgcagttgggcgatgggatcggggtctacgaacatgatggtcaggtcggattgcgtgctgacccgcatttggtccatcacccatatgccaagatcggagaacaccttgccgtcaatttgccagacggtttcgttggttacctcgacgctcattcagcgttcctttcgatttgctcgcttgtttgcctggatgtggttttgcccgtggcgtgtctgctgtggtcgccggcaatggccgcgtgtcggtcgtacgctgcgacgattttgccgacaagcgcgtgtcgcactacgtcttccggtttgaggtgggcgaatgcgatgtcgtcaatgccgtcaaggatgcgttcgatggtggcgagcccggatttcggtactgtcagatcgacctgcgtcacgtcgccggtgataatcattttcgtattgaagcctagtcgggtcaggaacatcttcatttgttgttcggtggtgttctgcgcctcatcgaggatcacgaatgcatcgttgagcgtgcgtccacgcatatatgcgagcggtgcgacttcgatggtgccgtcatccatgtagcgcttgagctggtctgccccgagcatgtcagaaagcgcatcatatagcggacgcagatatggatcgactttttcgttcaatgtgccaggaagaaaaccaaggctttctcccgcctcgacggctggtctggtcaggataatgcggcgcacctgcctatcttggaatgcgcgtaccgctttcgccactgcaaggtatgttttgccggtgcctgccggtccgatggcaaatgtgatggtatgtgattcgatggcattgacatatgtgatctgaccagccgttttggcacgcaccggcttgccgagcgcaaaggtgatcactccgggcacatgcggtttgcgtcggtccgcatgattctcgcgattggaggtatgctcctgttgccgatcggccagccgtagttcctccactacacgtccatggcccgggcgagtagcacgcacaggatttttcaacacgttttgatcgagcatgcgtcgcaccgtatcggcgtccatcggagccgtatatgcggcttggatgatgttttcgatcacatgctcggcctgtgcggcttgggattcggatttgctggaacgtgacatgatcgcgatgcggttgcctctgacgataatggtcaagtcggggaacgcacgttccacttcccgaaggacctcgtcgaccggtccgagcacggtcaccgggtcaagctgctgcggaatcgcgatggtacgtgtagtagtggccacaaaacctcttctgacgtcgatatatggggaaagggaagattattcgtcaagcttttcgccggtcagcacgtgagcatgcacgtggaataccgtctggccagcatcaattccggtgttgaagatcaggcggaaggcaccgtggaattcctggtcggcgatattttgcgcgacctgagccatgtgggcgagctgctggggatcggccgccgcaagctcggccacgttcgcataatgcttgcgaggcaccacgagcacatgtactttggctttcggattgatgtccttgaatgcgtaggtggtatcgtcctcatacactttttcgcttggaatttctcctgcgatgatcttgcagaacaggcaatccttgtcgctcataatgctccttaatgctggttgtccttcggtacccatgctattgcgcaaccgggataatccgccgcatttcgccggcgtgtggcgtcagatgaatcgtcccaacgcccgtgcgagcagcgataacgcgacgggaccagctgtcgacgctcgcagaatattgcttccaagcacgcatgcttcagctcccgcattggtgaaggattcgatttcagcatcgctgatgccgccttccgggccgaccaccacgtacacggtgcgctggcgcccgtcctgcaagcatttgtcggaaagcaccgcgatcgcttcctccagctggctccaagttttggtagcatcctggtgcagcacaatcaccatgtcgccgtgcacacaggcacgcttgcaaatggcaatcaactgcttgctggtcacgcactcccccaattccggcgtccaggagcgtcgggattgttcagtggcggcatcaagcacttgccgccacttcttatcggtgcgccccgccttccatttggcgatggaacgatcagcctgccatggaatcacctcatccacaccgatctgcgttgcggtgtcgatggcctgctcatcgtgtcctgttttcgccagcgcttggatcaaagcgagtttggtggtaggctgcggttctttgccgaagctcgacacttccgcgattccttgttgcgcatcgcgcaacaccgcgtggatacgtagccctttaccgtcggaaagctgcaattcgtcaccgtctttcagacgcatggcctgaatggcatgtcgacgcaccgactggggcaacgtcaatttccatccggcgttcaattcgtcactgttcaccggcacatcatcatgttccgtatcaagcaggaaaagggcatcagtcatagtttcagagcctaccagcacctcggataccaatggcgtaattccgcgcgacacgccgagacttgcatcacaccgagcatctgctatagttttcgtttgttgccgctgagcaacgcacctgtccgggtggcggaatggtagacgcgctagcttgaggtgctagtgcctatttatacaggcgtgcgggttcaagtcccgctccggacaccagcaaaccccttggaaacaaggggttttcttgtatctgaaagctattcggcgaaagatcgatcacatgcagttcatccatcttgattccattgacgacgagcgcgtgtcggcatacacgaatctcacggaaatccagcttcgcaacaagcttgaacccagcaagggcctgttcatcgcggaatcgccgaaagtcatcgatcgcgcgctgaccgccgaccgggaaccgatttccctgcttgtcgaagaaccgtggatcggaggcatgtcggaaaccttcgcacgcatcgaccaacgttggggcaccgacattcccgtgtacgtggcatcccctgaacagctcaagcagctgaccggctaccgcttgcatcgtggcgccctggccgcgatgaaacgctggccactgcccagcgtcgaggaggtgtgtcgcggcgcacgacgcatcgcggtcatggaaaacatcgttgaccacaccaatgtcggagccctcatgcgatcagccgccgcgttgaacgtcgatgcagtgttggtgacgccctcctgcggcgatccgttgtatcgacgcgccgcccgcgtgtcgatgggcacggtgtttcagattccgtggactcgtatcggcggagatgataaacactactggccattcaccggcatgcaggaattgcgcgatcttgggttcaccaccgttgcgatggcccttgaagacgattccatttcgctggaggagcttgttcgtcgtttgaacaacgacaacggcgaaaaggaccatatcgacaaattggcgctgattttcggcaccgaaggcgacggtctgtcgcatcacaccatctcccgcgccgacctgacggtcaagattcccatgagccacggagtggacagtcttaacgtcgccgcatcgagcgccgtggccttctattcaacagctgttcactgaaacagtcagcaaattttcaagactcgcgatgcaaactccttgcatgttgcagaaaatatgcaattattgagtgcgtaagtggtttgcgatgatgcagaccgaccaatgtgtgcggtgtcgtaacgacgctctaggagaggagttctcatggcaaagaatccgaaaattctttccatcgtgcttgcaggaggcgaaggcactcgtctgatgcctttgaccagagaccgggcaaagcccgccgtcccgttcggcggcgtgttccgtctgattgatttcccgctgagcaatttggtcaattcaggctatatgcagaccgtggtgctcacccagtacaagtcccattcgcttgaccgtcatatttccacggtgtggcgtttttcgccgttgctcggcaactacgtctcccctgttccggctcagcagcgacttggcaagcactggtatctcggctctgccgacgccatctaccagaccatcaacatcatcgaggacgtgcagccggatattgtggtgatcgtcggcgccgaccacgtctaccgcatggatttccagcagatggtgcagcagcatatcgaatccggcgcggagttcacggtggcgggtattcgccagccgatcagccagtccaaccagttcggcgtgatcgaggttgatccggagcacccgaatatgatcaagagcttccaggagaagccgcagaccacgaccggcctgccagatgatccgaactccattcttgcttccatgggcaactacgtggccaacaccgacgccctgttcgaagctttggcgcttgacgagaaggccgaagacaccaagcatgatatgggcggcgatatcgcaccgtacttcgcggcccgtaacgaggctggcgtgtacgacttcaactccaacgagattccgggagcgacgccgaccgatcatgcctactggcgcgacgtgggtactctgaagcagttctacgatgcgcatatggatctgatctcgtatgtgccggaattcaacctgtacaacaccgaatggccgatttacacgctgtccggcaatctgccgccagcgaagttcgtccatgccggtcgcgaccgtctcggacacgccaccgactcgatcgtctcccctggcgtcatcgtatcgggcggtgaagtgcatcattccgtgctttcgccgaacgtgcgtatccactcgtggtcccaggtcgtcgattcgattctgttcgacggcgtgaccatcaatcgtcgagcacgcgtctacaaggcgatcctcgacaagaatgttgtgcttaccgagaattcgaccgtcggtatcgataccgaacatgatctggcccgtggcttcaccgtcacgccggaaggcatcaccgtggtgccgaagggtaccgtggtcgacgactgacgttctgccgcacacagaacaaaagcgtgcttcccggcgtcgggagcacgctttttctgtgccattttttcttgatgatgatatccaatcaaatatcatcaaaatctgttttacaaaaaattccgcaacgaacatgcagtttcgctgcggaatcaacatatcagcaatatcaggttgatatatcacagattttctgtcagtattttggcagattgtcgaaattgaagccgagcgcagccaactgctcgcgaccttccggcgtgatcttttccatgctccaacgcggttgccacgtccagtcgatgcggaattcctcgacgaggccggcaagcgtgctcgcgcactcgtcttcgatcagatcagtcaacgggcatgccggagtggtcaatgtcatcgtgataatggcacgaccaagctcatcgatctcaatgccatacaccaatcccaaatcaatcacatcaatgccaagctcaggatcaatgacctgatgcaacgcttccttcacgtcggccgcagtagctcgaccaatgtcgtcaatagccttcaacgcgatgccgtcatcctgttcttcggaacaaccgcatgctccagcctgattgccgcagccacaagcgtcctgcttggtgtcttcgtgttcgatttccactggtttgccgtccttgaatcctttggcgagatttgggttaagcatgacgcgacgcgccgcggcctcgtcattgcccaatgccttggccacggaatcgaaaatcgaggcttgcggttcaggtaccaaggtatcgctcattgtcgctccatatatgattcgaatatgttccgttgagtagcctatcgcgttggctggagtttgtctcacgtgtttcgcccgttgtagaacgcggcgcacgaagcacgggaaacatcctgctttccaccatagaacaatacttgtcaggctttcgcggccaatgccttggccacggagtccttcatgccttcccatccgagcagcgcgcacttgatacgcattggatacttggacactccttggagcacgatgccgtcttccaacgattcctcggcggattcatcgtccaagcctttgccgcgtgattccatgagcttatggaacgttccggccaattccatggcctcatccacggttttgccttccaccagatccaccatcaccgaaaggctggcctgtgaaatggagcagccgtgaccgtcccacaccagtcgttcgataacgtgcggctcctggtcggaaacctccacatgcacggtggcctcgtctccgcaggtcggattgaactggtgggactcgccgggagtgcaatactcgtgggttgcctgaaccgtggtctttcccgcctgggaggcgttttcggaagccagatccggagcgaaatgctccttgccatgcggattcttcgaggcttcgagaatgacctcttggtacatctgctcgagatcgtcgccagacattgcaaaatcactcatatgcgttactcaactccaaaaaacggacggaccttcttcaacgcctcaaccaatgcctgcgcgtcttcgacggaattgtagatgccactggatgcgcggttggatgcgtacacgccgaagtgacggtggaccggctgcgcgcaatgatgtccgacacgaatggcgatgccctgcgcatcgatgaactggccaacatcatgcggatgcacgccgtcgatttcaaaagccaccgtgccgatgcgctgctcgttggtctgcggtccgagaatgcgcacgccgtcgatctgccccatcttgaggagttcgcctgcgataacgcgctcgtgggcttcgagattctccatgccgatattcatcagccattcggccgcgacaccggccgcaacgacctgcgcgaccggctgcgtgcccgcctcgaaacgcgcaggaggagccatgtattgggcttcctgatccatccaggcaagttccaccatggatccaccgaaattcgccggtggcaacgcctccaacatgtcgcgcttgccgtagaggaagccgacaccggtcgggccgtacatcttatgcgcgctccatgccgcgaagtcaacgtccaaagcgtggaggtcgatcttcaggtgcggtacggactggcatgcgtcgagcacaaccaccgcgcctacctcgtgcgcacgtttcaccatcggcgcgatgtcggtgatggcaccggtggtgttgcccacatgggtgacggccacgatctttgtgcgttcggtgatcacctcgtccgcagtgttggaaaggatgcgacctacactgtccagatcgaaccatttcaatgtcgctccggtacgcacggcaagctcctggaacggcaatagcacggagtggtgttcggccttggatacgacgatttcgtctcccggcttcacagcgaaacgtcgtgccgcttctcccccacgtcccagcgatgcgttgccgaatgcggtggctagcagattcagtcctgcggtggcgccggaggtgacaacgatctcctcttcgccttcagcggagttggcgccgacaagacgtgcgactttggcacgtgcctcttcgaacgccatggtgctgcgtgcggcaagctcatgcgctccacgatgcacgccggcgttgatggtgcggtaaaaatcgctttcggcgtcgatcacgcattgcggcttctgagaagtcgccgcggaatccaaatacacgagcggatggccgtggatctcctgatcaaggatcggaaattccttgcgaatcgctgcaaaatcggtcatgccagagcgctttcggaatcggatccttccggcaggtatgcgtcatagccggattcctcgagctcatcggccagttcagggccgccggtcttgacgaagtgaccggctgcgaacacatgcacgatgtccggcttgatgtacttgaggattcgcgtgtagtgcgtgaccatgagaataccgaactggttggcttccttggcgcggttcacaccttcggagacaatgcgcaacgcgtcaacgtcaaggccggagtcggtttcgtcgaggatggcgaacttcggcttgagcagttcgagctgcagcacttcggcacgcttcttctcgccgccggagaaaccctcgttcacggaacgtgtggcgaacttcggatccatcttcaggcgcttcatcgcctcggacagttccttggtccacgtgcggatggccggagccttgccgtcgacttcggtttttgcggtgcgcaggaagttggtcatcgacacgcccggcacttcgaccggatactgcatggctaggaagatgcctgccttggctcgctcgtccggggtcatcttgaggatgtcttcgccgtcgagcagcacctgtccggaatcgaccacgtacttggggtggcccgccagcgtgtaggccagcgtggatttgccggatccgttcggccccatgatggcatgggtttcaccggagttgacggtcaggttcacgcctttgaggatcggcttgatgccgtccttggtttcgacgtgcgcgtacagatctttgatttcaagagttgacatggttttcgctcctacgttctacttctcttccaacacctgggcgatcgcgtcgttctcgccgcgtgccaggcgcttgtcgataacgttcatgagatgttcgctgattgcgggaatgccgatttcctcgacgagttcgccaaaaaagcctcgcaccacaagtttgcgggcttcggtttccggaatgccgcgagactgcagatagaacagctcctcatcgtcaaagcgcccgacggaagaggcatgtccggctccgatgatgttgccgttttcgatttccagattcggttcggaatcggcgatcgcgcccggagtaagtaccaaattgcggttgagctcatacgagtcggtacccggcgcggtcggagcaatcagcgcgttgccgacccatgtggagtgcgcgcccttgccgtcaagagcgcctttatataccacacgactcttgcactcgggatggttgtgcacaatcatggtgcgatgttcgatatgctcgcccggatccacaaagtagatgccaagcatgttgagatcgccttgatcgccgccaaaatcctgatccatacgaatccgaacgacatcgccgccaagcgtgaccacggaatggcgcagggacacaccctcccccaagtggatacgctggttgcccacatgcttggagcccttgttccactcttgaatgaacgtggtggacacatgggagtccctacctgtgagaatctccacaccttcggcgatacgtgcatcgccgtcatgctctaccacaacgtcagcgtgggcgcgatcggcggcaatgatcaccaggtggaatgcgtccagatccgttccggcaccatgaatcttaacgagtatcggctggctgatttcaccgtcgatacgcagaattccggcacgggaggcggagttccattccactgcggacacacgatcgcagggcttggaaacgatgcccgtatcggcgtctcccggcttgccctcgctataggtcacgccttcagtaagagccgtgccgtcgatcatagtgacggcaatctgggtttcgttcgacggcgtgaacgcgttgaagaactcttcgacacgttccacaggggtataacgccaatcatcctgcttgcggtcgggcacttcaaatgcgtccacatcaaatgaccgcggcgagcgatccgccgaagagggcatggctgccggattcgcatacggatcgttcggatccgcaacgggaatattgatttcctgagtttgtgccatggtaatcagcccaccgatccttccatctgcaattccaccagtcggttcagttcaagcgcatattccatcggcagctcacggctgataggctccacgaagcctcgcacgatcatgcccatggcctcctcttcggaaagaccgcggctcatcaggtagaacagctggtcttcggaaaccttggaaaccgtagcctcatgtgccatggaaacgtcatcttcgcgcacgtccacatgcgggtaggtgtcggagcggctgaactcatctacaagcagtgcatcgcataccgtcgagttggacgatccttcggcacccttgacgattttgacgagaccacggtatgcggaacgtccaccgccgcgggaaatcgacttcgccacaatggtggagctggtatgcggggcaagatggatcatcttcgcaccggtatcctgatactggcccttgcctgcgaagccgagcgacatggtgctggccttcgcatacggctcggcgagaatgcaggccggatacttcatggttgccttggaaccaatgttgccatcgacccattccatggtgccgccttcacgcacgtaggcacgctgcgtcaccagattgtaaacgttgttcgaccagttctgcacagtggtgtagcgcacgcgggcatgcggctcgacgaaaatctccaccacaccggaatgcaacgaatcggtcgagtagatcggtgcggtgcagccttccacataatgcacgtacgatccctcgtcggcaatgatcaacgtgcgctcgaactgacccatattcggcgtattgatacggaagtatgcctgcaacggaatatcgacatgcacacccttcggcacgtagacgaacgatccgcccgaccatgcggcggtgttcaatgccgagaatttgttgtcgttgctcggaatgcacttgccgaaatacttcttgacgatttccggatacttctgcaccgcggtgtcggtgtcgacgaaaatcacgccttggtcttcaagatccttctggattgagttgtagatgacctcggattcgtactgtgccgcgatgccggagacaagacggcttttttccgcttcgggaataccgagcttgtcatacgtcgcacggatctcgtcaggcaattcctcccaagtcgtggcctgcttgtcgatcggcttgacgtaatacttgaaatcgtcggcgtcgaaatccttcagatcaacaccccattgaggcatcggacggttgatgaaatcgcgatagccttccaatcgcttttccagcatccattccggctcgttcttatctgcggaaatagcgcgcacgacattctcgtcaatgcctttttttgccgcttctccagcgaaatccgtgtcatgccatccgtacgtatagtcgccgaactgctggatgatctcgtcatcctgcttgatcttgtcttcattcactcgcgtgcgatcagccacatactggctcatctccacgtcagccgcggcgttgggcgcttggttctctgccaccgtacgctgcctccaatcactcgtttgtacctatgacaacctaacagaacgtggggctaaacactagcgcccctttcgctattcggcaatgatttgtcgtgatttatcttacatagcgtaaaggcggaaaccgaacattcagtcttccgcctttgcgtctttctgccgttagcccgcatatcaggcctgaacgtgaaccgtcgttcccatcaggcaccaattgtagaaccattcagcctgatcccagccgacgccgacgcaaccatgggacgtgttcttccccatagcctgaatactgctgtcgttaaacgcactttgagtggcgatgcgatgaatcgcgcaacctgttttcgagaaatagttgacgaatccaacatccttgacatcccacttctcggtgtttccatccgatagggtaagggtgccgctcatatcttgggactggtacttgagccacactttgaagtcaccgtcaggcgtgcagttgtcgtaggagttcggatcgcagtaggttggcgtgcacaagtcgccgctcggctggcactggcccgtctgataatcattgccctgaccggcagacatatgcatgacacggacggtctgcccattttcaatggctgtaacggtatgcgaagacaagctgactaccacggtacgcatggtttttttctcattctgtgggtcgcaagtgccttgaatacttactgaatcagaacctttggcaaacgcctcagcggcatcacggccaacattggtgtcgctaccatcagtaacggttataccatcatgcccagctacattggtttgcagcacatcaccgacactattaacgatgacatcaccgtcaactcgatcagcatggaagttcgatttgatggaatcgttatagtattgctgcaatttgtcaccatcgataatcaaagagccatttcgggtttgattatcgccgagcttctcactatccggtccaagcgtgatggccgatgcaatggactgcgcaccgaattccgccactttatggtcgccgatcttgatagccaccggcttcgctatccacgcgtcagcagaagccttggcctcgttggcttggtcatccgtgatgacgggatcagtaaccttatttttaagagtcaccatttgagcggtctgcttgccaaaggactcaagcacgttcttggcttctttgacgatatccgtcacatcgataccagtcccctgctgacctggcgtcacatcgaaagcggtaccatccgcgttgagctgtagcgacgggttggtggcggacacggactgcactcccaacatgtcacctaccgtctgggcgctgactcgagaatcatcgaaagactcgacgtcgacatcctcacgggtccagaatgcatacttctgaaagaaggaatcgtcacgtttcgcgttcatcacattttcggcgatggattccgcgtcaatggcgacgccaagatccttcaacgtgactttcttgctcgttccctcataggaaacgggaaccgtcaatgattccgccgtatcggaaatctcatggatgatatgatctcgggattgtcctgtcatggacttgccccagagcgtgacacctggcaacgcatgtgactggaagaaccagtatccgccgccggccacggcaccgagaagaagcatcaccgcaagaacaatccacagccacaacaggtggcgcttcttgctggcattcacagtcaacgctgcaccatcatcaatgggatcggccgtttcggcaaacgaatccaagctcacctgcgagatgacttttggttcatcgcccatgttcgggaaggcgaacttaccgttgccgctttccggagaatccatatcgttcaagctcatgctccctcgtaaaggtttttcattacgaatacgtcttgttgataattcaaggccaagcccttattatgcaacatggccatgaactcctttggactcatgaccatgttgcatatcgggttatccgacgttaatcacaattcgtcgatttagcgctcctgctggtggtccagagcggccttgaccagacctgcgaacagcgggtgcggcttggtcgggcgggacttgaactcaggatgagcctgagtggacacatagaacgggtgcacctcgcgaggaagctcgacgaactcggtgagttcgccgtccggactctggccggaaatgcgcagacccgcttcacgcagacggtccttatatgccacgttcacttcgtaacggtgacgatgacgttcagtgacatgcgtggtgccgtacagttccgcgacgatggaaccttcttcaagctcagccggataggagccaagacgcatggtgtgtcccatgtcaccattgccggcgacgatgtctttctgctcctccatggttgcgatgactggggtcgcgcaatcgggctcgaactcggtggagttcgcgtcctccaagccgaggacgtggcgggcgtattcgatgaccatggactgcaggccgaggcacaggccgagggccggcagcttgttctcacgggcgaacttcagggcaccgatcttgccgtcgatgccacggatgccgaagcctccgggaacgacgatgccgtcgacctggtcgagcgcggcggccgcgccctcctcggtctcgcacttatcggcggcgacccacttgacgttcaccttggcatagttggcgaaaccaccggccttaatggcttcggtgacggacaggtaggcatccggcaaatcgatgtacttgccgacgatggcgatgttcacctcatgcttcgggtggtgcacacgctccagcaggtcctcccactcgtcccaatcgacatcgtggaacggcaggccgagctcgcgcacgacataggcgtcgaggccttcgtcgaacagggtcttcggcacgtcatagatgctcggggcgtccacgcagttgaccacgccttcggaatccacgtcgcacatcagggagatcttgtccttgatggactggttcagcgggcggtcggaacgaagcaccagcgcgtccggggagatgcccagctgacgcagcatcatgacggagtgctgggtcggcttggtcttgagctcatgggcggcggcaatgtacggtaccaaggagacgtgcacgaacatgcagttctcggcgcccagatcgcggcggacctcacgcgcggcctccaggaacggctgggattcgatatcgccgacggtaccaccgatttcggtgatgatcacgtcgacgtcatcggacgcctgcgcacgcatgcgggacttgatttcgttggtgatgtgcgggatgacctgcacgcattgtccaaggtattcgccggcgcgttccttgcgcagcacttcctggtagatctggccggtggtgacgttcgccttctggctcaggtacacgtcaaggaaacgctcatagtggccgatgtcgagatcggtttcggcaccgtcttcggtgacatagacttcaccatgctggaatggattcatcgtgcccggatccacgttgatgtacggatcgagcttctgctgcaaaaccttgatgccgcggctacgaagcaggcggccgagggaggaggcggtcaggcctttgccgagagaggaaacgacgccaccggtgacgaaaatatgcttggtaacgtgctcttgagaattgccatgttgtcttctaaccatggaacttcagtctatcagcggcatgagacgcggcgtgtttccttcaatacaaaaaggcggggccatcattgccttgatggccccgcctagcaggaataggagatacattcagtcaatcattggcttatgagatcagtcctcctttctgcgggaggccgcgaacgcgaacacggatgcgatggcaagagccaccgcggccagtgcgaaaccggtgatggcggaaccagtattcgggctttgcacagcatcgctcttcttgtcggaagctggctggaccgcgggtttgcgcacggttaccgtgcgcgtgaaggtggcggtcttgcccctgctgttggttcaccgagtacacgagcgtgtattcgccttccttagaggtatcgaccgaaccttcgaccgtgatcttgtcggtcagatcgccgtcaacctcatcccatgcgctgacgccggacatcggatcgaactttgatcccagagtcacgctgtcggaagccaccagacccttgatgacaggcgcgctgtcggtatcgggcttggtgctgctgtcgagtttcagcacagtggcagacagtgcgcccgcttcgtacgaggccccttcggcgagatcgacattggcgatagcatcatcggagtagaccttgccgtcggctgcaagcacttggtaggagccgtttgccaagccttcgatcgcggtcttgtctacgttggcgttgaagatcaccacgtaggtgccgtcggactgctcggcctggtaggccacgacgccgtcagcggacttgagcatcgtcacgttggcgttgatgtcgttgtagtcggtcagacgcagcgcgttgatctgcttgcgcagcttgatcaggcccttgacgtagtcgacggaatcggcgtactgggtggtgcggtcccaatcgatggcgttcaccgcgtcgcccgtgttgtagctgttgccgtctccgcccttggtgcgcaggaactcttggccgagctggatcgcggggatgccttccgacagatacacgacggagtcggcaagcttggcacgtgccacggtcgtggcgtcgtcatccgtcgggacggacttcctgagcttgtcgtacagggtcatgttgtcgtggatttcggcatagttgaccacctgtccggcatcggcgtagtgatcctgcgcgttgccgttccagcaggtcgtggtcgcgttctcgtcgtactggcagccgagcacgttgtgggcgatcaggctctcctggtcggccttgccggaaacgaaaccggtgtcggtgtcggagaacacggatcccttcaagccgtcacgcacggaatcgttgaagaacgcgatgccgttgttcgtgccgtcggacgcgacttggtacgcgttcggctggatggtcatctcgccctcgtccatggtggtgttcatatcccagccttcgccgaggatgatgatggacgggtcgatctcgtcgagcgctgcacgcacttccttcatcgtttcggtgtcgatcagacccatgagatcgaatcggaagccgtcgacgttgtagttcttcgcccaatacgtcaccgaatcgacgatgtacttgcgcatcatcttgcgctcggaggccgtatcgttgccgcagccggagttgttgaccagggaaccgttgtcatcataacggaagtagtagccgggaacggtcttgttgaacgagtggttggcggcattgtagacgtggttgtacaccacatccatgatcacgcgaatgtcattctcgtgcagtcccttgaccatctgcttcatttcggtgacacgagaggcggggtcggatggatcggaggaatacgagccttccggcacgttgtagttctccggatcgtagccccagttctgcgcaccttgcgcgttgtagctcagatcgccggtctcatcaacggaaccgtagtcgtacatcggcatgatctgcacgtggctgacgcccaactgcttgagatagtcaagaccggaggtggcgccgttcgccgtcttcgttccggattccacaacacccagatacttgccccgcttgtcggctgagattccggaattcgggttgatggagaagtcgcgaatgttcatttcggcgatggtggcgtcagtggtcttgccgaattccggcatgcggtcgcctgcggagcccatgtcttcgctggagagcaccacggaacgttcgccgttggcgaccgcagcggtcgcgtacgggtcggcggagacgttcaccgtgccgtccgcgaaggtgagcttgtaggagtaggccgtgccgctagcaaggttcttcaccagggcgctccacacacccttgtcttcagaggccatgtcgatggtcttgtcgacttcggcattcacatcgtcggactggtaggtgacaagctcaaccttggtggcggttggagcccacaccttgaatccggtcttcgcgctcgtgtaagtggcgcccagatcgtcgccgtcataggcgtacttcttgtcgaaggcatccgtacgcaccaccgagcccgcaatggcgtcctgcgaaccgaagcccttgacttcgacggtgtacttgcctcgcacgtcaagatccttggccgtggtgatgagcaccttggtgccgtcggtcttgatgttcttgacatctacagccttgccgtcggcgtcagtgacggagaccttgccttcaagctcatccgcagtgacctttttggacagtcttgcggtcagcttgttgacgtcggagatttcaacggacttcatggacgctcccaacgatggacgtgaggaatacacggtggcgtcgccgcccatcagccacacttcggccgatgcggtgccgtccgattcgttgaacaccaaggcgtttgacgggatcttgtaatcggcgtcatccggatccttggccttccacgcatcctttccgtaacggcgcagcatgccgatgtcggaggctccgtcgacgttgtagtaggtgtagttggcgaaggagtattccgcgacctcgccccagtcatcgtgggtggtgaaggtggcggctccgccgttccaattggaagcccaggtccagatgtcccactggggaacggtgaccgaggtgtcttcggcgttgtagtacaggccgtcatcacggttgtagtggaccttcacggtaacggtgttggccttgcattcgtagtcgctcggagcggagtcgagggtttcgacggtggtcgattcgccttgatcctcatatttggtgccgtcgatccacacttcggctgtgccgtcggcgttcaccgtggcgctacggtcgccaccgtacttgttccagtctgcggtggtgacgatgaagccgaacttgtcgaacttgccgccgaaggtcagcgtagccaccttgccccagcagtcagctccggtgaagggatggttgactgccgagaggctcgagccgccagcgtctgtgccccacacgtacacgccgcgattatcggaatcgctggctggcttgtagtgcacgacgagtcgggtctggccgttgacggattccggattacccacggtcgcggcctgatcggccacacccacgtgcgtgatgcccgcgttggcgtggtagttgccgccgcccttcgggttctcccactggtcggtgccggtatcgtgaaacacgaagtcgatcttcttgcccctggtgtcgatggtggcgcgatagtacccctgctcgtcgagggtcatgtcggcttccggctggttccagtcatcgccaagaccgtagtggaccttcgggctcttccagctggaatcggcgggcttgtagtagatggtgacgcttctgtcgtcgggcagggtctcgtccccttcctggttcacgtcaggatcggacgggtcgttggccacgctggatgccgggtggctgtccttggtggcgcctgcatacagtgcgatggcggaatgcgccggtaccgtggtctcgaccttgccgttcttgacgcttacagtctgggagcagtccatggtggcgtacacgttgcagtattcgccgtcggcgagcgatgtcgtgtaggaggcgtccttgtcggtcttgccgttgttgatggcgatgaagcccttatccccgcgggagaaggcgatgttgtcgccgccgtcatcctgccagtcggcgaccttggtgccgttgacgtagttgcggaaggcgatcatgcctcgggtggaggtccagcgctgctcgcagttccagtcggagctgttggtggaacagacctcgtccatgttcacgtccggaacggatgtggcggtggctcccggtgcgccgttgtcgttctcatcccacttgtagtcggaaagcagacgcggcgtgccgtagtcgtaggcaagcatgaatgcgttggccagctgatacttggcaccgtccttgtaggtcagggcgccctcgttgcgcgcggtgtcccagttggtgacgaacacgttggcgtcttcggaggcgagatccttgctcaaccgctcattaagtcccttgaggtttgcgatcttgtctttgaaggtctggttcatttcggacttgaagccgaattcggtcaccgtgccgttttgcacgtagttgctcggctggatgcccgcggcttcggaggagttcccgatgacctcctggatccagtagatgctgtcggcgttcacgccgatcttctttgcgaacttctccttgatggccttcatgctgtccgtgtggatgtgcttgacggcatccatacggaagccgcgaacaccagcattccacagggcggcaagatagtcagattgaatatcctggaccttttcgctctcggagtcgaagtcccacatggagctcaggcggcattcctggacttcctgctggttggcgtagttggagatgttcttggagcagctgtggaagtcggaggccgtgatgccttccggatactgttcggtggcaaatcccgggtagtcgccggtcgaaccgttgtattcggttcctgcaacgccggtctgcttgccgtcggccacgtcggcaccggtggtctggttcagcacaacgtcggcgatgatgtcaacgccgacggcattgcactgcttgatcatgtttttgaattcggcttccgtgccgagcttggaatcgagcttgtagcttaccggctggtaggacgtccaccattgcgtgccttggatggattcctgcggcggcgacacctcgacgtatgccacgtcttccggaccgtatgtgctcgtgcattccttggcgaccgtgttccatgtctgctggaaggcgatgacctgcacgtctttcttcgcattcgtttgcgcctcgggctgagcctgagccatatgcggtaccgccaccaaggtggcgcacgccatggcggcggcgacgcctatggccaccgcacggctagccggccgattcattcgctgaacgaccattgttctccgttctcatcgttgagatcgaattccggcccccatggcaggttccgcccttcgacaacgtatgcgccatggtcatccgcgttacctgcggatcatctaagacacactctgcgatgaatgtgcatacgtttgcaccctagatcggggttcatcgtacagtagatgctgcgcatcgcaatgaaacagcgtgaccgattgcaatatacggaaaagaaggacaagcgaaagaaaatgctttcagcaacaattcattgtgttgcgcaaaacggcaatcatatttgcgattgttgcagctttttctgcaaacgaatgcaatgctatgtgaaaaccggatgcccatcaagagcatccggcattcatagttcctccgagactatctcaaggggaaatcggaaaatcatcacttcgattccaacagatgcgccaccgcatccaacgccagcttgtagccatagaaccccataccggtgatagtgcccgtcgctactggcgagatcacggaacgcttgcgaaattcgtcgcgtgcggacggattggagatgtgaacctccatcagcggcaatccctcatcgatcaccatatgcgcggcatcggccagaccgtaggagtaatgggtgaaagccgccggattcatcacgaccggggtcttctcgtcggcggcctggtgcatccagccgatcatctcggcttcgtcatcgctttgacgcacttccacgtcaagaccaagctcgctgccccactgcgcgcacagggtacgcagggtttcaagatcctgcttgccatacacgtcaggctgacgcacgccaagacggccaagattcggcccattgacgaccactactttagtcatattccacttccctaccttgtttactgctgaatacgacggaacgcctcttcaacggcgtccgcaggcggatcctcaagatgaatcggatggccgacgccctcaagcaccacgaaacgaagcttattgccgcgagccttcttatcccggtgcatcaatgcgagcacatcatcccatgtgccattgttccaggacgtaggcagccccagagatcccaacaacgaacgatgatagtccacgagatcctgatcgatgtaccccagaagatgcgacagttcggccgcatacacgcaaccgaccgccaccgcattaccatgacgccagcggaaatgctcaagcttctcgatggcatgaccgagcgtatgcccatagttgaggaattcgcgcaatcccgcctctttaaggtcggcggacacatggtaggccttcacgctcacggtatgttcgatcagctccgcgaccacatccttcaggccggaatccaagaacgtcgacccgtcgaaggcacgcaattcaccggcatggtcctcgaggatctgcagaatctccgggtccatgatgaaaccggacttggcgacctcgcccaatccttcgatgaagatgtcgttcggcagtgacgcaagcgatttcagatcggcaagcactccggcaggcgtatagaaagagccgaccaggttcttcccctgaggggtattgatgccggttttaccgccggtcgaagcgtcaaccatggccagcaacgacgtcgggcagttcacgtagcgaatgccacgcatccatgtggcagccacaaaccccgccaaatcggttgccgcgccaccaccaaggccgacgatcgcgtcagaacgagtgaaaccctcatcccccaaacgctgccagataccattggccacttcaatggtcttgccggcctccgcgtcgggaatcacaatatcgtacgcatcatagcccgcctgacgcaacaaagtacgcgcacggtccgaatgacgctgcaccggctgggtgtggataagcgccactttggcaggcttgcttcccaacacctgcgcaagctggcccatcacaccctctccgatacgaacatcgtatggttcgatggtggaaccggtgacatggactatacgttgatcaatcatttccatcagctttctcgccgcggcttggggagactggccacgcgtgcccacatgcacgttcgccacgctcctgaacaccgggtcacgttccttgtagagcttcttccaacgctcattggcatcgccattaagcatcggacggcctccaccgcgatttgcccgctccatggcttcctcaggatcggccataagatacacgaccttgccgccgtccgcgatatactgcgccaatccttcctgaatggaaggcgtcatcggcgctcccccgcccaaggaaaagataccgtcgaaatcctcgagcatatcaagcacgacgtcgctttccagcctccggaattccggttccccatacttttcgaagtactcgggaatccgcattccggcatcatgctcaatctcattgtccgcatcggcgaacggcagattcatcatctgcgccacttccttgccgacacgagtcttgcccgcccccatcatgccgatgatcacggcgacaggcctacgcataccactcatagacgaatcacctcatatgctcaggccatgaggcaacgtactgctcggcgttacgcttggtttcggcaacgcaatcgccgccaaacttctcaagcacatactgcgcgatggtcaaacgcaccatcgcctcggcaacaacagccgccgccggaaccgcagtattgtcggaacgctggttaatggcctgcgccggctcgcccgtggtcacatcgacggtacgcaacgccttcggaatggaaggaatcggcttcatcgccgcacgtacgacgatcggctgcccattcgacatgccaccctcgataccgcccgcacggttgcttagacgcgcaatacggccgtcatcgcccaccaccatttcgtcatgagcctgagaacccggacgcatggcctcaaggaaaccatcaccgatctccacgcccttgatggcctgaatacccatcaccgcactggcaagagcagcatcaagacgacgatccgattcaacatacgtgcccacgcctgcgggaacgccgtacaccacaacctcgatcacaccgcccaacgtatcggcgttctccttcgcctcgtcaatacgggcaatcatccgctcttccgcattcttgtcaagagtgcgcaccggagaagcgtccaacgcctcaagatcctccggtttgggaagcgtggcctgctgcggatcggtaatacctgcgccaccaatggaaagcacatgcgaaacggtacgaataccgaacgcctgctccaagaactgcttggcaacctcacccaacgccacacgcgaagccgtctcacgcgcggaagaacgctccaacaccggacgagcatcatcaaaaccatacttacgcatgccagtcaaatccgcatgccccggacgcgggcgagacaacggggcattgcggccctcacgagcaagctcatgatcaagcggatccgcactcatcacctcagtccacttcggccactcggtgttggcgatctcaatggccaccggagaaccaatcgtctcaccaaaacgcacaccagtcagcatacgaaccttgtcctgctcgaacttcatacgcgcgccacgaccatacccaagacgacgacgcgccaacgcgccaacaatatcctccgtggtgatatgaacgcccgcgggcaatccctcaatcatggcgacaagcgcctcaccatgcgactcgcctgctgtctgccaacgcaacatgccaactccttttctcacgaatgcaactagtggactatcttaacggtatgtggtatatgatttgcctgccaagtctgctttgtggactggccatcagcgttgaagacatccgttcacgtcgcattccacgcgcctggatcgccaccggatgcacagcgcaaatcatcgtaaacctcatatacgcactttccatcaacactctgtacctggcattgcaggcaatactcttcgccgtactgtcggccgtactgcaatgcgcgctcgctttggtgaaacctggttcattgggttttggcgatgtcaccgccaccttgctgatgggattggcagtcggcatgttcggtctgttcgccgtggtgttttggtggcttgcgattggtgtggtcggcttgttatggctcgttttgtggacacgtttcgatccgcagaagcataccgcatatgccggtaaaacgccgttcgccccagcgcttgtggcagctggggcgataggcattgcgattggcgttttattctgagatcagttcgcgttctcgttgttgttcttgtactcgtcgcgaatctgccagaactcatcttcggtttccacgaatttcgtttcgccggtctgcaggtttgtggtgacaaagtacagccacttgccgtccggaggattgacggctgctgtgatcgcgccatctccagggttgctgattggcgtgggcggcagtcccttgtggattctggtgttgtacgcgttgctgtcatcgcccaactggtcatcggtcaactggcttgcggaaataccaagaccgtaggcgaccgtggtatccatgccgagagccatatcggcgtcaagacggttgagaatcactcttgccacctggccgtagtatttttcgctgccgacttccgcctccgcgatggatgcgatattcaggatgcgctcacgttcgctgcctgtaggtacgcccaaggaatcgagtttgctcactcgcgcgtcgaccatttccttgatgatgtcttccgctgacttgttttgcacattgtagctgcctggttcaagccatccctcgaatttgccgccggcctcgtcaggaaggattccagcaccgccaccgtccatcacggcttggaactgtgaaacatccaagccggacacactcgccgcattttcgatgacgtccgacacacgttcacccgcacgcacttcggcaaaaccgccggcctggctttggtcagaaagcaccttgaccacatcggacgccctcatatgcgtcctcaatgcgtatgatcccggatacaacgtggcgccagctccgcttactgcggaagtgaaggcggctgcggatttgacgattttagctttaacaaggttgtccgcgatttccgcggctccctgcccggattccacgacaaacgtcacgcctttatcgcctgggcccgtgtaatcctcgatttggctttgagaattcgcttcgttcacggccttccaatgtttcagcgcgcgcacgccgaagaatccgccgacaccgatcagcacgatcaccaccagagcggcgataatggtgatatagcggcgacgacgcttctgctcacggtgacgacgcatgtccttacgtgatttcggtggttgcggcggcattgccgaaacgaaggatgcatcatccgacgaattcacccattgcgcgttatcggagaaaaaatcgtcgagattatcagtcacaggcctctctcctctggtctctctcttcggtcgatggccgtctgcaatatcaccactgcagactgctggtcgaccatcggacggtgctttcgtccaccgacctgcgcatcgaatagctgatgatgtgcagtcaccgtagttagacgctcatccaccaattcgatggacggcacttcctttagcgcatagttctcatcatctactgcgacacgcagtctcttctcaagattaacagtccatcgccgtgcttttttcgcgcttttgccttcttctccgcttagtagcaacggcaatccgactaccacatggtcgaccgattcgtcttcgatgacgtccacgacctcgtccaatgcacggaacgaatccccgtagacctgaatattgcctgcggggtgtgcaagagtgatgccaggatcagacagtgcgagtccaaccctggcatcacctaaatcaatgccaagccaaaccatgcttggtggttcagcccttcatggcctgattggccaaagcctcaagcgcctcattgatcttggtggcatccgcgccgccaccctgggcgaagtccggcttgccgccgccaccaccgccaaggatcttggaagcgccacgaaccaaatcgccggccttgataccctgcttgcgtgcagcctcgttagtggccacggcaaccataggcttgccttcctcgttcacaccggcgagagccaccacaaccgggaattcctcaccaagctgtccgcgcacatccagcacggtcttgcgcagcgcgtcgaaagagccgaagtgctcgacgttcttcgctgccaccttgaccggagcctgggatgccttggtttcggaaaccaaagcaggcacggaagccgcaagctgggattcgtacatggtcgcaagacgacggtcggattccttgagcctggcaagcagtgcgttcacacggtcagcaagctcgtccggacgggcattgaccatgtcggaaagctgtgagaccagcgcatgctcgcgagcgttgaactcataagcgctttcgcccacaaccgcatcgacacgacgcacgccggagccgatggaggcttcggacatgatgttgatggcaccgatcttgcccacatggtcgatatgggtaccaccacaaagctcacggctccatccatcttcgccgatggagaccacgcgcacgacgtcgccatacttctcgccgaacaggtgcatggcacccaaggcgatggcgtcgtcgaacttcatctcctgcgtggtgacggcaagattttcgcgcagcttctcgttgacacgcgcctcgacggagttcatcgcatccttgctcggggcgctggaccactggaagtcgaaacgcaagcggttcggcgcgtcttcagagccgcgctgggtggcctgcgggccaagctcctcacgcagcgccttgtgcaccatgtgggtcgcggtatgcgcgcgggcgatggcaccgcgtcggtcaaggtcgatgttggcgttgacttcggcgccgacaaccaacgtgccttcggtcaggcggcactggtgcacgatgaggtccttgatcggcttctgcacatcgtcgacttcgagcacagcaccatcgtcggaaaggatctcgccctgatcggcgagctggccaccggcctgcgcatagaacggagtgcggtcgagaatgacttcgatggtggccggaccggtgactgcggggacggagcccttgccttcctgcatgatgcccagcaccttggcgcgggcggacatgtcggtgtaaccaaggaagtcgatgggctggaccagcgtcttcttgaaatcgtcatagaccgacagatccacattgtgacgcttcttcagggcatctgcacgggcacggctcttctgctcggccatgagctcgcggaacttcgcctcatcgaccttgacgccctgatcggcggccatttcgagggtgatctcaatcgggaagccgtaggtgtcgtgcagcttgaacgcatcttcgccggaaacggcgtcggatccggattccttggccttggccacagcgaggtcgaaaatctcggtgccggattccagcgtgcgacggaacgcgtcctcttcaccatatgcggcttcggacacatcgtggaaggtgtcgttgagttccggatagctcggctccatagctgccttggaggtcggcagcagggtcggcatgaccggatcggtcacgccgagctcgcgcatggccttgactgtgcggcgaagcagtcggcgcagcacgtagccgcgaccgttgttggacggacgtacgccatcggacatgatcatcaatgcggaacgcacatggtcagccacgatgcggaaacgcacatccatggcttcgtcatcaccatacgtgcggccggacagcttctgggcggcttcgatgaccgggaagacctcgtcggtctcatagatgttctgcttaccctgcatcagataggcaagacgctccaagccggcaccggtatcgatgttcttgttctcgagctcgccaacgatgtgcaggtcggtcttggacttgacgttgtcgacctcgtagttttcgaacacgagatcccagatttcgatgtaacggttctcgtcggcgatcgggccgccttccacaccgtattcaggtccgcgatccacgtagatctcggagcacggaccgccagggccagggccgccggtggtccagaagttgtcctccatgcccatgatctggatgtgttcggggtcaacgccctcgttcttccacattgaacgggcttcctcgtcgtcggtgaaggtggtcatccacagcttctccggatcgaagccgtagccgcccttgtcttgcggggtggtcagcagctcatacgcatagtggatggcttcttccttgaagtaatcaccaaaggagaaattgcccagcatctggaagaacgtgccgtgacgggtggttttgccgacctcgtcgatatccaaagtacgcacgcacttctgattggatgccatgcggctcttcggcggagtctgctcgcccatgaggtacgggatgaacgggaccatgcctgcgatggtgaacagggtggtcgggtttggagagatcagcgatgccgaaggcacgataagatggccgtgcttttcgaaataatcaagatagcgcttcgcgatttcagaagtgcgcatatgagattaagctccttttttgctgaaaggcctagtgcctttcaaacgaattcgtgattgttgtccgaacgtacgttacgggaataagatcagctgatcttatccgcgtatttggtattaagttcagcctcgcgggctcgacgcgtttcgttgaactcattgaacaaaccttcaagggtgcgcacggcgacatgatcttgatccggcccgaacagaaattgtcgagccgcatcaggggtgttggccttgacgtacgcctgtgctttggtcactgccaccgcaccgatgcccacaccaatggagatccagaagagacgcttgaacatcactcccccttgttattgctgttgacgttcttcttgttcatgaaggactgcgcggtggttttcagggcatatgcagcggaagcaaccttgataaccggcttgcccaagaaggatccatacagatcggtcagggcgctgacattattggcggttgtggaagccgctgcggaaatcttgttgacgtcttccagcgacttgttgacctgctgcaccgtggtcacactctcatcaagcgcaggaatcgcatgatctcccgtttctttgactgtctcggcgagctggtcgaacagtttgccgagacgaatcaacgggtagatcatgaaaccggcaagaatcgcgaaagcgattgccgcaatcagaccggcgatttctccaacacccatcttgtacctcttttcagtcccacggttgcccgcgaacacaacacgcgcataacagtagtaaaaagcccagacctaaggcaagtttcgtccgccggtcactggttatacgatacgacggttaccgcttcagcgataggcttactggtgtcgaaatcgagcgtggtgaccgatccgttcgcagggcgttcgctgaggtcatagccttccggcgcgaaacggtgcataaggctcagcagcgtgttgccgtgggaaatctgcaacacgtcatcactgtccctcagcgcaggattcgaagcgatcagcgcgaatccctcctcgactctcgaccaatattccacgtcggactcggcatcgtggaatggatccgcttccttaaggaagtcgcgggtcgcaccaagaccgaactttgcgacgatgtcgttgtagttcttcgcaccgtgcggccctcccgcggcggtccacgccacgcccatatcctggccttcgaaatagccgtagaactgttcgcggaaatgcatgtcactgaccagttgggggcgggtgtgtcctgcggcctcattcacgtcgaggatgcgctgggctgtcatttgcgcacgcgtggtgtcggagcaatatgccgcggcgaaatcaaactccttcagtttgtttgcggctttgtctgcgtcggcgatgccggattccgtcaatggagaattagaccagccctgcaacctgttatatcggttgaaaaacgtctgcccgtgtcggacaagatgaagatgaagcaacatgggttccatgctaccctcacggtttgagcaaatccgtgctatacgatgttgttatgggtcattttatttcacgttggctaattcttaccgtcgcggcgggcgttatggttgcggttctgcccggcatgcacgccattggcgagccccctgtgcttggcatcgcggcgttcgccttgttcatggcgcttatcaatgcttccataaagccgattatccatgtcatagcgttgccgttctcgattatttcgttcggactggtcgcactggtgatcaattggctgttcatgcagcttgcgtcatggttggcgctgtcgtttttctctgtgggcgtcactattgacggattcgcatggtctgtgcttggctcacttgttatgacgattgtgagcggcatagtaggcggcatcatcggcgactgaaggcttcccgttgctcaaaaaggccgcacatgcgcttgagatagcgaagagcctcgcaatcctgacgattgcgaggctcttgctgtatgtccttatactgtatgttcttacagtatgtagatccagatcagcgggcgtagaattcgaccacgtactggatgttgacctgcaccgggatttcctcggcttcaggcttgcgagtcagggtggccttcagggaaggcaggttgacgtccagatagcccggaaccggcggcagcacatcgcggtgagtgccttcggccgcaatctggaacggaaccatggtctggctcttggccttgacctgaatggtctggccaggcttgacgcggtaggacgggcggtcgacgatgttgccgtcaacgaggatgtggcggtgaaccacgaactgacgtgcctgagcggtggtgcgggcgaagcctgcacgcaggaccagggcgtcgagacgggtctcgagatcgatcagcatggcgttaccggtctggccggcggtgtgggtgcccttctcgtaagcggcgcgaagctgcttctcagagatgccatactgagcgcgaagacgctgcttttcgcgcagacgcactgcgtaatcggactcagtgcgacggcgggtgcggccgtgctcacccggagcgtacggacgcttttcgaagatgcgctgagccttaggggtcagagcgatgccgagggcgcgggaaaggcgcacctgacggcgagaacgctgaacgttcgtcattggtttaatcctttgtttgttctgtcgttgtctgaacggagcgcacaccggtttccgatatgcgctgagccagcctctccagtgcttcttcgtgcatgcgcacgaacgacttgaacacgtgccgtaaacagctcgtatcggtcgccgacccactgatgggctaagactccagacggtatgctcccttgcgggcgcacaccaatcgttaataatacacatgagggcgggacgagctcgtcgtttcgccctcttcggcatgtcatgccatcatggcgccgctatgcttcagccagcactcccctgtccatgcgatagattcgatccacatacgtcaaggcatccggatcatgggtgaccatcaacactgcggtgccgtcgtgcgccacttcctgcagcagccgcatgacgatggcagtgctttcggcatccagatctccggtgggttcgtccgctatcagaagtttcggaccattcatcagagctcgcgctatgctgacgcgtctcatttcgccgccggaaagctctttcgggtagcattccgccaaatcgtcgacctgcagtcggcgcagcaatgcgtgcgcacgttccatggcatggtcctgaacgggatcgttgtgtgttttcgataccggagccgccgcgatgacgtccggaagtccgtcgtcaaccgtctgttcggaagatgcgtcggatacggtttcttccactgatttcgcatcagacgaatccgcaggtatctcaacatcgcgctgcgccgttttgccgttgcacagcacggaaggaagaatcacattgtcgagtgccgtgagattcggcagcaatgtctggctttgcgtgacgaatccgacgatccgattgcgtacgactgacatttgtttgtcgttcaaccgcgtcacgtcattgccgtccaagtcgatagagcccgatgtgggtttcagcagtccggtgatgagattcaacaatgtgcttttgccattgcccgaacggccgacgatcgccacgaactcgccttggcccagcctgaaatccacatggtccacggctgcgaacggtttgccgcgacgggtgaactcgcgagtgagctcttgtacttcgagaaccgtgttttccgccatcattcaccttctctcaaagtcagataggtttcgggagcggaaagtttcaccgccgtcgtcacggaggcgagcagtccggtaagcaccgcgaacacgaaactcactgcgatcaatgccaacacattccacatgttggtttgcagatacggcaactgcagctgccgtccgataagcgtgctgaacgggaaaatcgccagcgacgcgaccgcaatgcctatcacaccgcccaaagctccgatcatggccgattccttcacgatgatgccgaccaaagtggaacgattggcaccaagaatgcgatacgcggcgaattcacgtttgcgttcgttcatggcggacgagaacacagcaagcagcacgatcagccccatgacccagaacaccgcgacgaaaagggtcacgtagcgaatgatcacgttcagattggatttcgttgtggctgtgatgccccccggatacacgtatccgaggcttttgattcctgttgttttggtgatgttcgaagcgacctgctgggcggagtaaccgtccttgaccttgatgagcacggcggaaacggctttgtcggcatattcttccggaatggcggcatgccccaccttggcggaatatccgaccacgtcgggaacggtctgcatgttcacgaacacggaatcgtcgagcgacgtgccggtattggcgagttgcgccgccacggggaattcgtgcccatagagtttgaccgtgttgttgcccgacacgctgatgctggctcctgcaacgatctggccgcgctggagcgtgccgtcgaactgcgatgcgatccaaggggtgatcacgaagtcggtatcggggttgaatccgatgatctggactttctcgtcgcagcatgcggcggccaacgatgagatatatgtttgttccgtgatttcgtcgatgccgtcggcttttgccacttcgtcggtgatctcgttggtgaagtagaacgtgcttgccgatccgttggtcagcaacgcttcggcttcgtttttggtgttttgcggcgtgaccatgagatcggcgcccatacgttcctgcatgctgttcaagccggcttcaaggttcatggacagcagtgaaccaccatagaaggccacggtaagcatggcgacaacgatggtgagcgccgcggtacgaaacggtttgcgtttgagattgaccaggggcaacccgccaagggtgatgtgttgcgtcatattgggtcaggcgcgcttcgccggcttgagatcgagatatgccgcgattgccgcaagtacagccagcagcacgccgagcacgatcagcgtcggcaaggtgaccatatggcagcgcatcatggcacccttgcacacgccgatgagcacggtcggcacggcgatggtcagcacgccgagcaccgcattggcgaggtcaagaccggcgcgggtctgatcggatacgaacaggccgacaatgccaagcgccacgatcacgatgccgatgccgagcgcggcctgagccgtgtaatgacatgccatcggcgtttctttgaccgcgcatacgtgagcgaaggtctgcggcgcgatggcgatcaagatgccgagcacgatctgcgaaatgcctgcgtacagtttcttattcatagcttcctctcaaaaaaagacaaacaccgccgattattgcagggtctctttgaaaaagaaagtcttgttttttcctccttttcgtgctacagaggagatttcatccgttcttcatctccgtcatagcatttcaatgggtgccatacgcaacagcagacgcttgacctcaccattgccaaaatcaacggtaatgaccgaattcatgcccttgtcctgcgtttcaatgaccgtacccaacccgaaatgatcatgcgtaagcttgtcgccgacatgcacgtctgcaatgttcagatcattatggctaccggccgggcttgcggatgaggatttggttaaatccacaggcttgtttttcggcttgacacgtcgcgtggtgaccttgcccgatttccctcctgacttgccggagccatacgaaccatacgagccgtatgaggaaccggtccccgatcctccgcacgagcgccgggatgtggaaccatacgaggatgatgagccctgcgtagccgggccgccgtactgcgagcgccctgccccatatgaagacgatccgtatgaggaacgagaccaccgcgagccggaaccgtatgaggaaccataatccgactttccatacgaggaaccgccgaatgacatcgatccgaaatcgtcatcatcgtcccagccgccgaactcgtcgtcgtcatcctgccagctggcacgcatgcgttcggcgccggcttcgcgtcttttccaatcaatcagttcgtctggaatctcatcgaggaactgactgggcatcatgtcgctggcttgcccccattgcgcgcgtacggccgcgcgtgtcacatacaggcgtcgcttcgcgcgagtgatgcccacgtaggcgagacggcgctcctctgccagttcgctggtgtcttccatggcacgctggtgtgggaatgtgccttgctccatgccggtcaggaacacatacgggtattccagaccctttgcggtatgcagggtcatcatcgtcaccttgccggaatcttcgttctcccctggcaattggtcggaatcggccaccaacgcggtggtttccaaaaatcccgccaatgtggcgtctggcgtgttctgctcgaattccgccgccactgattgcagctgggaaagattatcgacgcgggaagcgtcctgcggatcctcggagcgctgcagctcttccaaaatcccactcttggcaagcacttcggcaaccacttcggatggcttcgtgtcatggtccttcgcaaaagccgcaagctcatgcatcatgtctcggaacgcactcaacggtttcgtcgtgcgcgtggacatgccttcgatctgttccatatgttcgatcgcttcgaaaaaagtggtgccatgggcatcagcatacgaggcaacgagtccttccgcacgaacgcccagtccgcgcttcggcacattgaggatacgtcgaacgttcacattgtccgcaggattcacgatggcctgcaaatacgcgagcgcatccttgatttccctacgctcgtagaatttggtgccaccgaccagctgatatggaagattggcattaatcatggcttcttcaagcgaacgtgattgcgcgttggcacggtacatgatggcgatgtcgcggtatgcgatgccttcctcttcgtggattcgcgcgatttcgttggctatccaccctgcttcctgttgtgcgttgtcggccgcgtatccgacgattttgtcgccttcgccaagtgctgtccacaattttttcggcttgcgattttcatttcttgcaatcaccgcgttggctgcgtcgagaatggtctgcgtcgaacgataattctgctcaagcatgatggttttcgcattagggaaatcctgctcgaaatcctgaatattacgaatatccgcgcctcggaacgcataaatcgactggtcggaatcacctaccaccgtaatccaagacggtccgacacggcccgctcctcgcatatgcggatcgggctgttctcctgaatcaatgccggaaagctcacgtacgagcacatattgcgcatgattggtgtcctgatactcgtccacgaaaacataacggaacttgtgccggtagtattcgctcacctgtgggcaacgctggaacaattcgacggtgcgcatgatcaggtcgtcaaaatccacggcgttcgccatggccagacggcgctggtactccgcatagaccacggcgaccagctcgtcgacgtcgccggccgaaacctgatatccgcgctggcctggcttgtagtcgcagttcacgttttttaactggtcctgccatgaagtcaatgaattcttgcagtcggagattttgccgagcagcatgcgcggcgtataccgtttcgtatcgatgttcaaatcgccgctgatgagcttgaccaaacgttcgcaatcagccgtgtcataaatggagaatccagaggtaaggccgatttccttgccgtctcgtcggaggatacgcacgcacgcggaatggaaggtggagatccacatatgttcggcttcaggccccacgagagcagcaagacgttcacgcatttccgctgcggccttgttcgtgaaggtgatggcgagaatgctgctcgcccaaaaaccgtgtgccagcagccatgcgatgcgtctggtgagcacgcgggtcttaccggatccggcgcctgctccgataagcagggcctggccgtagtacttcaccgcttccatctgttgcggattgaggtccttgattagactttgcggatcgcacaggcttggccccatattctgctccaccggttcctctttccatgaagattcaaagtcgattactgcgaaattcatgtctatcacacatgcaggtcagcgcaacactcgcatggtcaattgacacgcgtatgctgaacgtttatatgcggttcaccgtatgtcaacatcaacgccgccttatgcggccaacaatctaaggggattcatgaaggagctcgaagagcgcattcgcctgcagggtaccgtcaaaccgggtaatgtgctgaaagtggacgctttcctcaaccaccagtgcgatgtcgaattgttcgaccgcatgggtgccgcttgggcggagcattttgccgataagaccatcaataagatcctgaccattgaagcttccggcattggtatcgcctgtgttgccgcgcgtcatttcgacaatgcacctgtggtgttcgccaagaaggcgcagtccatcaatctcgatggcgaccagtacaccaccaccgtctactccttcaccaagcagaaggaattccccgtcatcgtgtccaagaggtatctcaacgaaggcgaccatgtgctgttgcttgatgacttcctggccaacggcaaggctctgaagggcctgattaatctgtgccatgatgccggagcgacggtcgagggcatcggcatcgcggtggagaagggtttccaaggcggcggcgatgagttgcgtgcagcgggatacgacgttgattccctggcaatcgtggagtcgatggatccggaaaccggtgtcatcgagttccgctcctgatcgtcgtatcttagggcacgtatcagcaaccattacaacctgttgctcatcacagtatgaatgaataagagaggattcgttgtgagcgaagagaagaagaaagacaatacgaacgaaaagaagggcgtttcctttgaagcactaagcagcttggacgcacctgtttcgttctggaagggcatcccgttcggcctgcagcatgtcatggcgatgttcgtggccaatctggctccgattttcctagtggcttccgccgccaacatgagtgccgagcagtctgccacgatcattcaggccggtctgctggtggcaggtctgggcacttgcctgcagctgtacggcgtgtggctgatcggctcccgactgccaatggtcacgggcatttccttcacctatgtggccgccgccatgtcgatcgcccagcatcaaggctatggcgcggttgccggcgcagtcgtgcttggcggcctgttggaggtagtgcttggtttgaccgccaagtattggcgtcgtttcgtgccgccgatcgtatccgcgattgtggttacgtcgattggtttttcgctgctttccgttggtgccaccagtttcggcggtggttccggcgctaaggatttcggaagctggcagaatcttacgctcggtctgatttcgctggtcgcctgcttggctttccagctgctgatgaagggtaccgccaagcagctttccgtgctgttcggcttggttgtcggctatgttgcagcgatttttatgggcaaggtcgatttctctggattctcgaatctgcaggccgtgtccgtgccgcatttcatgcctttccagcttgaattcgatccgggtgcgattatctccttcgccttgctgtacgtcgtgtcttccgtagaggtgctcggcgataccgcggcactcaccaaggttggtctcgaccgtcagcctaccgataaggagactgcaggcgccattgcaggagacggtctcatctcctccgtctctggcctgttcggatgcctcccgttgacgtcgttcgcacagaatatcggcttggtcgccatgaccaaggtcgtcaatcgtaaggtgattctttccggtggtctgattctgatgatagccagcttcgtgcctgctgtggcggaagtgttcaattccctgccgcaggccgtgcttggcggctgcaccatcatgatgttcggtaacatcattctgtctggcttccagatgatttccgaggccggctacacgcagcgcaacatcaccattgcagcgttgagcctcaccatcggtatcggtttcacgcaggtcggtgacattttcgtcaacttcccgccgctgttccagtccatcttcgcatccaactgcatcgctgtgtcgttcgttgtggccgtgctgttgaacgcgctgctgccgagcgaagagcatttcctgtcggctccgcagcatcaggaagactgagactattcagtcttaaggtgatatgaggaatccccctgctcaaacgagtcagggggattcctcatattcatcgcaaaactgctttatcacgattcacgagaagctattctcagtgtccttgcttaatccagttcgtaatcgcatccttaacggcttgggcgtacaacgtattggacatgccggggtgaataccatctccggcaagctcatcaggatacgccgaaatcgtagcatcccagtcaacgagaacaacattgtcggaatgggcggccgcgaagtcgctcaacgcgtcgttcgttccggaaacccaagacacaggggcatgcgcgttaatcagcacaagcacatgattcggtccaatgtcgttcagtatgtcattgagttggacatcggtcaccgctgaattcgtagccaagccgaccagcacccattggcgcaatccttccggctggcttttggctttgtctataagtcccaacgccttgatcatcgagcgtgaggtttccgcatcaacagtgattccagggaaaacggattgcaaacctttactggaggcaagcatcaccgagtcaccgaatgcgaccatctgctgcccgttaggcatggtgtgtacgggtttcttgggcgttggcggatgcttcctatcgaagtcgagatgcatgccctgctgctctttcagcattctcgcattctcttccaacgcgcgttccacactggtctgctttggtgcgttgtccaccacgtatccggacatcaagcatgtgctcaataccacgacgatcgttatccagcatctggcagcatcccacatgccattttccggaagaggacgaatcatggcgatgaatccgcctcgggcaacaggctgttccactaacttccacgacatggcggtacaacatgcggtaagagcgagcgtgattagcagcatccatccaagatgccgcgcaccccactgggggaacatcgccttggtgaacaaccataaaggccaatgccacaggtaaatgccgtatgaatatcggccgaccacatcaagtggtttgaacaccagcagatcctgcatccaagatccgaaaggaatggaaccggcgaccagaaccactgaaagtagcgaagccgcgaaaatccctccatagaaagcagcaggaccctgctcaacgtgctgcatcatccataacagaatcagtaatgccacaaaagccaccgcagggccgatcttgctccagaccagacgagcgcattccatgatcgccgtttcctccggacgaccgttgccacgccgtatgatcatcagcagccatgccagcatggcacctagccaaagtcccatggcatgtgtgtccgaaccgaaatacactctggttggatcggttcccgggtgatactgcaatcccatggaaagcgcactgcacacggcaagtccggcaagtaccgccaccggcacccaacgtaccagaatttttcgaagcaggtagatcagcaaaggagccaacagatagaactgcatcagcaccgacatgaaccacagatgacggaacatgtctggattcatctgcgagaaatagttggcgccactgccgatggcataccagttgtaacaacccagcatagccgtcactatctggttgttaatgcccaccaacatgtcttggttgatgaaccatgccaacgatacggtgacgggaatcatcagaatcagcgccgggtatattctgcgcagacgcttgaggtagtattccttgaaacctattcccttgccggaatcaatatgattcagcaacgacgagaaaatcagaaaacctgaaatggtgaagaatatgtcaacacctaggaatccgccccgcagagtgccctggtcgcagtgatacaacactatcgcgatcaaggcgatgcccttgaggccattcagaccgacaaaacgacgtcttaccacaacaatcaaccgcttctctcaacatgcgacgtatgcgcgttaggcacaacgtttcgtatcgtactaccagcccctcccccattatgcggaccatgaacagatatggaaagtcattgtctgggacgattggaaacgttcggcgatcgaaaccttaaaagcggtgaaacataaggattattcgaaaaagaaaggaccgtacgtcccattggcattggatttgattccaatggaacgtacggtcctcttcatacggtcccgtcaatcatttgactgcgggatctcctcgctcacttggagaagacgttgccgtaagtgtcttcgcctgcttctgcgattgccgcggacttgcgggcgattgccagctcctcgttggtcggaatgacgcagatggtgatcttggaatccggggtggagatgatgcgcggttccttggaacgggtggcgttcttctcttcgtccagcttgacgccgaacggggcgagcttgtcgcacaccatcttgcggaccacgtcatcgttctcgccgacgcctgcggtgaaggtgatcacgtctacgccgcccatctgagcggtgtagttgccgatgtagccgacgatgcggtgtacgtagacgtcgagagccagcttggcgtcctcgttgccttcggcgaccagacggtgaacctcacggaggtcgccgaagccggtcatgcccatcatgccggaacgcttgttgaacagagcgtcgagctcgtccacgttcatgtgggcgttgcggatcaggtggaagacgacggccggatcgatatcgccggtacggccacccatcatgaggccttcgagcggagtcaggcccatggaggtctcgaccggcttgccggaaacttcggcggaggcggaagcgccgttgccgatatgcagcacgatctgcttgaggccttcagccggcttaccgatgacgctcggcaccacggaagagatgaactcgtgggaggtgccgtgggcgccgtaacggcggatgtggtactggtcggcgatttccttgttcagcgcgtaggtgcttgcggccttcggcagctggaagaagaaggaggaatcgaacacgaagatctgcgggacgtccggcaggagcgcgcgcatgacttcagcacccttggcttccggaccgttgtgcagcggcgcgagcacggcgaggtccttgacctggttgatggtcttgtcggtgaccagagccgggttcgggaagatggaaccaccctgcaccacgcggtgaccaacagccacgatgccggcctcgtccagcttcggaccgaactcgttgaagaagccgagcacgcgcttcagaccctgctcgtggtcgtggatcggctcttccagctcatgcttctcgccgttgaactcgtgcttgtagtggccgtcaaccggctcgccgatcttctcgaccaggccggaagcaataccttcaccggtttcaagatcaaccagctgatacttgatagagctggaaccggaattgatgacaaggacggttttcgccattgtgggcatcctccatgtgttaatcgatgtgccgcttgcgcgactttccaaactttagattactctttgcttgctacaaaatagcgttttactgggcttcgatggcggtcagggcaaccgtgttgatgatgtcctgcacggttgcgcctcggctcaggtcgttgaccggtcggttcagtccctgcagcaccggaccgacggccactgcgccggaggaacgctggacggccttgtacccgatgttgcccgcgcacagatccgggaacacgaacacattgacatggcccgccacatcgttgcccttggccttggtggctgcaacggtcggcgaccaagccgcgtcgaactggatgggaccgacgaccgcgaggtccggagccttctccttcacgagtgcggttgcttcctccacgagatcaacgtccggtcccttgccggatcccagcgtggagtacgacagcatgccgaccttcggatcgaggccgaacgcctttgccgtttcggcggactggatggcgatttccgcaagctgctcagcggacgggttcaggttgatggcgcaatcggagaacactgcgacatggtccttgaagcacatgaggaacgcgccggacacgagggaagttcccggcttggtcttaatgacctgcagggccgggcgtacggtgttggccgtggagttgatggatccggaaaccagaccgtcagccttgccgagcaccacaagcatggtgccgaaatagctgtcgtcggtgagctgcttgcgagcctgttcttcggtcatgcccttcttggcgcgcagttcgcacagcttggcgaccatcggagcgagcacttcctcgtcgtccttggcctggaactgcgccttttcgagggatttgagaccaagctcctcgccgcgggcgagaatgccttccctgtctccgacgatgatcagatcgacgatgtcgcgctcaagcaggtagtcggcggccttgatgatgcggtcttcggatccttccggaagcacgatggttttcttgtccgccttggccttgcccagcagactgtactggaatgcgtatggcgtggtcggcgcctcgaatggagcctcaacagcggagataagctcttcggcgttgacattcgcctcgaatgcctccgtggccttggtcacggcgtcttcctcgtcaaaatcaacggcgggtaacgtccacaccggcacctcgtaagctgcgaactcctccttgagaggttccacctgttcgtctttgcatccggtgatgaacacgccggcgaccttgctgcctgcattctcgatgatggtcttcgacgcctcgacagtgcccaggacctgttccggagtgcggttgatggtgcatacggcaagaagcacgacagacttgagatcagcggctacgtcagcattgaacgcaaagatggacgggtcgttgatggcggatttgtccgttccgacaacaaccacggcttcgggctgggcggtttcgatggcttccgtgtaggcggccacgatatcggcccgggaaccttccttgtcggtgcgtgcacgcttcgggcaaacaccgacggattgttcacggctcagccccgagttgcttgcttcaagaagaacgtcggcgaaggtttccttgcgacaaaccgccggacggaacacggccgtcttcttggcagctgcgaatgccttggtgacgccaagggccacgacgttgcggccgtttgctgcttcagggctgataatggtgacgctggttagactcacgatgtctgctcctattcgttgtttttaaggtgtgtgactgcgctgtttcgcaccatgtgccattgtaatgcgtgaacggtaacagacacgcatttcatgacatggtgtcacaacgcattacaaagttacggatatggcaaaagccccaagggaaaatcccttggggctttgttcaagcaatcagcctatagaggctagactcactcgttatcgccagcggttgcggcggtagcggagacagcaccctgcttggtggtgttgacgccagagtagacccaatcggtgtaatccgggtgatcgtagccgttgtcgactgcgaactggaaggcttcctgacggaaggcttcgagctcgttgatcttgtcggcgtacttgtcagcatcgatcatgcgcagagcttcggcaacgagctcgtagcggtcgatgttgttcacgcgaaccatgtcgtacggggtggtggtggagccctgctcctcgtagccgtggacgttgaagttgtcgtggttcgggcgatcgtagatcagaccacgcacgtcgcgagcgtaggagtggtaagcgaacaggaccggcttgtcttcggtgaacaggtcagcgaagtcagcgtcggagatagcctgatcgttctccttggtggactgcagcttgaccagatccacaacgttgacgaccttgaacttgatgccgagctcgttgagcttgtcggcagcagccatgatctcctgagccggaacgtcgccagcggaggcgagcacgatctgggcttcgtcgttggacttggcggtggaagcccactcccactcggcagcgcccttctcgagctcagcgcgagcttcgtccagggtcagccaggtagcggccggctgcttaccagcaatgatcgcgttgatcatgttggtggacttgtagcacttctcagccacagcgagcagcatgttggaatccaccgggaagtagatgccgatcacgtgatcgttgttgaagcacttgttcagcaggacggaggtgacacccggatcctggtgagagaagccgttgtgatcctgacgccacacgtgggaggagacgagcaggttcatggaggagatcggcttgcgccacgggatctcgcggacggtagcctcgagccacttggcgtgctggttcagcatggagtcgatcacgtgcacgaaggactcgtaggagctccagatgccgtgacgaccggtgagcaggtaggcctcgaggaagccttccatctggtgctcggagagctgctcagtgacctggccggtgacagccatgtgctcgtcaacctgggaggacaggtagccggcgtcccactgcttgttggtgacgtcgtaagcggcctgcagacggttggaagcggtctcgtccggtccgaagatgcggaaggagtccgggttgttcttgatgatgtcgcgagtgtagacgcccagacgacgggtggcttcgagctggccccagccgtggccgtactcggcgacttccttgacctcgtagtcttcgagggccggcaggttcagctcttcgcggatcacaccaccgttggcattcgggttggcaccgatgcgcagttcgccggtcggcatgaaggcggtgacttccggcttcacggcaccgttctcgtcgaacagttcttccggcttgtaggactcgagccagttcttgaggacttcgaagtgagcctcggtatcgcgggcggaagccagcgggacctggtgggaacgccaggagccttcggtcttcttgccgtcgatgaacttcgggcaggtccagcccttcggggtgcggaagatgatcatcgggtagaacggacgagtcatgtcgtcggtctgggctgcggccttgatgtcgcagatctcgtcgaagacggtctcgaacagctcggcgaaacgacggtggatcgacaggtgatcctcgttgtcgaagccagcgacgaactcgtacggctcatagcccatgccgtggaagaactcgtggagctcttcgtcggagatgcgggacaggatggtcgggttggcgatcttgtagccgttgaggtgcaggatcggcagcacgataccgtcggtgcgcgggttgacgagcttgttggactgccagccggtggccagcgggccggtctcagcttcgccgtcgccgacgatggccggaacgaacaggctcgggttgttcatcacagcaccgtaggcgtgagacagggcgtaacccagctcgccaccttcgtggatggagcccggagtctccggagcgtagtgggacgggatgccgcccgggtaggagaactggcggaagaacttctgcagaccagcttcgtccttggtgatcttcgggaaggtctcagtgtaggtgccgtccaggtaggactgagcggtaccagccgggccgccgtggcccgggcccatgatgatcacagtgttctgctggtgatcagcgatgagacggttgatgtggccgatgaggaagttcaggcccggggtggtgccccagtgaccgaccagacggtgcttgacgtcttcgcgggtgaaaggctccttcatcagcgggttgctacgcagatagatctggccgatggagaggtagttggctgcacgccagtacttatccacgccttcgatagcttcctcggaaaccggagcgttcagcttcttccaaggggtgccaataacaggactcgtcatgtgtactcctgtactcctgcactgtgttgtgcgattgtttattttcattcggtcctgaatctcgcaaaaccttgcggttccgcggaacgattcattcccaatcacttgagcatattacgagcgaggtgcgactttttgctgtttttttgcgactgtgtgcgcaagtgtgtcgtttctgttagaaaatgagaacttttatcgggagatttgtgaatacttcacatggtatcaaaaagattgataaacggctcaatatcaacgatattgagctaccttcgcacctttttcacgttcgttttgcaatacttgcatgcggcgtgttgaaccatgcgtagtaagcaattgtgaggtttgttcactttctgttcacagcgtttccaatgtctgctcgcgtcgccacaatagaacagttagtattgttgcttcttcatacctcatatcaaaagggagagtgttatggctgcaggtcctgtgctcgttgttgatttcggagcccagtacgcccagctgatcgcacgtcgcgtgcgtgaagccaatgtttattcggagcttgtgccgcattccatgccggtcgacgagatgctggccaaggatccgcaggccatcatcctttccggtggtccggcttcggtgttcgaaccgggcgcgccgcgtgtggacaagaaactgttcgaggccggcgttcccgtactgggcatctgctacggcttccaggccatggcctatgccttgggcgcgaatgtcgacaaggccgcccttggcgaatatggcaagaccgagaccttcatcgacaagtcggaaggcctgctcgaaggctcccccgccgatcagaacacgtggatgagccatggcgtggccgtcaagaccgcgccggagggctttgaagtgctggcgcataccgagggcgcgcccgttgccgccatgcaggacgaatcccgcaaactgtacggcgtgcagtggcatcctgaagtcaagcacaccccgatgggccagcagctcatcgagaccttcctgcacaagtgcgcagggctcggcaacaactgggatgcctccagcatcatcgaggatcaggtcgcgaagatccgcgagaaggtcggcgacgcacaggtgatttgcggcctgtccggcggcgttgattccgcagtcgcggcggctctcgtgcacaaggccatcggcgaccagctcacctgcgtgttcgtggaccacggtctgctgcgcaagggcgaggccgagcaggtcaagcatgttttcgtcgaggcgaccggcatcaagctcatcgccgtggacgcctccgaagacttcctcaccgccctgaagggtgtgagcgagccggagaagaagcgcaagatcatcggcgaaaagttcattcgcacgttcgagaaggctcagcgccaggtcatcgaagaggcgggtgcttccggcaaggaagtcaagttcctcgttcagggcaccctctacccggatgttgtggaatccggcggtggcgacggcgcagccaacatcaagtcgcaccacaatgtgggtggcctgccggacgacatcaagttccagctcgtcgagccactgcgtaccttgttcaaggatgaggttcgtgccatcggtaccgagcttggattgccggacgaaatcgtctggcgtcagccgttccctggcccgggcctcggcatccgcatcatcggcgagatcaccaaggagcgtctggatctgcttcgcgaggccgacgccatcgctcgcgaggagctttccaaggccggtcttgaccgcgatatctggcagtgcccggtcgtgctccttgccgatgtgcattccgtgggtgtgcagggcgacgagcgtacctacggttcgccaatcgtgcttcgtccggtttcctccgaagacgccatgaccgcagactggtctcgcattccgtacgatgtgcttgccacgatttcgacgcgtatcaccaatgaatgccgtcagatcaaccgtgtggtgctcgactgcacctccaagccgccggcaaccatcgagtgggagtagttccccttggtttagatgtgccgaaaaacccagtatttatgcgggtttcgggacttggtacttttcgggcaaccgattttgcaacagatgaaatagtcccccttggcttgcaactaaacctaaaaatcgcataatttttaaggcttttgccctgttttgggcagaagcctttttgcatatttgataaaattttctctttaatatatcatcaaatcagataaaacagcgaggtggatagtatgaaaacagaaaaaataccatatatatttaagtacaaaagaaagaaacgaaattgttgctttccttataaatctaaaaaaacaaattgattgaacaaggcagatacaccgacgccgtcgatgatgttctctgcaaagtgctttctgccaagaaaagaaagctcaaaatcaaataatcttgccacgacataagaccgcctacacgatgtaagcggtcttatgttttagttcgataaactggaatttctatttgtgttgccatgtcattacataatctttttctccggtagcctcatctaagccactatgctgaatctcaaatccttctctcttataaaaagatattgcccgtgcgttcttttggtatacgttcaagtgcaacttattccttttatcccttgcataattcagcagaattttacctataccctgcgattgcatttcaccagaaacaaaaatgccctcaacatattcatcatttaaccctataaaaccctgtatttctgtatcatactcatacacataaacctctgctagtaacagcgcttcttttgctgatctgaaattgcttttccagtattcggcggggataaaattatgtgcctttatatttgtatccaaccatatatctgcaactttatttatatcatcccttttaaattctctaatcataacggtgactctccataaacttgaatttaaattataacggtctttgcaaatacaccatatctaccagctgtattccactctcatagattgggtggtcataattatctataaagaaatttgatatgatatgcgaacggacaaaaccacacttttcataaaatggtattgtcagtgggctatcgcccgttcccacttgcagaatggcatattgctctctgtaattattaacaataaactcaattaaggctcttgcataacctttcccttgatattctggaaccgtcgcaatgttcttgatttcaagtatgtcattttctttatcggttatgacacactcacacttgaccccattatcatcaagtacatacatcttgccgttatcaagataacggtcaaccatatcttcctgctcatctgctaataggagcaaatcaagatattgttttttattttctttaacttcaataattttcatcaatcgcacctacaaattctgatttatcaatctttaatatcacatattatacatcataaatatgaaaatttctacccgccatctgttgacctcaaatttaaaacaggcggctttttttattttcaaaaaaagttgaaaaatttttgctcagagggggcgcaaaatgcctctcccagttcaaacaagtgagtgggagtgattccaagctgattcgttactgaacgcaaaatcgcaatcaatatgatgaagcccccgaaagtgcgaaacttccggggcttcatcatgctttccgccttctaggctcgagccagataacacctctcaaggtgtcggacgcctcgtcgctgcttacctctttacgtacggtgtcaggtttccattggttccgtgtttttcgtaggcattatgacgtttgcgagcgccactacctttgccatgttggggccggacaaggccaagccgtgtcaggaaagctaagaaccatcgtggcttgacatagcggcatccgcagaatgattacgatcctgtgcaaacgtagaatgtccttcctccgtttttgcggaggaaggacattttcataccgttttcaatattatttgcggattatcctggacaatcattgctaggccagcatgctggtccacatgtttgcgaaatcaggaagcgttttcgcagtggtggcgatgttcttgattagaatgccgttgattttcagccccagcatcgcagcgaacgtcgccatgcgatggtccgcataggtttccatttcagccggcctgagattcgttgccggcactggcacgatctccagaccgtcggccagctcacgggcttctcccccgactctggtgatttcgttgaccaatgcttccagacggttcgtctcgtggccgcgcaagtggccgatgcccagcatgcgcgtaggcttgtcggcgaagaccaggattgcggccagcgatggcgcaatctcgccggccgcagtcaggtcgaaatcacccaagccgttgatatggctgctgccggtcacttcgcagtaccggacgccgtcgatcacggggaagctgatttcagcgcccatatgttccaagtatccgggaagcaggccgcccggctgggtggtggattccggccaatggggcacgcgcacggttcctccggcgatgagcgctgcgccaaggaacggggcggcattcgacaggtcaggctcgaccgtcacggtttcgggcaactgcacggctcccggctgcacggtccacacgcgggcgtgttcgtctgcgttggcacgcacaccggaaccttgcagatcggccacggtcatgcgaatatgcggtaaactcggtgtcttctcccccgtgtgatgcagttccaaaccgcctggcactcgagagccgacgagcaatagtcccgaaataaactgcgaggatcccgaagaatcaatgctgactacgctcggctcggcgcactggctcaccgtttgaggtggaatgattgtaaatggcaggcgcccttcctcgccgtggtattcgatacatgcccccaactgttcaagaccgtccaacacgggcttcatcggacgcgcatacgcctgctcgtcaccgtcgaaatccacaggaccgtccgcgaacatggcaagaccgggcacaaagcgcatcaccgttcccgcaagaccgcagaacaccttcgtaccaccgtggaaccggccgtcggacggcggcaccaccgtaaccgtggtgtcaacctgctcatcgatttcgcagcgcactcccaacgaacgcagtgcgtccatcatcagctcggtatcacgcgagcgcaacagaccgaccaatcgcacaggacgatgcccgagagccgcaagaatgagataacggttcgacagggatttgctgcccggcaccacaacggtggcgtcgagcggcttgccggcaaacggcgccgaccaaagattctcttgagatgcgttcatagggcttatcgtatccaaaacccgaggaaaacaacgcttcaatctcgccatacagcacccgtatcttgctcgaactcgacaatcaaatgccatccataccatttccgtttgaaaacccaggcggacagaactatgcgaatatcacaaaatgccacgaggaattcccgcgatcgtcgtgtttgtaccggaaaccggggaaaggatttttcaaaccgtctgaaacacctttgtttccaacggttttggtcgggctgacaggatttgaacctgcgacattctgctcccaaagcagacgcgctaccaaactgcgctacagcccgttcacgttcacaccccgcgaatccgcctcacggaatcgcaccaagtgaacacgagtttctattatagcgtatggttggacaacgacaggcttacaatagcatttcggaagggagagtggcatgggacgtcaccagcaggccgaatcgtcaggcatcatctcctttgtgacatgcgccgttatcgcctggttcgtcatgaacgcatacatgcagttcgccccggccatctggcgtgtcacgcagcgtctgttcaccgtctgctcgggaatcgtggcaggatgcggagtcgtttcattcagtttgggttacgcacgaaaatcacgttcgctgacactcaagcatggctgggtcattccggttcgccgtgttttcgagatccttgcgctttccgtggtgtatgcttcgaccattttcgtcacatcgttcatgatgttgtccatcgtcaacaacatgatgggcatccgcacgctgaaaggctatctgccgatcctatgcgcggccatcgcaggcgttgtaggctatatcactttcgtgcaggcggaacttatgaatgccaaaacgatcgcttccctactgccatttttcgtggtgtctggcgtgagtatcgcaggattgacgtccgacgatccgtactggtacaacaataatttctctcaattgggcgaccgtacgacgttcgccgcgcgtatgttcaattcgacgctgacgctcgcgggcatctgcattgtgatcatcagctatttcgccgtttccgagctcatcaccacgtatcgtctgcaattgcagtatctggattccaatgccatcaatgagacgccgaagcattttcgtacgaggattctgctgctgtcaatcatgttgacgttggccggcatcgctttcgtaggtatcggcatgttccgttacacaccgcatccgattttgcacaacgtgttcgcccgcggcctaccatgtttgatgagcgtgctgatgattgccctgccttggcttgccccgcaactctcaaaggtcgtatacgtggtttccgatcttgcgattgcgattggggcttatgccggattccaatggctgagcgggcataacacgctgacgaatgtggaggcgttggccggcatgatgttccttggctggttcatcattttctcgcgtcaaatcgccgccatcgaagcggatcgcgtgcagacgcagctgatactggcgcaatctgagagaccacgctccgtcgaggatcttgcggaagtcagcgaaactgttcccgacacagtttcgaggctcgccgcacaagtctgatgcaaggctgaccggcaaccgccggatttcaacatatacataccagtggggtggagccatcgcattggcgacgactccaccccactagattctgacggcataacgcgagtgcgccgtcagaagttgtagtgcttgttggacggcttcttgtcgctcatcaacagcaggaagcttcttgattgcgcagtaatcgcaaaaccggcctcataattgagttctggcccctttggattatgcgtgtcgacaattaagcgccatttcttgccatattgctcatcgggcagggtgaacatgatcggctcgtaatgcgcgttgaaaatcagaatgaaatcattgtcgaccatctgattgccgtaccagtcggtttccggaatatcggaaccgttcagatagatcatcacagtgaaggcgtgtgtgtttgaccagtcgtccatatccataatggagccggtatgatccatccattcgacctgcggaatcgcagtgctgtcgtctccctgctcgcgaccggagaagaagcggcggcgatgcagcacaggatgctcaagcctcaaatggatcagcttcgatacgaattcgagcaggtccttctgatcctcgtccagatcccagttcgtccaggagatcgcattgtcctggcagtaggcgttgttattgccctgctgggtgcgcgccacttcgtcgccgccgcagatcatcggaatgccttggctgagcagcaacgtggcgaacatgttgcgcatctgctgttgacgaagctcgttaacatccttgatggtcgtaggaccttcgacaccgcagttccaagaacggttgttgctttcgccgtcgcgattgccttcgccgttggcctcattatgcttctcgttgtagctcaccagatcgttcatggtgaagccgtcgtgcgcggtgatgaagttcacggatgcgaccggtcggcggccattgacctgatacaggtcggaactgcccatgaatcggctggcgaattccggcaacgtggacggctgcgagcgccagaagtcgcgcacgcaatcgcggtagcggccgttccattcggaccagctggacgggaagccgcccacctgatagccgccagagccgagatcccatggttccgcgatcagcttgacgcgggagatcaccggatcctgttcgacgatgtcgaagaaggccgacagtttgtcgacttcctggaactgacgggccaatgtggcggcaagatcgaatcggaatccgtcgacgtgcatttcggtgacccagtagcgcaggctgtcggtgatgagctgcagggcgtgcggcgagcgcatcagcagcgagttgccggtgcctgtggtgtcgaagtagtgtctgcggtcgttgtcgaccagacggtagtaggcgccgttgtcgatgcccttgaagctgagggtcggtccacggttgttgccttcggcggtgtggttgtacaccacgtcgaggatgacttccatgccggcatgatggtatgccttgaccatggatttgaattcgttgacctgttcgccacgctgtccggagctggaatacgcgttgtgcggggcgaagaagccgatggtgttgtatccccagtagttgctcaggcctttttcctgaaggaagctgtcgttgacgaactggtggatgggcatgagctcgatggccgtgacgcccagcttcttcaggtattcgattaccgaggggtacgccagacccgcataggttccgcgaatgtccggcggcacgtccatgttgaggttggtcatgccgcgtacgtgggcttcgtaaatcacggaatcgtgatatgagatgttcggatgctggtcgttgccccagtcgaaataggggttcaccacggccgctttcatggtatgggcggccgagtcgagcgtgttcatgctggtaacgtcatcggggcttctgaaccagtacgagtagaggctctcatcgccgtcgatgttgccttcgatggctttagcgtaggggtcaagcagcagtttgttcgggttgcagcgcaggccttgcgtcgggtcgtatggaccgtacacgcgatagccgtaacgttgccccggttggattccgggcagatagttgtgccagacataagagttctgctcggtcatttcgattcgagtttcgttgtcttcctcatcgaaaaggcaaagctcgactttttgtgccacttgggaaaagagggcaaaattcacgccggcgccgtcatagcttgcgccgagtggatacatcgatccgggtctgatttgcatgattcaagtatctcacgtttcagcccccaaatcgcaatttcgtgttgttcggcgattatttttacgattcgaaagaactcttgcctgtattttgccggtttcgtcgaatttgctcgtgaagaatagcgatcatggaattggaggccgtaatacgggtgccgcgcagccgctgccaggagacccacgccgattcgacgtgctcatcgccgtcgaaatgacgttcgacgggatgccatgcatgcaggtgaagcaccatgatgttggcaagctcgtcggtcatgccttcggacgagtaaaactgccccacatggtcgaattcgacaccgtcacgcccggcgggctccacaccggtttcctcacgaagctcccgcagcgcggcctcctccacgtcctctcccccgtcgatgagtccagccggcagaccgtaggcgaaggcgtcgcagccgatacggtattcccgttcgatcagatacaggtcattcgcgcaatcatgcaccagcatgaccacgcaaggcgcgtgacgcatcacctgacggcgaatcaccgtttgccctccgtcacgcatcggcaatgcgatccgcaggtcgtcgacgccgaaaatcgcaccctgatacacgtgcctgctgtcaagcaccgtgaccataccggacatgtccacgccatcgctggattcatccagcaatacgtccacctgggttccgtctaccgcctcgtcacacatgacgcgtcaccgttcctgcccgctcgaaggaaataccatattccatggatcggtattcatggaaatccaacgcacggcaggaatgtcgccggtcgcttccgcaaccgcatggggaacgtcttccatcgcatactggaaccacatggattcgatagcgctgtgcggagtgttgacgaacgccggacgcacacgcccgtcaccatggcccatggcaacgccggaagcacgcatggaagcctcatagcgggcctgctctatggcgtccgtcaccggatgatgccgcagatcactggtcacatacacgtcggcaccggccgcacgcacctcatcgaacaaggaatcaccggaacccggaagcaccgccaccgtgctgaccggaacgtccagatcgccgcaaacctgcacgccaagctcggtgtacggcagcgcgccagctactcgactggcgaaatcacgcaacgccacaggttcggcaagacgccccacacgccccaaaccgaccggatgctcggcatccggatcatcgatgggcaccagcggacgctgatccaccaaaccgaacatgtcagccgcagccatgccgacgccacgatacgccgcatcggcattcgtatgccccacccacaacgcgcatccggcaagattgagcttacgcacaatctcaccacggaaacccaatcccgacaccgcatgaacggaacggaagaacaacggatgatggcaaaccagcaaatcaataccaccggcaatcgcctgatcaaccaccgccatagagggatcagccgcaaaagcgataccgcgcacaggctgacgcaaatcacccacgataagaccaggctcatcccactgctccgcatagcgaagcggatacaacgtttccagcacatccacaacctgcttcagcgttgccatcattcctccttatgccattgctcgaccacgcacatccgcaacacacacgaaacccagtaccgtatcagtgcgcggcaagctgccaatccgaaccaatacccgtggaaacatccaacggaaccgccatatcgaccgcatgctccatggcatccttcaccaacgcagtgacacgctccgcctcacccggcgcaacctccaccacaagttcatcatgaatctgcaaaataatccgactggcaagaccagcctcatgcaacgcatcatcagcacgaatcatagcgatcttcataatatccgcagcagaaccctgaataggcgcattcaatgcggcacgctccgcagcatcacgtaccgcacgattcggcgacttcaagcccggaaaatacctacgacgaccataaatcgtctccgtatatcccttttcacgagccgaagaaaccaacgactccaaatactcatggaccttgccgaacgtcgcaaaatactgccgcttcaatgactcggcctcacccggcttaatgccaagctgctgcgaaagcccatacgtgctcagcccatatgccaagccatagctcatcgccttaacatgactgcgctgatcagacgtaatctcatccacaggaacgccatacaccaaactcgccacatacttatgaaaatccctaccggaacggaacgcctcaatcaacgcctcatcaccagaaagatcagccataatacgcaactcaacctgagaataatccgaactcaacaacgactcaaaaccctcaccaggcacaaaagccgaacgaatctcacgaccagcaggatcacgattcggaatattctgcaaattcggatcaaccgaactcaaccgaccagtcgcagccacagtctgctcaaacgtcgtatgaatgcgaccatcagacctgttcgtcgcatcaatcaacgtctgcacaatctgcttaagcttattcttctcacgatgcaacaacaacgcatcaagaaactgacaagccctatcattaccatacgaacgatcacgcaacacctgcaaagcagccgcattcgtagtatacgaaccagtcttagtcttcttcgtaggcttcaagcccatatcctcaaacagaatcttctgcaactgcttaggactttgcagattcacgcgctcgcccgcatactgccatgccgtttcctgcgcgtaattcgcgtcggcggcaagctgttcgcgcatgctcatcagcctgttcatatcgacttgcgcaccggcatgctccatgccatacagcacacgggatactggaatctccacagattcaagcaatgagaactgctcacgctgatccaatgaatccgccagtttgcgcgccagcaaaccaacaatcgcagtatggcgcggaagctggttgtcgttccgctgcgcactatcgtccggctcgtcgaaatcaagcgtgccttgcgtcgcgccctcggactgttcctcgatatgcaggtcaaggaaatgcgccgccgcctgttccagcgtgtcggcatggaaatcgggatggaccagatacccggcaagcttggtgtcgaacagcggcttcggcaacgccacaccgacgctttccagcaggtgggactgttccttatacccatgcaccaccatggattggtggtgttcgtcaagtaccgtttgcagctgggacgccatgtcacggtcaacacgattggtacgaatcgctttatcatgtgcagcgatcatcagcgacgcataggccgcgttccccggcttgctttcgccttccacctgcaacacccacgaatgcgccacggactgcgcacactgcttcgtatgatcaatggcgaagccggagggagtcgtcttcggcgcgatttcacgttcgtcatgcagatgcccgttcggcatcggcagattgtctcgtacccatgcttccaatgcttccggcgagtcaaccgtttcatactgaggtatttcgagcttgccggactcgtcttgctgcacgggatcgttggtgggcttccccgcattgaatgttctcagcacacggtttttggtgcgtatgccgaattcaagtctggtgaacagttggttgagctggttggcgtccacctgaccgaaagtcaaatcctcgatggacacgccaaggtcaaggtcacgcaccaaggcattcacggaacgattcagtttgacctgatcgatattggcccgcaacgcctcgccttttttgccgccgatttcgtcggcatgctcgataatctggtcaagtccgccatacaggttgatccatttggccgcgaatccatcgcccacgccgggaacgccggggatgttgtcggcggtttcgccacgaagcgcggcaagatccggatatagctccggcgtgacgtggtatttctccaccaccgcgtcgggagtcatatgcttcaaatctttgaaatgatgccccggatacaacacggtgatgttgtcgttgatgagctggaacgcgtcacgatcgccggatagcaccagcgtgcgatagcctgctttgtctcccatgctcgccaacgtgccgatcacatcatcgccctcgtatccaggtttttcgatgaacgtgacgccaagggccgtcagcatccgttgaatcaacggcagctgggtcaatagatcttccggagccgcatctcgcgtgcctttgtactgcggcagcatcgtattgcggaaggtaccgcctttgacatcgaaagcgacggcaagatgatccggatgttccgcgtcgatcacctgcgaaagcatggtggcgaagccccatacggcgttggtcgcctgacctgcggatgtactgaaattctctacgggcaaggcaaaaaaagcgcggaacgccaaggaatggccgtcaacgaccaatagcgtcccgcgcgtagtgccttccacagttgctgtgttagcgctcatcctctgcttccgacttctgatcaccgtacttggcgatgatggccatagccagacgcttcttcgggatgcgctggtccatggaggtcttctgaatccaacggaacgcgccctgctcggagaagtcagccttatccatcagcaggcccttggcacggtcgacaagcttacgttcctcgagggtttcctcagccttcttcagctgctcttccgccttcttcagctgctcttcggtttcgtgcagcttggattcgctgcgctccacattgtcgagcagatcgttgatttcggcgaaacggcccatggccacttccagagccggaagcagcttggattcctcatacggcttggtgacgtatgccatggcacctgcacccgtggccttcttgaccagatcggactgggagaatgccgtaagcataacgaccggagcgatattctcatcacagatgatgcccgccgcttcgatgccatccatacgaggcatcttgacgtccatgcataccacgcttggacggaacttgcgggtcaattcgactgcttcctcaccgttagcggcttcgcccacaacctcgtagccactatcttccagcatggcaaccaaatccatacggttcacggattcgtcttcggccacgacgacggtacgcttgcgaggtttgtcatcttcctcgatggactgctcaggcgctgcggcagcctgaagttcatcgtcggtgagcacttcgtccggttccgtggtcttttctgcagacatgtcggtctctttccactgtcacacccaaagccggtctcacaaaccccaacctggtcctggactgattcgatgccgttacttgcaatcgttcggattctggaaatcttcagcttttcacagccttgattcaccctccatcacgcaagttggaacgaaccggctatcttccttgtactttcatggatgatactagcagaagcctacaagcgcgtgttgccgcaatcctctttttccttcacgtgcaaagccgaaaaatccaagaaattccgcaatcctgcaaaggccttctttccacaatcccgcttcaacgttgtcttgtttatactggtcgtatgagtagcactttcactatcagagatattgtcaacgaagacgcaacggcatcagtcagcgattacggtgcgcatgtgctttcctgggcacctgccggcgaacagactgtggtttggcggccaaaggcgattcatcttaaggaaggaactgccatccgcggcggtgttccgattattttcccttggttcaattccggtttcgaaggcgggcatgtggcttcgaagaagcccaagcatggttttgcccgcaacagtttctggcattatgacgaggaagggtccaccggagctcgtttgcgctacacgttggattcgagtgagatcgacgcagacatactttcccagtttgtttctggcccgaatcctcaatttcatgccgtttacaccattgaagtcggccatgaattgacgatgtcgcttaccgtatgtaacgatggcgacgagccattgtcttacgaagaggcactgcatacgtatctgcaggttggagacgccgaacagtcgcaggtgtgcgggctggagggcaccgattatctcgataccgtattggacggcgatccccgttgcaaccaaggtaatgaacctgtgaccttccaaggcatggttgaccgcatctactattcggcggatacgcttgagctgcgcgaccccgtgttgcagcgcaccatcattgtctccaagcagggcgcagcgcagaccgtggtatggaatccgggagagcaagccggcaatgccatcggagatttgagcgacggcgaatggcgtggcttcgtgtgcgtggaagccgtcaacaatcgcgactgcgcggtcatcgtgcctccgcacgactcacataccttgcagcaaacactgtcggtcaagcactgaaagtaaatagaaactgctggttcgatgaacatcgaatatggtttccaatgtccatcgaaccagcagtttattcatcgacaatctttcctggactacgctaatcggcgtcatgtcgatcgtccggactcgatgaatatcgacgcaaagtacataacgccaataaacagccctgaacagttaccaaccgcaacaattgttgcaataaattgtccgatgacccagatgtcgtcacggagttcttttggacatacgctgacgttgatccaggcacgattgaatgcgcatcatcgtccactttcatttcgacctgtccctcatttaattcacttcttcgaaaatccggcctcatcagttcttgctccccacctcgattacagtcacaactagcctgcaggattcttcttccttggtatctttagggcagatcctcccatcccaaatctgctttgcataggtgaccgtaaccaaagaaaaatgttcacggaaccactcatgaaattcagaggccaatccggacggacaacaaacgctacaaaaagacccacagcctgataaatgattatttgttagctgcgtgaggtcaaccttcgaaacatcaatttcgccagacatgagcttgggtagaagcgtgtctcggaggtcttctaactgacgattctcatcctcaaggtgacgttgttcctcaagcagcggagaagcccactcttcaaacttggcgcacaagttgatgttagggagcgtgagctcgatgcccgccattgtctttcccgacacttccgggaaagtggtacccgagccagcatcggcaattcgatccttgttgcgtacaagaaaacagtagacaaaagctgtgccaatttctttatgcggcacgattgatttgaaaccttggtttgtggttacctcgtcggaagcaatggcgatgtagccgattggtgctcttgagctgaatagcacagtgcccgcaggcaacttcttaatgctacaagagtcgaacccaactcgagtaatgtcatcggctccgtgtgcaacgaacttattggtagtattcgatagatccttgggtgttatccagccaatcccttcatgacagtaatattctggcctcttcttggaaggtgtagccccgcccaccacatcacctatgtcagaaatcgtgccattataggtgcccgcccctctgaataggtggtcgtaacgagcaagcaaacattgctctaaataatcatttgctggtgcgcgggcacaatgttcctaaccgttattggaaggaacacctatggaaaccatcattaataatgttctgtcacagatgcagaacatgctcgatccgtcgcagctcaaacatttggccgaagtactcagagtcacgttactgccagctcaggaaacatcagcgccgcagaatctgctgacgctattcctcacggcaaaagaggtcgaaggctgctcgccgaaaaccatcgcttactatgagagcacgctccagcacatgacccaggcccttgccaagccctgcacgcggataaacagcgatgacttgcgcgagtacctcaacagatacgagaacgaacgtcatgcgggcaaggtcaccatcgacaacattcggcgtatcatgtcaagcttcttcgcgtggcttgaagacgaggattatatcgtcaaaagccccgtaagacgcatccaccgtgtgaagaccgccgtaatggctaaggaagtcctgagcgacgaaaacctggaaactctgcgggaccgatgcggcaccttgcgggatcttgccatcgtggacattctcgcatccacaggcatgcgagtgggcgaattggtcggtttgaacatagccgacgtaaatcttcaggagcgggaatgcttggttacaggcaagggaaacaagcagcgtcccgtctatttcgacgccagaacgaagctccatctcaccgcatacctgcaatcgcgtaacgacagcaatccggcgctattcgtcgctttgaatggcgatggcgaccgtatcagcatcggcggcatcgaaagccgcctcaggcggctcggcaaagacgccggcatcaatcgagtccatccacataagttccgtcgtactctggccacgcacgccatcgacaaaggcatgccgatcgaacaggtgcaaaaactgctcgggcatgcgagaatagacacgaccatgcactacgtcatggtcaaccagaacaacgtgaaagcttcacacagaaggtatttggaatgagctggcgagagacgacccttggtgagattaccgacttaaaaagaggatttgatttgccgaaaagccagcgtttgcaaggggatgtgccggtttattcatcatcgggaattaccggatctaatagtactgcagcagtagaggggccctgtgtaatcacagggcgatacggcactatcggagaagttttcttttcgggtggtccatgttggcctctcaacacagccttgtattccaccgagttcaacggcaacaatcctcgatttgtctattatcttttgcagacaatcccgtggcaaggatacacaacagctagtgctgtgccaggcgtcaatcgaaatcacgtgaatctctgccctgtcaagatacctgacagggcaacgcaagatgcaatcgtagaagtgcttgattccattgtcgacaaaattgcccttaataatcggctaaatgattatttgttagctgcgtgaggtcaaccttcgaaacatcaatttcgccagacatgagttttggaaggagcgtatctcttagacgcgaaagggcctgattctcaatgtcattggaatatatacagtccgaaattgctttcaattgatttgtcaaggttttgattaggtcaaagggaggataaggcacagtgagatgcctaagaccatcaattgttatttgcggttgagccgagcccgttgcataatcgtacaactgatgtagcataaaatactgttttagatactcgtaatatcgtctatctttaagttcaattatgagtgaatttgacgtaataaagcttttcggcagtgagacaagaactttacctgaggcagcacctcggcaagaaattagtatctgaggctcttcgtacaagtacttagaataaaagccaatctggccattcccgccaaagaccggatatccatcctccactagttcatttttcgctagcccttttccgtacttgatatcagcaatatcgaatagagcgatcctttcttcgatatgagatgcttgattttggaaaacagtagaagcaaagtctgccaaataatcatttagccgattgttgagatcgatcttgtcatcaagaacatttagcagttccgcaactttgctttgttctccgcgggaagggagctgcacaggcatgttgcgaatatcggcaacattaatatgcgacacagttgcgccattggccaatcgcagcattctgtcacgctgttcaggagcattcagataataattcagatattcgggaaccacgaaagacgaatcgggtcgaagaagcattgtcctttgtcccaaacaaacctcaatcccaggtgagacgatagctacatttccggctggtgcttcacgtgcaagaatcagatcaccctgccttggtacagctcgggagacacgtctctcgtatacgtcttgggagaccctgtgaacatcagtcagaatcaatcttccgcgcccaacattaggtgttcggatgagtggatatcccaccccttcatccttagcgctggtatgtggacaatcgacaatcaactcgcagacgtcctgcagtgtcacctgctcacatgccatagccgatggcctccagattcttcttgatctgctcttgcagacggttggattcctcgaagcatttggcgatctcgccggtcagacgggtcatcttctcctcgaatggctcatcgtcttcttccacttcggcgacaccgacgtaacggcctggagtcaggatgtaatcctgcgccttgatatcttccgtcgtggcgatggcggagaagcccttctccgtttccagagtgccgtcacggaacgcgtcgaacgcagtcgataccttggcgatgtcctcatcggtaaactcgcggagcctgcgggacaccatggttcccatatcgcgcgcgtcgatgaacaacgtcttgccggactgcttcttgttcttggtgatgatccacaagctcacaggtataccggtgctgtagaaaagcttgtccggcattgcgatgatgccctcgaccagatcggcatccacgatcttggcgcggatctcgccctcgttgttcgtctggctggacaacgcgccgttcgccagaaccatgcccatgcggccggaacggttgagatggtggatcatgtgctggacccatgcgaagttggcgttgccctccggtggggtgccgtactgccagcgtacgtcgttctcgagtttctttcctccccagtccttcaggttgaagggcgggttagcgaggatgaaatcgaatttctcggtcttgtgcaggtcctcgaagaacgtgtcggcattatgatcgcccagatccgcgtcgatgccgcggatcgcgaggttcatggtcgccattttccacgtggtcggattggactcctggccgtacacggagatgtcgttaatgttgccctgatggcgtttgacgaagtccgcggactgtacgaacatgccgccgctgccgcagcacggatcgtacactcgcccgtggtagggttcgatgacttcgaccagcgtcttcacgacgcacgcgggtgtgtagaactcgccggcgttcttgccctccgcttcggcgaatttggccagacaatattcgtaggtgcgtccgaggatgtcgcggctatcgcccttttcggccatcttcacgttggtgaacaggtccacgacttcgcccagacgtcgcttgtcgagctcctggcgtgcgaagttcttcggcaggatgcccttgagcttgttgttctcggcctcgatctggcgcatggcctcgtcgatggccttgccgatctcgggcgtgtgcgcggccgctgcgatggtcttccagcgggcgctctcgggaacgaagaagatgttctcactcgcgtattcgtcgcggtcctcctcgaagccctctccctcctcaacgagttcctggtatttctggtcgaacttgtcggagatgtacttcaggaagatgaggccgagcacgacgttcttgtattcggaagcgtcgatgttgccgcgcagcttgtcggcagcgctccagatctgttcctcgaagccgatctcggcggtattgtccttcttctttgccatgtcttgtattatcctcctgctcgtcctattcgctgatcttggtgtcggcccacagctcgcactgttccatgacggtcttcatggcgtcctcgacgccttcgggcggatacttgtatttgcgcagcaaacgtttgatggcacgccgcatgccggccctggcgctttccttcttctgccagtcgatcgtggcgttgctccgcatcgcatcggtcaactcgcgggctatcgagacgagctggtcgttgtcgtagaagtccttgaccgcctgcggctgggtgatcgcgtcgtagaacgccatctcctcgtcgctcaagccgagcttctgcgcgtcgtcgcggtccttcatgatctccttggccatgttgacgagctcttcgatgacctgcgcgttcgtgagcatgccgttgagatacgcgttcaacgtgttctggagcatctcgctgaacttctgggatttgaccacgctggtgcgcccgtacgcccgcactttctccttgatgaggcgtttcaggctctcgatcgcgatgttcttctccttcatgccggcgacctcctggaggaacgcctcatcgaacagggagatctccacgctgtccttctcgaacaggttgagcacaccgtccgcatgcacgctctgctggaggatctcgctcacctgcttgttgaactccgtgtacgtcatgccgctgcccccgccggagccacgtccggtcaggcgaaggacctgcacgcgcaatacggataggtaagccgcctcatgcgcgtcctcttcgcttaccatgcttttgcacaggctcagcgcctggttcatgagctggcattgcttgaggaacgattccatgtcttcgtgccgttccggatcgagcagccagtcggttccctccgcgatggcgtcggcaagcgcctccctgctgttctggaagatgagtttgcggtagttgaagccgtacatgagatcacggcacacgtcgagcttttcgaggaatttcggataggcggtctcggcgatgttcatgtcgccgtaattgtgctggtcacggctggtatagtccttcatcgcccgcttgagcgcgcctgcgatgccgatgtaatccacgaccagaccgccctccttgcccttgcacacgcggttgacgcgggcgatggcctgcatgaggttatggcccttcatcggcttgaacacgtacatggtggacaggctgggcacgtcgaagccggtgagccacatgtccacgacgatggcgatcttgagggaatcggaatcgtccttgaacctgcgttccatctccttcttgtgcgtggtgccgccgcacacgtcgaaccattcctccggatcctggttcgacatggtcatcaccacgccgaccttgtctttccattcggggcgcagctccatgatcctgtagtagatcttcatcgcaatcggccggctgtacgccacgatcagggccttgccggccaggacgtcggcgcggttgttctcgtaatggtccacgatgtcgcggcacaatgcgtcgatggtttcaggagtgtcgaagatggcatcgaggccgccgaggtcatgcttggacttctccacgctcgcctcgtcggcctggtccgcgaactccttgtagaccgcgtcgatgcggcccagcgcgttctcgtcaagatggagcgagaccacacggctttcgtagtagaccggcttggtggactcgtcctcgacggactgggtcatgtcgtacacgtcgatgtagtcgccgaagatctcgcgggtgttgcggtcatccgtggagatcggcgttccggtgaaaccgatataggacgcgttcggcagtgccttgcgcacgacacgggccgcgccgaccgacacatgaccgtccgcgttgatccgttcggtcaggccgtactggccgcggtgagcctcgtccaccatcaccacaacgttgctccggtcgcacaacggctcgtcgccgtccgagaacttctgcatggtcgtgaagatgatgccgttcgcctcacgaccctcaagcagttcctgaagattcctgcggctctcggcctggaccgccttctggcgcaggaacctggcgcagcggctgaattgtccgaaaagctggtcgtcgagatcgttgcggtcggtgatgaccacgatggtcgggctttcaagataacgctgcagcagatgtgcgaagaacaccatcgaaagcgattttccgcttccctgggtgtgccagaacacgccgatcctgccatccccattgacggcctcttccgctctgacgatggctttccgcaccgcgaaatactggtggtatgcggcaatgatcttcacgaccttctcggaggaatcgttgaagcatacgaagttttggatgatgtcgagcagccgttccttcgggagcatgccgtcaatcatggtgctccatgccgcggctttcgttccggaatagtcgccgtccgccgacttccaagccacgtaacggtcctcgtcggatgtgatcgtgccgaccctggtctgggtcatatcgctcatcacgcagaacacgttgggcacgaacatgctcggtatctgcttcatgtactggcgcaattgcaggtacgcgtgtgaagcgtccgtctcctcgcgtgacggggacttcagctcgaacaataccagcggcatgccgttcacgaagatgatgacgtcgggacgtttctcggaatactccacgaacgtccactggttcacgacatggaaatcgttgttctcgggatcgtcgaaatcaagcagccggacgatgtcatcacgctcttccttgccgtcaaagaagtgcacttcgactcctgattgcaggtagtcattgaatatctcgttgcgctgctccaggctgccgatctcgacattctgaatcttccgaatggcctcctcgacggctgcttccggcagatttctgttgattcgtcgcaacgcatccgggagaatatcaggaaggaatacgtcgcgatacgagtcgtcggtgcggcgaacatcgggcccgtacaggtgctcatatccgagtttctccgttagatgttcgacgatcagattttcgtaccattcctcgttcagtggatccatggacgtgatgttgttcagagaacactccgaaaccgtacgagattcgactttggaaacagtcattgttcaccccacaaacatatggattctctcgcaaaccatctttcggtttagtctatcaattaacctatcgtctggatgtaaccaacatgagtgtctgctgtttttagattacgtcatgctgtcttatttttgttcagtagaacaagaaaaacgcccgcagcttaaacgccgacgggcatattatctcttcctctcatctacttcccaaactcaagcctcacacctcgattctcgtctggaagcccgccgcatgatattttcgaaagcagaccccctcaaaaaacgcaccgcacatccgattatcgaattcacctctcaacaaccgaggctcgtttatcacaggcccttcatctatcaccagtgcacatctctgcgcagtcctttaagagcttcgttttttgttaaaaactccgatggttcagcatctcgtaaaccgtctttgttgtgccgttgagaccccaaagcaatatagcaagctttctttgcacgggttattccgacatagtgcatgccaagagattgctcaatatctttttgtactcctttatatggaggcatgataaaacgataggcttcaagacaaaaaacgatgtcaaattcaagtcctttagccttatgataagtaagcacattaatctcatctgattgagcaggacgaaaaccccttctaagaatatccacgtctttaacggtgctgcaatatgcctcgatatcttcatcacatcccaaccccggcccacataggtcagctatagcaaacgctaaatctgtttggtttaccagatcttcttcacgaactccaaagaagtcatcaacaagagcaagtccctgattccgctttgttgttttgacattcctccggcagttctttccattgtccataattaaagttgttatccttaacaaccttaagcttcaaaggtctgttaatgatctgaggagcaaaagagataataatctggctaagacaccgctcatgatgcagatctgctccttcgacagtccgcgcttcgagcgtgggcgagccaccacatcctccaacacgggacgagactgcgcgcgtacttgtcctcagaagatcgcaattcattgatggcccgtctgcgccccaatgcgcccatgccgaacaactggctacggatctcctcggtgagacccatcaccctcacctccaacaactgtaatctcagtgcaactacagttgtgaacatgaaggctcatgtccactctgagttaacagagccaaaaaaacgatttgtgtggcattcacgacattatgcgaatgccacgcgaatcgttttttattggttttgctttaaggagcacaggatttgccgttaaggcgctgaactcgatgcctttttcagaaccgtttggcaagctgcttctcgcacactccttggagccatgtcaataccgtgcagaaagcaagatatatcacgccgacctcgcaataaagcaccagtggttcataggcggtggcgacgatacgctgcgcggccatgaacatctcgaccacggtgatgttcgcggccagtgaagtgtctttcaccaaagagatgaacgtattgaacaatgcagggaacgccgaccggaaagcttggggcagcacgatcagcctcataatggtcagatagctgaggttcgtggtcaggccggcttcgacctgcccctttggcaccgcgagaatagctccgcgaagtgtctcagaagcgtacgcgccgacattcagggagaaagcgataagtgccgagggaaacgccggcacgacaatgcccacggacggcagaccaaagaaaataacgaacagttgtaccagcagaggagtccctcggaacacccacacatagaattgcgcgattcgatgcaccataggaaccttggctactcgaacaagcgccacggcgatggccaacaccagacctattgcgaacgatatcagtgtcagcgggatggttaccgtcagcccaggaatcagcaatttcgtgaaggaaccgatgatgattcccaacagtctgtcatccatgatgcccgatcctcatatccggcccgctttcgtcggatccgcacgcattatgcaaatccgttgagaacaggcaaacccatctttctactgctttaccgaaacgtcctctccaaagtacttgacagacagtttcttcaatgtgccatccttctgcagcttcgcgagggcatcgttcagcgccttcaccaagtcgtcctcacccttgcggatcgggaaggccgccgcggggctgatttcggactttgccgcgatctgcacatccgcgtccggcttctgcttgagatagtccagcacggcgagcttgtcgttcaacgtgacatcggcacgaccggaggtaatggcgtcaaccgcctgcgcgaagtcattgacagagacgatgttcgcgccattctcctgggccgtctgattccagttgctggtcttggtctccgccgcattcttacccttgatgtcggagaagctcttgatgtcgtcgttgcccttcttcgtcaccgcgacgccctgcgagtaggtgtacaggtcggtgaaatcgtacttctgcttgcgttcatcgttcggagtcacctggtcggcaaccgtatcgaactttttcgcgtccacacccgcgagcagcgaatcccaattcgcttccacgaacttggccttgacaccaagttcctcggcgactgcggtggcgatctccacatcgtagccggtcagattatcgtcggtatcgtggtacgagaacggtgcatacgtgccttccgtgccgaacacgatctcaccgttcttcttgacctgctcaagctcgctggtggcggaatcatcggatcccgcaccgttcgaggatccgcatgaggcaaatccaacgaccgaaacgacagcaagcgcggcggcagcatatttcttccagacagatttggtatcagacattttcttcctgttctttcttaacgttttggagggtttgttgattatcaattactgaattcagacgttggggatttggagtgcgtctgctgaattgtcacgagttcttccggtttccaatcgtccagcacgttgacatcgtgtatcgatgacagaaaacgtgcggttcgtggctcgtttggatggctgaagatgtgttccggcttcccctgttccacgatgttgcctccttcgaagaacacgacttggtcggaggcgttgcgggcgaaacgcatttcgtgggtgaccatcagcatggtcgttccggaatccgccaaggatttgataacggcgagcacgccgtccaccatttccggatcgagagccgatgtcggctcatccaacaccaacagttctggatccatggcgatcgcgcgcgcaatggccacgcgttgctgctgaccaccggacagtttgctcggatatcggtccgcgaatccggccatgcccacccggtcgagttcgtcatatgcgattcgtacggcttctttcctgccttttcccttggcgtggatcaggccgatggccacattgtccaaaaccgttctgttcaaaaacagattgtaattctggaacacaaaaccgattttcgcgcggaccgaagcgatatcctttggcttggtgctggtgagggacaccgggccttctccgaagtcgatggtgccagcgttggcggtctcaagaaagtcaatcgttctcagcaaagtggatttcccggatccgcttggaccgataatcgagacaacactacgttccggaatgtccaggtcgacgccgtcaagcactaattgcgattcgaacgactttcgaactccacgaattcgtatcatattcgcctccccagttcatccaatcgtgacggtcaggccaatgcatcttctgtgatcgcatcgttccacttgtcggagtgtttctccgaggccttctcgaacgcctggcccagatcctctttgagatcggcgacatcttcaatgccgatggcgagacgaatcaactcatccgtaatgcctaccctcagcctctcctcacggggaagttcgaagtgggtcatacggcacggaagctccgccaggctttcgacggcgcccagtgaaaccgcaaggcggaacagtcgaagattgtcgagcacatcaacgggatcgattccgtcgacgacctcaaagctcaatacgccgccagcgccgcgcaaccccttggccgccaggtcctcgccatcggtaagacccggataatagaccttcttcaccaacgggtgggcaagcaggtatttcgccacatcggcggcattctcctgctgtcgttccaagcgaagagccaatgtttggatgcccttacgcacggaatcgcattcaacgggtgcgaggacaccaccgagacggttctgggcgaagtagacacgctgcccgatctgctcatccttcaccacgactaggccagcgatgacatcggaatgacccgcgagatatttcgtggcggaatgcagcacgatatcagctcccagatcaaggggattctgcagataaggtgtcacgaatgtattgtccacgataacgatcgttccgtatcgatgggcgatttcagcgatcgcgtggacgtcgttcaccttcaacagcggattcgtgaccgtttcaaaatacaccgccttggctggctggattccccgtttcggatcccctgccacagcacgctctacatcttccagaacgcgggtgtcggctgacgtgacctccagaccccagcggttgaaatgctcgttcagctgcgaatacgaaccgccatagacattgtctccggcaacgatgcggtctccaggctggaaaatggacagcaccgcatggatcgccgccagaccggaggcgaaggcaaatcccctagtaccatgttcgagctgcgcgatctgcctttcgaggtattcgcgcgttggatttccgctacgtgcgtaatcccaacggggcatggcatcgaccgactcaaatgcaaaagtggacgatttatagatcggcggattcacggccctggtgtcattgtcgttcaccggttcaccgtggaccagctgtgtgttgaatcttgccatcacgcaccccctcgggttgtagagttgtttcgcgcgcacatctttcatgcttgcacgatcatctacttaacccgaaaagaaaatgcgccacacgcttggacttatcgacataatttatatgacgtttaaactgttatcaggataatttattagcttttatcaatggagcaagacatcgctctttggtttttctttcgtcctatttggcttcccatgcaccgcaacacgcacaaattaccaccctttaaaggtggaacattgggtacaccattcgagagagactaggcgtcataaagatgctgtggtgcacttcaagggcaagatcatccaagtcatcgaagacagcggccaagccacccagtaccgtattagcgtgacgcccacggattatggcggatgggatgagcaggtcgatgatctgccgcacgtcggactgggtggtcggaccgttctggcccttcagaccaccggcgagggtgatgacgccatacaaactagtttgttttagtttgcatggcgttcttgcggacgccaactccaagcctcacgtcgctcgcgcagcaacttggttcacacttcacgggagcctacgttgcccggtccgaaccggtccatcttccatctcctccatgcgcgtttagagtctccagggcactcccggcgaccccgatgctgatgatcgcgttcaagtcacggtccagccccaatccgcattccgtcaaccggaaaaacaggatgcgcagactctccataccaaacgtaagacattgagctataatcgtcttacaacaatcagcaaaagatggaggtcgagatgaccatgacttcggtgacggtccgcgtggacgacgccacgaaaaaacaggctacggacatcgtggaggatcttggacttgacctgtccagcgtgacccgcgcgttctaccggcagatcgtcagggagaaccgtatcccgctcagcctgtcgaggcaacccattccggctgagacccttgatgcgctcgacgaggtgcgcgaaaaggcggagacgtggagataatctacaatctggtggatggcaagacactgagctaccacgtaactgcacatgcgtcagatgggtttcaaaacaaaacagccgcggcgggtgatacgtccacggctgttcatcaatccggtgcccccggtgggactcgaacccacactgtacagattttgaggctgtctcctctaccaattgggatacaggggctttcgcacaacttgaccatattaacacagaaaaatgattttgcaaagtccttgagcagtcggcgtttcgcgccatactcgacaccttgatcgcaacctgtcgcagtctgcaaatcggcaacatatcaacatcatccaaaaacaacgggagggcttccatccaaacggacggaagccctcctattcgctaatcagtcagccactgaccgaaacgcatctcagtcgcaagcaccgacggtgtggacgtagatggaatcggtgcgacccggctggtgctcgccctgggcggagctcagcacaacgatcttgtcgccatcggtgaccttgccggcatccttcaggatcttatcggtgaagatcatcaggtccttgcgggacttgtcgtggtaatcctcatcgagcaggaaggactcggtaccccaagacagagccagccagtgataggtgtgctcgttgttggtgataccgtagatcggggtggccgggcgttcgcgggacacgcggtgcacggtggaaccggtctgggtgtaggcaacgatggccttggcgttcagcttgtcagccagatccacagctgcggaagacacagcgccggtggaagacatatccaggttcttcagctccgggatacggtcgaaaccgtgctcggtggcgaaggaggagatacggctcatggtgctcacggtgactgccgggtacttgccgacggcggtctcgttggaggtcatggtggcgtcggcgccgtcaaggatggcgttggcgcagtcagatgcctctgcacgggtcgggaccggggagttgaccatggagccgagcacttcggtagccacgatgaccggcttggcgtactggcgagcgagctcgatgcagcgcttggtagccagcggcacctcttcgagcgggcactcaacggccatgtcgccacgagcaaccatgataccgtcgaaggccttgacgatctcttcaaggttctcaagagcctgcggcttctcgatctttgcgacgaccgggatgcgacggccttcctcgtccatgatctcgtgggcgcggtcgatgtcggtggcgaaacgcacgaaggacatggcgatgatgtcggcgccggtgcggatagcccaacgcagatcggcttcatccttctcggtcagagccggcagggacaccgcaacgcccggcaggttgatgcccttgtggctggaaaccggcccggcaacgacgaccttggtgtacacgttgttgccttcgaccttggtgacctcaagacgaaccttgccgtcatcgatgaggatcggatcgccagcatggcaatcgcccggcaggcccttgaacgtggtggaagtgatatgctcgtcgccctcgatgtcgtcggtggtgatgacgaactcctggccttcggtcagctggaccttgtcttcaccgtcggcgttcttcttgaaccaaccgcaacggatcttcggaccctgcagatcaaccagggctgcgacgttgcggccggtggccttggcggcggcgcggaggttgttgtagaccttgaggtggtcttccggagtgccgtgggagcggttcagacgagcgacgtccatacctgcttcgacaaggctggtgatgccttccagggactcggtagctggaccgatggtatctacgatcttggctttacgcatgaatgcctgcctattcttgttgatattgattttggatctgacgaccctgtttccaaccgaccagtctactagcaaaaagcgctcacttccaccctgaaacgaggcgtgttgtgagcgctcacatttttttgataaaaagaaaccgcatgtttccatgcggtttctcaaatcgtcacttttcctttgcttcgatggcacgcatcttcagtacgctggccaatgcggcaccaccaatcgccacaacgatcaccgccaaagacagccatgtaggcacttcaggcacccaagcgatcggttgaccgccgttgatgaacggcaacgaattgccgtgcaatgcctccataatgagcttgactccaatgaagcccagcaccacggaaagtccaagaggcagatacaccagcttgtcgagcagctcgccaagcaggaagtacagctgctgcaagccgagcaatgcgaacacattggacgtgaacacaatgaacggatccttcgtcaaaccgaaaatcgcaggaatggagtcaaaggcaaacatcacatcggtggtgccgatggtcagaaagacgatcagcatcggagtccaatacttggcaccgtttttgacggtacgcaacttttctccgtcatactcatcggtgatcttgatcaccttgcgcaatgcacgaatcaagccattctcatgatattcctcatcttcgtctcccccagtgaccaacttgatggcggtgacgataagaaatgcgccgaacaggaagaacacccaggtgaagcgggagataatggccgcgccgatgaggatgaacacgccgcgcaacaccaatgcgatcgtgatgccgatggacagcacgaatttctgcagctgttttggcaccgcaaaattcgacataatgatgacgaagacgaatagattgtcaatactcagcgaatattccgtaagccagcccgaataaaattcgatggccggcttagaacctgcgaagaaccacataagtccgccgaagatcaacgccatgactacaaagaacgcgatatgctgcacgcattccttggtggagggcacatggggcttacgtccgatgataaacaagtcaaccacgaagaagacggcaagcaccgcgaacgtggcgatttcaaaaacaagtggtgtttcagccataatccactatggtacggatgccgtatgaccggtcggaactatttgctcgcctccgtcatctgccgaagttcctttttcaggtcgcggatctcgtcacgcaaacgagccgcaagctcgaattgcagttgttcggcggcggcatgcatctgctcggacagttgtcgaatgagatcagctagatcctgcgcgggcaatccggccttgagaatctcctcatgccgtctgtcagattcctccttgctggtagcaggcacgccaagatgcgagttgccggctttgccttcattacggtagccggtaccgagcaatgtctgggtgtcgacgtcctccttggcaagcatgtcgttgacatcggagatcttcttgatgagcggcttcggatcgatgccatgttccttattgtaggcaatctggatatcacgacggcgattggtctcgtcgatggccttgtgcatggcttcggtgatgtcatccgcatacatgatgacggtgccggacacatttctcgcggcacgaccaatcgtctggatgagggaacgataggaacgcaggaaaccttccttgtctgcgtcaaggatcgcaaccaacgatacttccggcaaatcaagaccctcacgcaatagattgatgccgacgatgacatcgatcttgccctcacgcaattcacgcaacaattcgacacgtcgcagggtgtccacatcggagtgcaggtattcgactttgatgccacgctccagcagataatcagtaagatcctcagccatcttcttggtcagcgtggtcaccaacgcgcgttcgttacgtgccacacgatccttgatttcagcaagcagatcatcgatctgcccgtcaaccgggcgcacatcgatttgcggatcgaccaatcctgtcggtcgaataatctgttcgaccacaccgtcactcaagccaagctcataatcgccaggagtggcggaaaggtagaccgtctggccgacgcgctcaaggaattccggccatttgagcggtcggttgtccatcgccgaaggcagacggaagccatgttcgaccaacgtgcgtttgcgactggcatcgccttcgtacatggcgccgatctgcggcacggtaacatgcgattcgtcaatgacgagtaggaaatcgtcagggaagaaatccaataacgtatgcggcggcgtgcccggctcacggccatcgaaatgtcttgagtagttttccactccggaacatacgccgacctgggaaagcatctccaaatcgtatgtggtacgcatggtaagacgctgcgcctcaagttccttgccttgtttgcgtagttcagcggtacgttgatcaagttcctgctgaatggtagacaacgctcgctccatacgttgcggccctgccacatagtgcgatgcggggaaaatatggacttgcgattgacgcccgatcacatctccggtaagtggatgcagggttgaaatacggtcgatttcatcaccgaagaattcaatacggatggccagttcctcatatacgggaatgatttcgacggtatcgccgcgcacacggaaagtacctctggtgaaggcgatatcgttgcgcttgtactgcatggcgacgaaagtgcgcagcaagtcgtcacggtcgatctgctggccttcctcgagaaacagcatacgcccggcatattcttccggcgtaccaaggccgtaaatacaggaaaccgttgccacgaccacgcaatcacgacgcgtcagcaggttcgccgtggccgcatggcgaagccgttccacgtcgtcattgatgttggaatccttttcgatatacgtatcggtttgcggaatataggcttccggctggtagtagtcgtagtacgaaacgaaatagctcaccgcattgtctggcatgagttcacggaactcggcgcacagctgcgctgccaacgttttattcggttcgatgatcaacgtcgggcgttgcagacgttcaataagccatgccgtggtggcagttttgccagttccggtagcgcccatgagcaccacatcgttctcaccgttttcaatgcgttccgcaagctcttcaatcgccttgggctggtcgccgctcggcttatatggcgatttgaccacaaacggcttgttcgtgcgttcaatattgaatcccatacctacctcgcttccgtgcgccattgttgcattagcatatcaatatgctcgaacatttgttccaatgactgtgtggaatcgatgatctcatcggcaatggcaagacgctgttccacgctggattgatggttcacacgattccatgcctggctttcgctcatgcctcgcgttgacatcattctgctgaccctcacctgttcaggcgcttcaacagttacgatatggtcgaattcaaaaggaatgctgtcaattacttcggcgagtaacggtatgtcatgcaccactactgcttggcaatcaacttcaacagcctcatgttcgagttgcactgcaagttcataaatcagtggatgctcgattccgtccagcatcttgcgttttcgttccgcatcagcgccggaaaacacatgctctgccatccacgctcgattgagctcgcctcgatcggtcaaagcatcggagccgaaacattccactatacgctgaaggccgatgctgcctggttccaccacttgacgcgcaagcagatcataatcgacaagtactgcaccaagctcacgcagtcttgcggataccgtgcttttgccagctgctatgccgccggtcaatcctattcgaatcaccacaaccgccattgtaatgcgcttcgcatgcgcgcttgccatgcacatacgaaaagaccccgaacctgaatcaggaacggggtcttttctaaaatctagcctgagctggattggatcctagctcaggatacaatcacttgccgagcagctggtcgcgcagagcggcgagctggtcggagtcggcgagggtgccggcggaagtgttctcggaggagtagttggaagacacctcttcgaccttctcttccttcggagcctggccatcttcagcggcggaagcttcagcgttctcgagctccttggccacaaattccttatgctgctcccacagatcgtgagcggtggcgtactgggactcccactcctcacgctgcttctcgtaaccagcgatccactcgttggttgccgggtcgaagccttccggatacttgtagttgccctgctcgtcgtactctgccggcatgccgtacagagccggatcgaagtcctcggaagccggatcgacggagtcgttggcctgcttgagggacagggagatgcggcgacgatcgagatcaacgtcaatcaccttgacgaagacttcttcgcccggcttgacgacggtctccgggttctccacgtggcggttggccagctcggagatgtgcacgaggccttcgatgccgtcttcgacggagatgaagacaccgaactggacgatcttggtgaccttgcccttgacgatctggccaggaacgtgggtgcgagcgaagcgctgccacggatcttcctgggtagccttgagagacagggagatgcgctcacgatcgaggtcaacgtcgagcacctcgacggtaaccttgtcgccgaccttgacaacctcggacgggtggtcgatgtgcttccaagacagctcggaaacgtggatcaggccgtcaacgccgcccagatcaacgaatgcaccgaagttgacgatggaggacacgacgccttcgcgaatctggcccttcttgagctgggacaggaaggtttcgcgcacttcggactgggtctcttcgaggtactgacgacgggagagcaccacattgttgcggttcttgtcgagctcgaggatcttggccttgatggtctggccaatgtacggggacaggtcgcggacgcgacgcatttcgaccaaggatgccggcaggaagccgcgcagaccgatgtcgacgatgaggccacccttgacagcttcgatgacggtgccttcgacaacgccatcggcttccttgatcttctcgatgtctccccaagcgcgctcgtactgtgcacgcttcttggacagaatcagacggccttccttgtcttccttagtgacgacaagggcctcaatggtgtcgccgacctcgacgacttcgtccggatcaacgtccttcttgatggaaagctcacgggaggggatgacaccctcagtcttgtagccgatgtcgagcaggacctcgtcgtgatcgaccttgacgacggtaccttcgaccagatcaccatcatcgaagttcttgatggtggaatcgactgccttgatgaagtcctcttcggtgccgatgtcgttgatggcgaccttggcgacttcgttattgttctctgccattaatttggtttcttacaaatagtgggtggataaaatcggtcttcaattatgtgcgtgcgatataacacacgcaaggcataagtttacatgggaccatgcacaaaaaaggcgtgccgtaacccgcgacacgcccgaaattacttcatattttcacacacagagcgcaattacagctgacgctcggccatctcgaccacgttttccagcagcatggcgcgggtcatagggcctacaccgcctggattcggcgtgtatgccaaggccttctcataacaggctttatcgacatcgcccttcacgcgataacggccgaccccctcgtcgaacacgcgagaaacaccgacatcgaccaacaccgcgccttccttgatatcttccggcttgacgaaaccggcggagcccatggccgcaacgatgatatcggcctcacgcatatgcttgcgcacgtccttggtgccggtatggcacagcgtgaccgtggcattcaccgccttgcgagtcagcatgagaccaatagtgcggccgatggtgatgcctcggccgagcacgcagacctctttgccgtccaggtcaatgtcgtaggctttgagcagttcgatcacgcctcgcggagtgcatggcagcggagtagtgatctcgccgcgcgcatgcaacacgagttcgccaagattatatgggtgcataccatcggcgtctttcttggggtcgatcagatcgatgatggcgttctcgtcgatgcccttcggcaacggcaactgcacgatgtagccggtgcaggcaggatcggcgttaagctcctgtacgacttcggcgatttgttcgaatgttgcgtcggcaggcaactccttcttaatggagttcacaccgatttcagcgcaatcggcatgctttccggcaacatatttgacggatccggcatcggaaccaaccaggatagttccaagaccggggttaaccccctgctctttcagcgctgcgactcgctcggcgagattcgctttgatctgcgcggacaccatctttccatcgattttcaccgccatgccggccactccccttttcgttgtctcattgttgtattggcatttgcatgtatcgtaggctatcttggtttcagtcgtaagtcgcacacgtatttatgagatgaacacgattagggcggttcaggaagagggcaatcgacatgcgcttgcacaaacgttctttgttacgcgctttcgctgcgggaatcgcgctttgcgtggcgttcggcacggcagcatgttccggagggtcaacttcgcaggagaatgacgcctccgccgactccgaaaccccaaccgaacagatcactccaatcgaagtggtcgcctcggtcaatcaatggggttctcttgccgagcagatcggtggcgtccatgtgaaggtcacgtcggttctctcttcaaccgatgtcaatgcgcatgatttcgagccgaaaaccgacgatatcgacaaacttcagcaggcacaggtcgtagtgtccaatggtgccggctatgacacttgggccaccaagaacctcagtaagaccatggtttccgtttccgcagcacaaatggtgggcgccgtcgagggagacaatccgcatttatggttctccagtgacgcccgaaacgccatggccaaggaattggccgacacatatagccgcatcatgcccgcgcaaaagaaatatttcaacaacaaactcaccgcgtggaacaggcgggagaagaaaatagaaaaggacatgaaggcgttcagcgactcgcataagaacgtctcctacgccgccaccgaaccggtggcctactatctgctcagcgacatggggttcaccgacaacacgccggaggggtatctgcaatcgtccagcacgaattccgagccaacccccaccgatcttcaggaatttcaggaattgctggaaaagcataaagtcgaggtgctgatcaacgacacacaatccacaagcgacgccacgaacacgctgaccggcattgcttacaaatccgacgttcccgtgcttgatgtcagcgaacagatgccctccgattacaccagcctgacatcgtggatccgcgctcttatcctgtcgttgaccgatatgttcgatgaacaatccgatgccgacgatcaggatgcaacaagttccgacagcacgtcggaaaacgcggattccttggaatcaaccgcagattcctcgacgcaagacaacgatcagacaacgaacggatcgaacgatgcgccgcaaccaaatccggtgaaatgattgttcggcaaaagcgattgccgaacaatcgatcggtaatcgcttttgccaagaccatcctgcgtccaactgaatgcgggatggtcttttttgtttgcctgacgttttgctttttacgcaaagcctctcgtctgatcgttacgacggtttcaacgacaatccttattgagaatgattgtcaacaccatttgcgagtatgtacgtgcattcaaatcaaggagaagccatgcacgacgagacacctgcctgcatcgaattcgacgacgcctgcgtcaaacgaggcggtcacgtcatctggcaacacggcacgttcagcattccgcaaggctcggtaaccgcaatcgtcggtaccaacggcgcgggcaaaaccaccatgatgaaggccgagctgggattgattccaaccgcgcacggcagcatcaaggtactcggacagcctgcaggctccgcaaaccggcgcatcggctacgtgccgcaaagctacgcatccgacatcgaatcgaacatcaccgcggaacagtcggtgcttctcggcttgacgggaactcgattcggcattcatcccgtcaccaaaacacttcgcgagaaagcccgcaaggccatggacttcgtcgagttacaagacaaagcgaattatcgcctatccgaactttcgggcggactgcgccaaagggtcgccatcgcgcaggcgctcgtggatgacccgaaactgctgatgctggacgagcctctcgccaaccttgatctggcgagtcaacgcgccactgtgcacgtactcgccaaactcaaccgcgaactcggcatgaccatccaagtggtggcacacgaccttaatatgcttctgcccatcctcactggagccgtctatctgcttgacggacatccacactatgcaggcatgaacgaggtgctggattcccatctactcacgcatttatatggcacgaccgtacaggtggtcaccactccgcaaggagatatgttcgtgacgccaagcgaggacgagtctgaaaacatgagcatcgatgcgcatgctccagaagaaatcgcgcaatttcaccatcacagccacaccacgcaggaggactgagcatggacggtaccgtattcgctttcgacccggattgggtttccacgctcaacgccccattcatgacgaacgcgtttctcgccggcctgtgcatcgcattggcagccggcgtgatgggttatttcaccatcgccagacattccacattcgcagcccacgccttggcacatatcggactgccaggtgccaccggagccgtattgctcggcctgcctgtttccgcaggtcttggcgtgttcgctctcggcggagcactggtgatcggcgcgcttggcaagaaggcttcacagcgtgagatcgccactggaaccgtactcgctttcgccaccggccttggtctctttttcgcacgcatgtcaagctcggcttcgcagcagatgcagtcgattctgttcggctcgattctgacgatcaccgacggtcagatcattggtttcgcgattttcgacgtgctgcttttggctgttctggcagtgatctaccgcccgctattgttcagttcgcttgacgaacaggtggcacaggcaaaaggcgtgcccgtcggtttcatgaacatttgctttatgacaattatggccggcgtcattaccattgccgttcccgcagtcggcacattgctgatcttcgcgttggcgatcacccccgccgccaccgccaacatcatcgcccgctcaccattcaaggcgatggtcgtcgccacggtgatctgcctgatttcgatttggggagggctcatgatttccgccatgttccccgctcccccgagcttcatcatcgtgacaatttcgacgttgttttgggcggttgcgaaggctattgaatccttcaaaagaaagtagcagaaagaagtatcggaaagccgtcagcgggcgaaatcagactgcctgacgagtcgatggatcaacaggttccaccaaagcatcggcaatcgcggcgacgccttcgcccgaaccagtgaatcccatgccatccgttgtggtggcggtcatggacacctcacaacctatggcttcagacaacgctcgttcggcttcttccctgtgttttccgattttcggccgattggcgatcacgaccacgctggcactcactggcttcataccacgttcgttcagataatcgaccgtggtccgcaacatttcggcgccatgcttgcccgcgccatcggactgcgagccgacaccgaacaaggtgccgatatcaccaagaccggccgcggaaagcaatgcgtcaatcaacgcatgagcggcgacatcgccatccgaatcgccctcgatgccatcgccctcccaacgcaaacaggcaagccataacggcttgcctgcatcgtgagatgcgaatcgatgagcgtcaaaaccctgaccgatacgcatgaaacgccttacctcttcttggacttcttgctttcggcctcaactcgggccagcgtatccatggcagcctcctcgggagcctcggtatgatgctcctcatcgccgggctgggccggctcatacccaaggttcacgtccagcaaacgctgggcctcggcttcatcaaggtgttcggacagcgaaatctcggaagtcagaatgctacgggccttggtaagcatgcgcttctcaccagccgacagaccatgctcgtcaacatcacgctgcgcaaggtcacgcaccacttccgcaattttattgacatcgccggtggcgatcttctcgacattcagcttgtagcgacgagaccagttcatctccttctcaatgatcggagtgcgcagaatctcgaacaccttggccacttcgttggcgtcgacgatatctcgcacaccaacctttttggcattatcaacaggaacgttgatgaccagaccgtcagacgaaagcaccgacagctgcagatattcgcgggtgattcccttgactgtccgttcggtgatggcctccaccttcgcagcgccgtgacgtggatagacgaccatgtcgccgaccttgtaacccatgaatcctccgtgaaaagcttacacaaaacccgaattattgtgccatcaggggtggacttggccaaaaacacttgaaaaacggaaaaataggcgcgacacgggccacttttcttccgtttcatgcttacacttttgccatggctacagaatccaagatcaatgaagatgtcgttgctgttcctgttccccagggcacactggatgcagtaagcaacggtacgttctacaatcctcacgaggtgctcggcgggcacctcggttccggcaagcatgcggatgtcgtcacgatccgagtcttgcgtccgttggcaaaatccgtgacgattatcactgaacaaggtcaaacgctcgcaatccatgaatacaatggcgtcttcatggcactcgttcccgccgccgcagcagaagaggggtacggcgtgccagattaccgtattcgcacggagtatgaagacggttccgttgtggtgtctgacgatccctatcgttatctgccgaccatcggcgagatggacatgtatctattcggcgaaggccgtcacgagcgcctgtgggaggcacttggcgcacatgtgctccgctatgacgatccgatgggttcttctgaaggcgtagatggcgagcaggtggttggcaccgcgttcaccgtatgggcgccaaacgcgcatgccgtgcgcgtggtcggcgatttcaatggctggaacggacgtacccacgccatgcgcgaacttggttcttccggcatttgggaactgttcatcccaggcattgaggccggcgaaatctacaagtatgaaatcctcaacgccaataacgaatggaccatgaaggccgatccgatggagcgctcccacgagattccgccgcgcaccggatccatcgtggtcgaatccacccatgaatgggatgatgccgattggatggccgaacgcgcggccagcgacccgcataacggaccggtcagcatctatgaggtgaacgcctccagctggcgcaaggacgtgaacgactaccgtgagcttgccgacaagctggttccctacgtgcagaaggaaggcttcacgcacgtggagttcatgccgttggcggaacatccgttcgcaggatcctggggttatcaggtgaccggctactacgcgatcgattcgcgtttgggtggccccgacgatttcaagtatcttgttgagaaattgcacgaggccggcatcggtgtgatcatggattgggttccggcccacttcccgaaggatgcgttcgcactgggccgcttcgacggcacgccgttgtatgaggatccggatccgactcgtggcgagcacccggattggggcacgtacgtgttcaatttcggacgtcgcgaggtccgtaacttcctggtggccaacgcctgcttctggctggatgagttccatatcgacgcgcttcgtgtggacgcggtctcctcgatgctgtacctggactacagccgtgaggccggccagtggcatccgaacatctacggcggccgcgagaatctcgaagccatcgacttcctcaaggaagccaacgccacggcatacaagaacaatccgggcatcatgatgatcgccgaggaatccacggcttacccaggcatcaccgcgccgaccgacgccggtggtttgggattcggtctcaagtggaacatgggttggatgcacgacaccctgcagtatctgcatgaggagccgattaaccgcaagtggcaccacaacgagatcacgttctccatggtgtacgcctattcggagcattatgtgctgccgatcagccacgatgaggttgtgtacggcaagggatccatgttcggcaagatgccgggcaacgattggcagaagtatgccggtgtccgcgcgctgttcgcctaccagtgggcccacccgggcaagaacctcaccttcatgggcaatgagatcgcccagtacggcgagtgggatcatgacggttccgtggattgggccgcgcttgaatggccggaccaccagggtgtgcaaaagcttgtcgcggatttgaacacgctgtacaaggcttcccctgcactttggagccaagacttcgacccggccggcttccagtggctcaccagcgatgacgccgatcacaacacgctcagcttcgtgcgtatcggcaaggacggagagcaaatggtggttgtggtgaacttctccggcgaggcatggaccgactatcaggtaccgctcaccaagggcggcaaatggaccgaagtgctgaccacggatgatgagatctacggcggttccggcattcacaatggcacggtcgaagcgatcgaaggcgaataccattcacgtgattggtccgcgaaaatcaccgttccggcactgggcgcagtattcttgaagccggaactctgagaaaggcggaaagctatgctcaactcatcagcacaacccacaacggctccacgcaccgttctggtggtcgaagacgagccgacactggccactgccatcgcgcagcgcatcacagcggaaggctggacggcgcgcgtggcatccgacggcgccagtgcggttcaggccgcgactacgttgcgtccggatctggtcatcatggacatcatgttgcccgtgatggatggtcttgaggccacgaaacgcatcgtggcggagcgccctgtgccagtgctgatcctgacggcacgagacgacgaggccgataaggtcatcggcctcggtgccggagccgatgactacatgaccaagccgttctccatgcgcgaactcatcgcccgttgcaaggcgttgctgcgccgtgtagatcgtgccaaggtcatcgccaaaaactccgaaaacgagaagcttctcgatttcggctccttggtcatcgatcccgcgcaacgtatcgtcaccgtcaatggcaagcaggtgcacctgacccctacggaattcgatttgctggccacgctggcccgcaagccgaagtccgtgctcactcgcgagaaactgctcgaggaagtgtgggattgggtggatgcttccggcactcgcaccgtcgattcgcacgtcaaggcattgcgccataagctcggttcgaagaccattcgtaccgtgcatggcgtcggttacgcgttcgaaccgccagaagtccaagactaatgcgctaaaattcggtggtatgcgtactaccgatacaaaaccagggcgttcggtgaatccattggaaaccgaacgtcctattggtttgttctcatcgctcaaaattgaattgagcgttctgatcaccatctccaccgccattgcgttcatcatggcgtggttcctgctcaaagtagggctcagcgtatggatcgccatgcccattaccctcgccgtggctttaggaatcacatatttcttctccagaggactcacctctcccctgcgccaaatgcgcgacgccgccgaagcgatggcggaaggcgattacaccgtgcgcgtccatgtcgactccaatagtcgcgatgaagtcggccagctcgccctcaccttcaacgaaatggcggaagagcttcagcatgccgaccagatgcgccgggacatggtagccaacgtaagccacgaattacgcacgcccgtatcagcgcttcaagccatggtcgaaaacatggcggatggcgtgatcgatcctacgccatcaaatctggaaagcatcctcaatcagacgcaccgcctgtccgatctgatcgcgttccttcttgatctttcccgcatggaagccggcgcggcaagcctgcaaatcgaaatgttcaatttcgccgattttcttgacgaaaccgtggaacctttggaaatcgccgatgccgggcatgcgcatgacatcgaaatgcatgtgcccgacgatatcgagatggcaggcgatcaggaccgcctgcgccaactgttcaccaatatcatcgcgaacgcgctcaagcattccgcggacaataccacggtgcttatcgaagcacacgaaaacaaggatttcggcaccatcgtcaccaatgtcgtcaatttcggatcgcagattccgcaagaggcgcgttccgacattttccgccgtttcgtcaaaggaaaaacaggtccgggcaccgaatcgggcggaaccggcttgggattgtccatcgcacgttgggccgcccagttgcacggtggttcggtgagggtcgtcgatgacccgcgtggagccgattttgaaatcattctgccgaaataccatgttacggatgacgaatagaggatttctcacgtcactgcacttgcgtgcgtgaccatgcttgcgttgggccaaccttctgcgttcccgccggagtgtgagccaaagcaagcacggtcacgaccgtggcaccctccttccgcatcgtttcgacgcaactgcgcatggtcgcaccggtcgtgacaatatcgtctaccagaatcaccatcgtattgcgcaaggaaaccgaaggacacaccgaaacatgccccttcaaacgttgcgaccgttgcgccgcaccgctggtctgcactgatttccctttgacccccctgttctccaacgcgtcacgcaccgtcacctcgcagcctgtttcctcccgtagaaaacctgccagatgtttggcgatcggcatcatatgtttacgtccgcgacgacgtattgaagcgggagacgaaggcgcgggaaccacaacaacaacatcatggcatgaaccatgcctatcacgaacgaagtcaataacgccagacgcttttgcaagggcgcatatcgcatcggcgaacgcacggtcacattcctcgtcgccgtgatccttccacgcgagaaccgcccttctgaccgtgccacggtaccatccgcatgcgaaccagcgttgcatcgccacaccgtcaaacgactgtgcggtcggctgggaaaacaatgccctgcaagcttcgcatagcacttcatccggtttgtcgcacccggcgcagccccggggaaacagcagattaaccaccatcgagcatgccctcgccattgagttcatgcgaaacctcccaacaggttctatcgcgatagactggcgatgattccaccgcacaatttcacggtatcgttcggacaggtaaccttcaccgccctggtgcctgcctttgccgcgggataatcgttaccgtccggatccatacggtctcccacaaaaacaatctgcgccaccgtaatgccgagaatatcggccaattctcgaacagcgaacgacttgtcgacgtttttttcggagatatcgacgctgctggcgccgcccggccgtacctccaaatgcggtagatcggcggcaaccgctcgtgccagacgattcttcttctcgttggttggatcccacgcctccttggcttcgatgggcgcaagctgccctaatgcggagaatgtgatctggctgccacgatcctcgatacgttcaccccaaacgtgcgtgagccagataccctgttcgcgcgcattgcgttccaacgattcgtaagccttcgcacgatcatccgcgctgaggtcatgggcgaagaccggcgcccaatccgatccgccccaacggtaatatcgggtgccgctggtcggcataagatgcagatgcgaccgattggcttgacctgtcaaccgttccaccacctgacttttcagcaatgcatacttgccaccggtgatcaccgcgacatcaatcaacgatgtcaacgcggagaagcattcggccatgtcgtccttcattggctttttcgaccttgccaacgtgttgtcgagatcgaaggcgataaggcgtactccattgcacaattcctcgatatccacgtcgttccaacagggcacggaaatatccgtcatgatcgtttcctcctgtgtcgatgcaatgaacaatatgctatcgcatgattcgcgcaaggccctgatatggtagaagccatgtatcaattgccttgggaatcaacagtgtatagaaaccgtcatggtcgtgggacccgcactcccatgttcggtaccagacttccacgttatcgtacaagaagcggtatgttcgacgacatgctggtggctcagatccgtaggctcaacgatgcatggcccgaactggtggcaccggtacagtttgcggtcgaggatgttccgccatccgacccggcaccttgggaggccactgcgcacttgggctcgcagtctttccccgcggaacatggcattccgccgcgcgtcgtgctgtaccgtatgcctttgcaatcgcatgcgcgaagccgtatggacctgcaattcgccatccgcgacgaagtggtgttgcgcttggcggaactgtatggacgccgtcccgaagagatcgaccccgattggggtatgtgatcaacgcacgacggtcatgttctggttggccagcacctgctcgcgggcttccttcagatccgttgcgccgataatcgacactccggccagtttcgcatccgatacgtctttttggctgatacggatgttccacaccattgattggtccggatcggcaaagcttacggcggcaacgtctccatcgttgatatccgccagatcaaccgttgtcgaagcgccggattggagagcaatctcgcgctggtcaacagtatctccgacactgttgtaggacgtcaatgttgccgtgcgctcatcgcccgatatgttggtgatgcccacttgagccgtggcatggtcgggcacggccatggcggagacgctcatcggcactgaagcgttgaccaaggcgaaatcagcctggtcatcatcgccatcattggtgatcttcgcggcgacagataccggctcgctggcgctgatggtaagtccggtcgccgacttgggaactgaacccaggtcgatgaccgaaacgcgattcgattcgagcgtctgctgattggttttcttcagaccttggtcatccgtccaagatacggtgacgtcggcctgccgagacggatacacatacaggttgacggcatcgccttccgtgagtccgtcaatcgccaatgtttttgcggcaacagtattgggaaccgcataatccgatccttttgcaaccagaccatccatggctatggtgcgtaccacggccgcaacgggcgtgtccacgctggacacggtaacgtacaaagcatcctgcccggaagctgctgcggcaaggttcagcacagattccttgcccgcgccaaccgtcaacgtcgaaccagtagacaatgccaaagcacccgacttgtcggatccccaaaccttgatgttcaccgacgtggccttagccgacggattggccacgaccagctgctgggtcatgcctgttttggtgcccgacaccatcagcgactgcttcaaagccggaacgacgcaggaagcagcggaaacgcctttcaaatctccctcagtagcccaagacatcaccgaagaggccgctcccgttccatcggaagccgacagcaatcgggtattctgcaattgggctccgtcatcgaccgtgccggacgccatgaaaatatcatcatccgatccggcatcatccttgttcaacaccaatgacgaagtggcttcatcagctccgagaagccctacggaagagcggaacaccgaaccgaaggacgcataacgcgccgacgacatgatattgccgttggacgcttgatattcgctgtctccatacacatcagtatcagctatcgtcattcgtgctggacaatatgtttccagctgacgcggactgacggtgcgggatacggatgaacgctgcgttaccggcgaatccgcatgaatccaagtcgggcggtagattacggccacagtcgccagtgcgacaatgaccaacaccgacactatggccagaattacacgccaaaccgttttggaacgggaatgtttgctcatgcttcctcctgaccgtgacgcctcatgcgcggaagcgcaaccaagcaatacgctgcgagaacaatacccatgcaccacagccatgcctgacgccacacactcgattcagcctgtcgatatcccttgcggtcgatatgctgcttggccgtatcttggatggtgagacgatagtatgttcccgcatcagtacttacgacattctgcgtgccatcggaagcgctgatattggaactcaactgatcggttatctccttttgcgccttgtcttcgccggagcgcaccacatagatgcctccgaatcccaactcgctcaaatcggcgacggcgtcggaatcagcattcgacaacagctgcgcgcaatccttggcgatggccttgttcgcatcatcggaacgtccgaacgccacttcgacacgctgtgccggagagctgtcgatcaaatcacctcggcgggtgcgcatcacattgtagctgatggaaccggcactatccgcgcgtactgcgagcacacgcctcgcctcatcctgcgcaagatagtcggaagcaacaatcggcaaaccggaatcactggtcgaaaccgtgttatggtctctggcgacataatcaaaaccggcactcgccacaaccgacgccgcaatcagcatgaccagcacgattcgtgccgcacgcccggcaataatgccagtagaagcgccattcctctcaacttcgacatcgccggtgggcctctgccacagcatgacgaaacgttgcaccgcaccgcctgcgaccatgcacacgcaagacagcagtcccatcatcgtgaatgaaacgccgggaagcacggaaccggccacggcgccatccgcatcgaccgcaaccacaaccgcggcggaaagcagcgacgtggcaagacccgcgatcgccacgacccacatcatacgcgacacgcgaagcacgaatggcaggaacagcgataccgcggcaagaagcacaatcaatgccaacattgcagcagccacatactgccaaatctcgccggatacggcaacgccgaacgcacgggaaacaatatccgaaagatttgcgatcatcggatgcccatcatgcgcagacgacggcaatatcacactgccaaaaatctgacgccacgtacctgctcctgcgaaacgtaccgtgttgaccaatgtgggcgcgcatacggaagcggccggcagcggaatcagcagcagcgtcgttctatgggagcgtacaagcatcaggaacacaaggaacgacaacatcagcggcagcagcaattgcggttcggccgcgacgacgggaataaagcacaatgccgcaagcgccgcggcctgcacggaagcctgcggattgaccagatcttccgtacggtacatgcctacggctcggaaagaaaacgcgaaggccgcaggaagaaacaccatgaccgtcatcatcgtcacgtcggcatcgctgtacacgttcatcgacaatgcgatggcgaaccatgccaacgcgatcacgcaacgcaccgtgtcggaccgagtaaagattccagccaaagcccagaacgacagcaccatcaaaggagcggacaagaagaacaccacggcgactgcggtcgcaacatggccagccgtgaatacggaaaccaccatgagcaccagcagccaaggcgcgctcggggcgctgattccagttcccgcggtatacgcccacgacgtggtggcggcatgcaccaactggctgaaactggcatcggtcggcagcaacgtttgagaatatatcgacgcgccggagaatacgctccgaagcacattccaatataggaagacgatccatgcgaaggcgatcaccgccgatgcgatggcaagcccccacctgcgcatgagccttttacgcagatgcgccttggcaagagggctgaggatcacagtgccacgctggtcaagaaacgcacgcttgcgatcgttccattggccgatctgctgacgagtcgtctgcaatgcggccaatgccttcaaggagaccctactctgctcacgcaatcgggcacgggccctccatgcgcccggcaagtggagcaacgaacgccaaggcagggccaattcgcaacaggcatggtatggctgtttgcgcgtcaggcacagcacggccagtcccaacgccttcagtgtcgaccagatccacagcagcggccaccaagaacgatgcacgtccgtatacgcgtatttcgtattcgcctcgcgtaccgcaaggtacggatcgacgcggccttcctcatcttcaacaggttggccgtttttggaacgcacgccttcaaatcttgccctcctatgggcgattcgcgcctgcgggaccaccaccacacggccaccgcccaggcagatgcgcctgcacaggtccgtggattcggcgaacgtgccgaaccatggatcggcacccttccaagtacgcaaggtggccaatggaaccagcgcgccggaaagcgacacagccaacacatcctgccggccatcatactgttcctgatccggctcaccgtccaccaccagagacgtgacattgtggtgccccgcatacaaaccgacgttatgcaggctttccgcctgccaatccaactgtttcgcgccaagcaaagacgcagtcggcgtgtttttccaagcatcgagcaacacctcaaggcatgactcatcggccggcctggaatcgtcatgcaatgtccacagagcaccgacccggtcgtcaagatcgatctgttgcattgcacgagccacggcattcatgaatgaagaggcacccttcactcctacgagaatgacacgtatggtcttgctttcgggaacttccgtaagcacaccggcaggcgacgggataacgctaaacgtcatctgcataggctgctcaacctgattggtgcaatccgcaacgataatagtgcctggaagcacacgctgtgcgagcaccgcggcaaaagtggatgagaaaaaacgtagatcgctttgcgcggtaatcaccgcagccacggatgaatcggcatcctgccgatgggagtacggcctgctgttgagcagatcggtcacaattccctggatatcgctgctggcgttagaattcataatttcaagtgtacgcacagggtgtgccgtgcgttatgcccgttccttgtgttccttcttataccgacggcgctcacgttcgctcatgcccccccaaatgccgaaacgctcatcatgctcgatggcccatttcaggcattgctcacgaacctcgcactgggcgcacactcgcttggcatccctggttgatccgcccttttcaggaaagaacgcttccggatcagtctgagaacataaagccctatgctgccaggaaacatcatcatcgcttttgaacagaccccacagttccgcaagcggattatcggaggactcgtcgatcacgccccacatgcgtcctcccctgctatacgtatgcgcacttttagtcgtgttaaattacacacatgcaatttctttttgtcaagttttccgccgtgtcaatcactataattcgagaaaaatatggtacatggtacctccaagaacgacgggggcctgaagcagaatccgtgaaaatcggggaacatctctataatcccatgacagagtagtggtatgttctagaacgcgttgagatatggcgtgatcttttgtataaacaggaaggcgataccgtgaccacatcaccagccggcgataagcttcctaacgtcaatggactgcgagacgcaaagccgcgtcacagccttggctatcgagtgcagcatcgtgcgaggacgatagtcgcttcggtcatcgcggcgatgctggtgttctcgggaaccgcagcggccgcaacatggctggatgtgaatggcatcatcaaagaccattcggtcgaaatcatcggacaaggctcacttgacgccaacacctcgatcatcgatcccaactccggcaaacccatcgaattcgtactcatcgggcaggattcccgcgatggcgaagagaaccagtccgtcggaggcaacttcgacgacgtggtaggcaaccatcaggccgacaccacaatggtggcgcagatttccgcggaccgcaccaaaatcaatctcgtttccattccgcgcgactccctagtggacataccgcagtgcgaaacgaccaacggcacgattcccgcgcaatacaatgtgatgttcaactcgattttcgcgaacgcataccagaccggcggcgatctcgcttcagccgcaagctgcaccctgaatgcagtgaacagcctcaccggactgaacattcaaaacttcatcgtcgtggatttcgcaggactggtcaaaatgatcaatgccgtaggcggagtcgacctgtgcatcccacaggacgtcgacgacccctacaccagcctgcaactcaccaagggcctgcaccatctggacggacaccaggcaacgcagtacgcacgaacccgccatggtctgggagacggatccgacacatcacgaacaaccagacagcaatacctcatcaaacagttgatgaacgaagcgctcagcaagaacctctttactgacaccgcacagctctaccagctagcgaaatcagccttgcaatcactctatatctcgcaaggcatggccgataccgcagcgcttgcaggtcttgccatgagcctcaaggatttcaatctgtccaacctgtattcgcagaccgttccggtagtatccgcgccgtcggacccgaatcgttcggtctggaccgatgaggcggagacgctatgggagaagatgcgcgcggacaagccgatttatggttccgacgaatccgacgcgaacacggatgccaataccgcaggcaattccgacggtccttccgataattcgacggatggcactgacaatacggataatatgggcactgacaacacgggttcccaggaagccgcacagacgcctgatccggtcactggtctgatcacgcaagccgatggcacgcttatcgatccgaacaccggtggcaccgtcgatccggaagatggctccatccatgacgctcttaccgggcagtacatcggacttgccgatcgttacctcaacgcgacagtttgtgccgttcccgcaaagaactagaccgctttcaccgaatccgttcctacacggtgtaaatggtgtaggaacggatttctttttggaggatattgtatgagtgaagagaacggcggcaaggaccccatgcccgcaccaccgagcttcatcccgtctgcaggacggaagaagacggaatcacagcctcacaaatccacaattccttctcaatccggctctccgtcaattccaagtttttcgcctgccgcacagccagcgcgctcaagtgccccgcacgccagcaggcgtacagcgcaaccatcatccgtaactccatccggttccagcgctccacagagtttccgtcctgccgcaaactccaccagcagaccacgtaagtcggcatcatcgtctcctgcatcgtttgctcctgcttcagctccgaacaatcaccgtgcgtctcagcaggtacgaggatcctcctccatacccactggcatgccacgaacaacgcgacagaacacgcccagacaacctttgtccggcaatagcacaacaggattccaatccactgcgaaagccatgctcccccacagaaaacgacatatggggcgggtcattctcgcgtttttccttgctgtgattctcgccttgggactgtcgatattctccgcatggaattgggtggatggacagctcaacaaacagtcttggttgacgaacaaagccgataccgctggcgaaagctggctgatcctcggttccgacgaacgcgaaggcaccgttggtgacgctggcgacgtgaccggtttcagaacagacaccattctggtactcaccaaaccgaaatccggaccttcctcactgatttccattccgcgtgattccttggtggaaatcgaccagagttacatgaaaatcaacgccgtcgcccaactgtacaacggcaaacaactgattaacgaagtcgaagacatcaccgggcaaaaaatcaaccacgtggcaatggtgcaattcgggggtctggtcaaagtggtcgacgctttaggaggcgtcgaattatgctacgaccaggatgtaagcgatccgtactcccagttgaactggactgccggctgccataccgccgacggcaccaccgcgcttgcgttttctcgtatgcgttacgcggacgcacaaggcgatttcggacgtgcagcccgtcaacgccaggtcatcaacgccatagtgaaaaagggcgcgtccaagaatacgctgctgaacttcggcaaagtcaaaaaagttgcggaggctgcgttgggctccgtaaccgtggatgaaaaggcttcaacctcatcgctgatgcgcatggctttggcgttcaaaagcgcttctggggatcaaggcatttcaggaagcgtttattggaccgatcccgactactacgttgatggtgtcggctcaagcgtgctcttggacgaggataagaacctcgaattgttctccgaattggctaaggggacccatcgggctggcactgtaggcacgcttgccgaacagcagggctgatattccggtcggaggatgtggataactcatcctccgaccacaaccctggtttcagcttgcacccgctcatccgcattgcccactatggcgggtatgaagggcaagaacaaacgcaagcataccgatggattcaatgaagaccggctgatgctcatcagttggtccgcacctgtgctggcacagctcgtcatgcttgtcataatgatcgcgcaacggcaatggctatatgtggccatgcttgctcctggactcatcagcagcgcgttgtctctggcatccatggcgttgcgttccaatcagaagcagcagcatgacgaaccggtctccaccacctatgcaaaggtggtggagaccgcaaggcaaaacagccattcgccgttcgccgcaatgccccatatgtgtttcgagcggttctacgctctggacgaggacgcgctgccttggcgcaccatcacacgaacatggctttcctccacatcatcctgccctataggagtcacggagcatggcttgtttcgcacggatctgcaacgatcaggaccgcatgccatggtagcaggcaccacgggttcgggaaaatcggaattgctcatcagttggtgcttgtcgctcgccatgcaatacagccctgatgatctgcattttgtgtttttggatttcaaaggaggatcgacattcaacgctttggaacatcttccccacaccgttggcaatgtctgcgatcttgatttgttccacgcgattcgcgcgttgaatgccattgaacaggaattggtgcgtcgtgaggctctggtcagcgccgaacgtgtttccagattcgaccaattggtccggcctccggcacgactggttgtggtcatcgatgaattccatgcgcttcgagaccgtctgcccgactatatgcaacggctgaatcgtcttgcgtcacttggccgttcccttggcatgcatctgatcgtctgcacgcaatatcctatgggccaagtccatgccgacatgaaagccaatatctcgctgagcatatgcttacgggttacagaccaaatgcagtcgaacgaattgatcggcatacgtgacgcagcgctgattcctcccagcattcccggtgcagcctattgcaatgacggacaacacaccacacctttcctatgcagcgcggtccgcgatgtcaaccgacttgtccgcaatattggaacggccgcacgattccacgcctgcaaacgccccgatctcctgttttccgagcctctcacgcaacatgcaacgcaatccgatctttccatcccatcaaaccagtcatggcataacgttccctttgcgcttgccgacgatggcgtattggtgtataccgccattcttgacgtgagccaacagaatatcgccatcatcggtgcctacggcagcggcaaaaccaatctactgttgcattgcgcacgctggctatatgacacgggttgcgccaatattcgtttcacacgcaaaaccgaacatggcatggtgacggatgacggcaaacccttaccgtcgcataagcgaaccatctggattgtggatgatgcggacgaagcgcttaatcccttttcctctgcgcctgaagcgaacgaattgcgtgaggcgttggtcaatcccaatatcacagtgattgccgcggtggaaaaacctatttccgcactgctggaccgatgtccgactcgtgtggcgttcccctgcggagaacgttccaacgatcctgatgctcggcattcccggcgcaattctggacgggttcgcagccgacgactataccctcccaggtcgtggcgtgctcatgcaacaggccaaagcatgccctattcagtgcgtggaattccaaggtttttaacgattcgtgggattcttttcgcgaagactcttgaaaagtcgcgcgattcgtggttatctgagtaacggacttacatgccgtacatggcaagaggaaggcgattatatgagcagtgcttttgactggcgcgccaaggccgcatgccgcgacaaggatccggagctgtttttcccggtcggcaatacaggcgccgcctatcagcagatcgaagaggccaaggccgtctgccgcacctgcaaggtgattgacgcgtgcctgaagtgcgcgcttgacaccaatcaggattacggtgtttggggcggtttgagcgaagacgaacgtcgtgcgctcaagcgccgtgccatgcgtgcccgccgctcccaagccatgcagatgcagatctgaaattttcaaagatccatcattgcatacgctctgcgaatagcgacttacaacgaaaatgtccggttgacttcccctggtcaaccggacattttcgtatctttcctatcgttcctgcgccgcacgcagcttcatatcgagcactactcgggtgccaccgccacgacggggctcccaacggaccgtgcctccgaaatcgttgttgacgaacgtgctgatgatctgcgttcccaaaccggatccggaggaacgtgccataccatcatgctcctcattggccaagcccgtgccatcgtcttcgaccacaacattgaggttgttgccaccgcgtcccacggaaatcgtgatatgaccttctttgcgaccttcgaagccatgttccacggaattggtgatcagctcggtcagcaccaatgacaacggcgtggcatcctgcgccggcatcatgccgaatctgccgatgaagtcgatgtcgatatgctggtcacgcatggtggccaaatccaccgccatcttcaacaggctggaaatgaccttgtcgtaatcgacgatttcatcggcggtctggctcaagccttcatggaccatggcgatggtttgtacacgacgctgcgcctctttcagctctttcttgacctcttcggacttggtcttacgtgcctgcagtcgcagcaatgcggaaaccgcctgaaggttgttcttgacgcgatggtggatttcggaaatcgtcgcatccttggtctgcagttccttttcacgacggcgaagctcagtcacgtcgcgacatagcacaacagcgccaacgcggccattggcatccatcaacggcagcgaacgcatggacaccgcggacttgttggcatcgagttcggaatcgacggcggctttgccactgagcaccagaggcaaggtttccagcacgggatcgttctcgcgcagcaatttggtgccgatttcgctcagatactccccctgcatggtgctgaccgatcccaaacgtcggaagcagctgatggcattcggcgaagcatatcgcacgataccttcgacggtgagcacgatgaagccgtccgccacacgcgcattgtgacgctggttcataatcggattacgatatgggaactgaccgcgaggaatcatctcatacagctgcttacctgcgctgatgctttcggattcgtaacgtccgttcgactcccgggtggccatattcgtctcacgtaccaccaagcccagcgtcttgccattatgacgcaccggcgcgtacacattgcacaccgtggactcgcccacagtgcggagcaccgtggaacggaacaccgattcggaagccatcgcggcatccaattcagcgctcatttcctcctcgacaacgtcgccgaccacatcgtcggccctcaggctcatcaccgtggatggacgacactgttcggcaataatgtatttgccctcgccattttgcagaatgagcagcagatcagcaaaactcaggtcggcgatcacctgccagtcggcgaccagatgatgcagccattcacgatcttcgtcatcgaaatcgggacgggtcgtcaagatatgtgagaaatcagccatgcgctccatcatacgcatcacaccagaggttttgcacgacacgacgcatattgcaggaaaagcaatattgacatatccatgagttacggtaacgtaggttacggttccgtaacttacagtggaggcacacagatggcgaaacccacagacgtagagatcgaggaaaaacgagcgatcatcgccgaggcacgcgaacaggcccttcaagccaaggccgatattattcgcgtgaaggcacgcaacaaggccgagaacatccgcaagaaggccgacggcaaggcgaaaatggctatagccaagggcgaagctcgtgccgcgaaaatagaaggcatcactccggcggagatcgaacgtaagattcgtcttgacgtgcacggtcgccccaagccggcgatgcgcggctggattcatgccgtggccactcctctggcattggcggccggcatcgtgctgatctgcctggcacacggtaccggtttgaagtgggcctgcgccgtgttcatgacgtgttcgctggtattgttcggcaattccgcctgctaccatttgggcgattggtcacctcgcgtcacggatgtgctacgacgcatcgaccatatgaatatcttcctgctgatcgcaggcacttatacgccggtctcctttgcactcgaaccgttctggcgcaattcaatcatcgcgggcatgtggatctgcactaccgtggcgctcatcattcacgtcatctggatcagcgccccacgctggctttacgtgattgtgtatattattttcggtgtttccggagtggcattcatgggattgttctggatttcgccatatgccggtccggcggttgtggtgctgttggccgcaggcggagcctgctatatcgccggagccatcgtatacgcgctacgtaagcccgatccatggccgaaggtgttcggcttccatgagattttccactgcggcaccgtcgccggttacgcatgccatatggtggcgatctacatggtgatcgtgcagctatggacgtaagttcagatcatatctgattgcagtttgacgaaatatacgaaaaggctggttcatccgttgtattcgatgaaccagccttgtatttatatcgctggaatatcagattcagcttatgacgaacatcactcaggcgagcggcttggcttccttgatggtcacggaaatctcacgtccgttcggagccgtatacgacaccgtgtctccctcgtgagcgccgttgatggccgcgccgatcggggattccgggctgatgatgctgtagtccgtggcgatggacaggtcacgcgtgccaagcacgtagaccatttcacgtccgttgacatccagcgtcaccaaagaaccgtcgccgacttcgccggccttgggcgcggtcagaatcttcgcgttgcgcagcttgacggtcagttcctcgatgcggccctgatttactcgctgagcctcacgagcggcctgatagccgccgttttcgctcaaatcgccctcggcgcgtgccgcggaaaccttggaaaggatttcgtcgcgatactcgccttcgcgccaagcgagctcttccttcatcttgtcataagcttcctgcgtcagcagaagcgttttttcttcggccatgttgcctccttgaccttggaaattactctatgccgcttagtttcagcgggtggagatgatgtcgatcacgaacaccagggtgtcttcgccgccgatgccggcctgcggaacgccacgggaaccatagccatactccggcggaatggataccaccaagcgggaaccgacgttgtgccccggaacggtctggtcccaacccttgatgacctggccgacaccgatgccgaagctggccggctggtgacggtcgaagctggaatcgaacggggtgtctttgccccagaccacaccgtgatagttaacggtgacggtgtcgccgcggcgaaccatcgggccattgccctcgagcagctccacaaccttcagacctgccggagcggtctcggacgggaattcgatggtcgggcgatcgccgaactcaacattgacaacgggcatttgagatgccatggtgaacctccttgaaaagcacaatgccacctagactagcaccaaccaccgctagcattcaacgacattgaccgccaaaccaccttttgaggtttctttatacttggacatcatgtcttcgcccgtgtctttcatggttttaatggcctgatcgagggtcacgatatgcgttccatctcccagcatggccatacgaaccgcgttgatggcagtgttcgcagccatggcgttgcgttcgatgcatggaatctgtaccaaacctcccacgggatcacaggtcagtcccagattatgctcgatgccgatttccgcagcgttctccacttgctgtggagtaccgcccatcaccgcgcacaaaccggccgcagccatcgaacatgccgtaccgacttctccctggcatccgacttccgcaccggaaatggaggcattgcgtttaaacaggtaccctaccgcgcctgcagtgagcaggaaggtaataacaccctcttcgttcgcatggtcaacgaaatgccagtaatagtgaagcactgccggaatgattcctgcagcaccgttggtcggtgcggtgacgattcgcccaccgccggcgttttcctccgacaccgccaaagcgaacaaatccacccatgccgcatccgacgattcgagcaccgcatccgcgcgtttcttgtctcgcgcaagcacatcactgttcgaggcaagccttgcatacattttcggtgccctgcggggcgcattcaaaccgccgggcaacacggtctgcgacgtatggcatccgtgctgtacgcaacgacgcatcacccgccacacgttatccagttcgctgcgaacctgcaccgccgactgcatggccgtttcgttggcccacacaatgtcggcgatactcatatgttgcttctcgcataatgcaatgagatcgtcgcatgacgtgaatggatatggcacatccgagccgtcatcaagtgaggaatcactctgctgatcggcgaaagacgttccgatcggcggacgctcatgaatgccgatcatcagatcctcggcattgccttgccgtacgaagcctccaccgatggaataccagacctgttcgtcaacaagattgttctgctggtcaaatgcctggaaacgcatgccattagggtgcgcggccaagcgatgccacacgtccatcaccacatcatgcgcatagtcgaaatcgatgcgatgcttaccagccagcagcagttccccactcgactcgcattcatgacgaatgatgttcacatggtccgtatcgacggtttgcggcatgttaccttccagacctgccacagtcgcgcgatcggtaccgtgccccaaacccgtcaacgcaagagatccatacagtaccgtacgcacgcgtctcacacggccaagcgttcccgtatgttcaagcgattcgacaaatttgcatgccgccaccatcggaccaacagtatgtgaggaacttggtccaacgcctatcttgaacatttcgagaatactgaacataccaatcgtcgccttgcttctcaggtgccttgctcaggctgcatacaatgcacggaacatgagaatcataatgatcaaaccaatgatggcggccgtaacttccaccaccagcatgataatggccgtggttttacgattgccgagtttaacgtcaagtaacttggcgaacaggaaggcgacgaaaccaagcgctgcgccattcaacgcaatcgcaccaatctggccattggtgagcacactctcccccaccatggcaagcacggaattgatggtggcggagaacaccagcaggctccacgcaccgtaaccgataagtccaacaatcgcatatgcgaacggtcggaaccgttcacgcattttgagcgtgaacgattcggcgcaccacagcagcgcaaagcccacaacgaacgtgaacgccactgccatgaacaccgcttccatagcccatgggatcaacgccaacgacgccttcaacaacgagaaatacagcggagaacaagccagttcgcccacagccaaaactcctgcgacgataatcgcttgggagagcatcagcggaatttccgtatcgggctgttcgattactggcttgatatctttcgacgtcatactttttccgttccagtcggctacttggggttatcaatgccgccagtgtaataacggattgtttcgtacgtgctatccagcaatatttcacaacgtcattcggtgccgccagcgggaatcgaacccgcaatccgaagagaccgattttaagtcggttgcgtataccagtttcgccatggcggcaaggcatcgaacaagccgacgcccaagtcattatgccacgttaacgttcggcaagcaatcgcgtgccgtaatccaacacaatgccatcaagcaaaccgtgttcgctggccatgaaggagtcgatatgctgaccatggtcggcataggccgcttcgctgactttggcgagcacacgattccacaccagtgcaccgccaccgaccacgtcaacacgacccgggtgaatggttttgtaggtcaggcgctcttcgcgcggcatcgtaaggaacttgttatcgaccgcataagcgtcttccagcgagcagctggcaccatccaccgcggaatggtcgtattcggtcaatcccatggccagagcggtcatggtagtcactgtgccagacacgccgatgatagtgcgggttttgcctgcaggaaccgttttgaacgcttcatcgatatgctcgtcgatgtcggcaatggcctcttgaatctgcgcttcggtaggcggatcgttcttcaagtggcgttcggtcatacgcaccgagccaatgttcatggagaacgcggcctgcacctgcgtgttcggatggcttacgccatcgccgccaagcaccaattccgtagagccgccacccaaatcaaccaccaaatacggagcttcgacgtcgcgacgaaccacgctcgtggcaccaaggaagcttagatcagcctcttccgtaccgggaatgacttccggacgcacgccgaggatctgctcgatagtgtcttcgaattcctcacggttctcagcatcacgagtggccgaagtggcaacgaaacgaatgccatccaccggatgctttttcagcacctcggcgaattcgcgggcagcggcgtaggcacgttccaatgcctcatcggcgaaacgatgcgtcttatcaacatcctgaccgaggcgaatcacacgaagaatacgcggaacaatatcttcaacgccgtcttcgctgactcgggagaccttcagacgaatcgagttcgtaccgcaatcaatgccggcaacagtaacggatttcattgcttcttctttctgtctgaatatggttcagtcttcgttttccaccgtgcaacggcatacattggggtcgaattcatgacgaatcgcctccaatgccatgtctccgatcggattggcgccctcgcccatcaccagcgtttgcgccagcaaggcgtgcagacacttgatgcgaacaggcatgccgccggcactggtgccttcgatatgctcttcgctgtcttccatagcaacggcgatttcatgccggaacgccaaatacagttcgtgcgcacgctcgtaggcggctttcagatcgtcatcttcagccaaaagatcgttgtactccttcatcttgccttcggcttcgatgtgggagatggctttcaccgcttccgggccagtcaaatagcaagtggtagggaaaggcacacctcccggcagcagcggacgcgtgaccacagccaaaggcctgccgcacacgcaacgtgctccgacagccaccatgccacgcgggtaacgacccagctgacgctcgaccacagcaatatcatgctcggtggcaggctggtcgagaaccttcttcgccaaggttttggcctgttcgctgattgtcataccctgtgtcactcctgctgatctcctgattgctgttggttgttgtcttgtgaagtctgctgctggccaccggattcctggcttgttccattcgcatccgattcaccggttgacgtactttcggacgtttccctcgatttcgatttcacttcgtccgattggtcggcttgtttgaacgaatacgccatctccttgtaccaaggcagtacggttttctgcgattcatccgtcttttttgcatcttctgtggtttcgccggtcaccgcttcgggatgttccacacgaatcgcctgttctcctggaaatacgaatcccagacgatcccttgcctgcgccgtaacgtaagctttgtcatcccaacgcgcaatgtcgttttccagttcctgcttttgcgctatcagcgcagcttcctgcttcttcaagccattcaattcagccatattcagcgcataggtatggaacgtcgacgccagctggatggatcccaaagccacgataaataccgccacaaagaacgcgatggggccagcgctgccccttctggatgctttcttgcgtgactttgaactcatagcaatgaaaatacccgccgcgttcgacgaggaacacgacgggcactctacatcagcgcatattcgatgcgcttacgctcacttggcgatgtacttcttgcaggccttgaaagcgctgtagccagcatactgagcggtggagccgagctcctcctcgatctcgagcaggcggttgtacttggcaatacgctcgccacgagccggagcaccggtcttgatctggccggtgttctttgccacagccaagtcggagatggtggtgtccggggtctcgccggaacggtgggaaaccatggaggtgaagccgttcttggtggccagctcgatggcgtcgagggtctcggtgacggtaccgatctggttcagcttgaccagcagggagttggcggcgccgagctcgatgcccttagccagacgtgccgggttggtgaccagcaggtcgtcgccgacgaactgcagacgatcgccgagcttggcggtgatggcagcccagtcttcccagccttcttcctggaacggatcctcaatggagacgatcggatactcgttgatgaggttctcgtagaagtcgagcatgtagccggcttcacgatcgtcgccttcgaagtggtacttgccggtctccttgttgtagaactcggaggaagccacgtcgagggagatgccgatctgcttgcccggctcgtagccggcggcggagatggcgtccatgatgtagttcagggagtccttgttggacttcatcttcggagcgaagccaccctcgtcgccgaggccagtggccaggccttccttcttcaggacgttcttcagggtgtggtagacctcaacgcctgcacgcagagcctcgctgtaggtgtcgaagccgtacggggagatcatgtactcctgaatgtcggtggcgaagtcagcgtgagcgccaccgttcatgatgttcatgttcggaaccggcaggatgtggccgttggtgccgccgatgtagcggtacagcggctggcccgcggactcagcggaggcgtacagagcagccagggacacgccgaggatggcgttggcgcccagacgacccttgttcggggtgccgtcgagctcgatcatgacctcatcgagagcgcgctggtcggaagcatccatgccgatgaccttcggagcgatctcttcgttcacggccttgacggcattgagaacacccttgccctgatacacggacttgtcgccatcgcgacgctcccaagcctcagcttcaccggtggaagcaccggacggaacgaggcccaggccctgagcaccgtcttcggtgtcgagaacgacctcaacggtcgggttgccgcgggaatcgagaatctgacgcgcgtaaacgctttcaattactgccacaactactccttataaacgttaggttgtgatgacattgcctagaatagtgcgttttgtggacgtatggcaaacttatccgacacgatttgtgtgaacgctcacacaaatcgtgtcggatgcgtctggaacttcacctgctatttctttggcgttggcttccagtcaaggtcatccagcaattggttcgtccaaccaacgatttcatcagagctcattggaccagatcccagcgaacctgcgaacggcgcgggaatcaggtatgttttagtcatcggacggtattgaatgcccttgtagattctggccatgcgcatttgcacggattctcgcggctcgaatttggcgacacgaacgttacggccttgcccgatgatttcggtaatgcccaacttccttgccttgaaccgaagtctcgccacatcgaacagcgcctcgaaatcgaccggaggcttgccgtaacgatccgtaagctcatcacgcaactcgtcaagatcggcttccgtacgagcacccgccaacttgcggtaggcttccaatcgcaatttgtcggaatcgatgtagctgacgggaatggacgcttcgatcggcagatcgatggtgacagcaaccgattccgtacgttccggttccttgtactgctcgacggcctcggacaccatgcgcacatacagatcgaaaccaacaccctcgatatgcccgctctgctcgtcgcccagcagattgccggtgccacgcagctcaagatccttcatcgccacgtcaaaacctgaaccgagcgcagtgttctgcgcgatggtggccagtcggtcatgcgactgctgggtcatcggcttggttggatcatataggaagtacgcgtaggcacgctcacggcctcgcccgacacgaccacgcaactgatgaagctggcttaggccgaaacggtcggcatgatcgacgatcaacgtattcgcattggaaatatcaagaccggtttcgatgatggtggtgcatacgagcacatcaatgtcgcgatgccagaagtctcggatcacaccgtcaagctgcttctcccccatcttgccatgggcgatgccgacatgcgattccggcaccagctcgtgaatcttcgcggcaaccgaagcgatgtcttgcactcggttgtgcacgtagaacacctggccaccgcgcaacagctcacgtctgaccgcagcagtgacctgagcatcctcatacgcgccaacgtaggtaagcaccggcaagcggtcttccggaggcgtggccaacgtggacatttcacgaatgcctgtaacggccatctccagcgttcgcggaatcggtgttgccgacagactcagcacatccacattggtacgcagcgccttcaacgtctctttgtgttcgacgccgaaacgctgctcctcatcgatgatgaccagtcccagatccttgaatttgaccttcggtccgagcagtttgtgcgtaccgatcaccacatcgacggaaccgtcttcaagtccctcgatggtgtcgttgatctccttggtggtttggaaacggctcatcgcccttacttccaccggaaaaccttcaaaacgttcggtgaacgtctcgaaatgctgttgcaccagcaatgtggtcggcaccagcacagccacctgtttggaatcctgcaccgccttgaatgcggcacgtacggcgatttcggttttgccgaatcccacgtcgccgcaaatcaggcgatccatcggcacgggcttttccatatcggatttgacttcgtcgatggtggtcagctgatcagcggtttcttggtacgggaaagcgtcttccagttctttctgccaaggggtgtctttgctgaaggcatacccctgcatacgttgacgtgccgaatacagtttgaccagatcttcggcgatttcgtgcacatgcttacgtgctttcgccttggtggcagcccagtcggatccgcccagtttgttgagttttggagcgtcggcaccgatgtatttgctgacttggtcaagctggtcggtggggatgaacagtttgtcggcaggtgcgccgcgcttgctggatgcgtattcgatgaccagatactcgcgtgtggtctggttggcgcccgctccgatggtacgctggcgcatttcgaggaacctgccgatgccatgctgctcatgcaccacgtaatcgccggctttgagctccataaggtcgatggccttacggcgacgtttcggtgtttttgcctgtcccgcggccgatgtacgtccggtcaggtcgcgttcggtaagcagtgcgactttcgcggcattatcgacgaatccgtcgatggcacgcgatctgatgcagtcgaagttggcgattcccgtttcgttgatggcacgtttgagtcgaacaagagtgccttgcgctcctgcagtgacggtgacggcatagccggcatcaagaagaccttcgataccggaagctgtcttggcctcatctccgcgatattctccaggattggtggcgtcgagctgaacgcggccttccctactggagtccacaccgaaactcgtaagcttccatacgtcatgcctagagaacaccagtgaggaaatcgtttcctcaaaatcgtagaaattcgcctgatcgaatgtgattggagcaccggcaccatgaccggatgcagcaacatgccaactggctgcaaggaattcattagccgttttggcaagatcgtcggcagcgcgacgcaatttttccggatcggacagcatcaccaacgcacgcttgggaagcatgccctgcaccggttccatatcatcgactaatgcgggaagcaacgattccatgccttcgacaggaatggcgttggcaatggattcaagcatgtcttcggcgtttggaatggagccgatcagggatttcgcacgcacgcgcaccttttcggtcagctgcagctcacggcatggcgtggcccagaccatcggaatgtcactgccatacgtacgctggtcggatgcatggaattccttgatggtatcgatttcgtcaccgaagaattcgatacgaaccggatgcggcaatgttggaggaaacacgtcgataatgccgcctcgcactgcgaattcaccacgatccatcaccaagtcgactcgagtatacgcattctccaccagtcgatgcgacgcctcatcgagcgccaactcctcaccttgggagaacaccagcggctccacatcccccaagcccgcaaccacaggctgaatcagggaacgcaccggcatgacgagaatcctgatggggccaaacagcttgcttccctcttgagggtgcatcagtctgcggaacaccgccatacggctcgccacggtatcggcgcgaggcgaaagacgttcgtgcggcaaggtttcccacgcttcaagctgtgccacatcgtttggatcgccggaataccacgaacgaatcgcctcaaccatttcctcggcctcgcgcccggaagccaccacaagcacaaccggtcgtgttcccgctgccccggcagcgagcgccggacgcaatccttcgggaacgccaacggtgatgctggggtctatgtcggattccggcacttcgatctcatcggaaatcagcgcacgaaaatcctcatcagtttcgagtacgtcgagaatgccagccagcgaacctgacgtcggcagttgcaccggttcagcggccattgaactgctcctgagccttggcgaggccgttgaagatgatggtttccgccgcgtcggcaccgtcggcaaggaattccggaagctgcttgcgctgatccggaccgaatccgcccagcacccaattcaccgtgttgtcgtgggcgtgggcgccgcgttgcgcatgaccgactcccatgcgcactcgggcatactttggcgttcccaaggcacgatcaattgatttgatgccgttatggccgcctgcggagccgcctgccttgactttgatacgtccgaaatcaagatccatgtcgtcgtgaatcaccacaatatggtctggttcaatctgatagtaggcactgatggaagccaacgcattacctgactcgttcatgtaggtgagcggctttgccaggaagaatttgacgttacggccagacaggttcatcacgcctttgccgagcatggcaagccctttatggtcggaaaagttgaccgaccaacgttcggccaacagatcggccgccataaatcccatattgtgacgggtgccttcgtatttggatcccggattgccaagtcctgcgatcaaccagaaatcagatgccattgaaatcgttccattcattcatacatacgtttgtgcgcgttcatattgcgtcacattgtctcgtcttgataaccgcaaagattgtacttacaggtcgagataccagtaactcatgtcacgcatggtgccggtggaatcggtggcagcagttggcatgaggccaaactgtgtaaaaccgaaccgtttcatcagtgcgatcgaaccggcattgtctgcgaaaataatgccgcatgccttacgcatattacgctttcgacattcttcaaccagtttggtgagtgtgtatgtaccgactcccctgccctgccattgcggatcgatataataggcgagatcggtgacgccgtcgtatcctgcgcgatcgtagaaaacggaaagcgcgctgaatccaatgatccgcctctctccgtcatcatctaccgtttccgtaacgaacaccgcatacggatcatgatgcgattcaacccatgctttgcgctgttcgtatgtgcgtggagttatatcggccgatgatccacctcgtatgactgcagcgttgtaaatgtcggtgattgcttgaatgtcgtcttgcgtcgcgatgcggtaggaatactcgatcatgtttttgagcataccgggcatatgcagaaggcggaagaccggttccccatatggaaccagtctcccgccttatgcaaacagcaatcgtacggaacttgtgcggaaactactgctcgagttcgagcgccttgttcaacgcttcctgaagtttcttctgcgcctcgccataagcggaccaatcgcccttcttcatggccgcgtcggaatccttcattgcctgggaagcgtcgttaagcgcgctcttcagaccgttgctcatcgtgccggagctactaccggtattgccggaactgctgtcattgcccgagtctgttccagatgacgaatccgtgccatcggttccggaagaaccatcggtggaggcatcgccgttggtatcggacgtatcagtcttgccactggtcgagccgtcgacgttttcagcatcgccagcggatgcaccggagttgccgccgaacacctgatcgagcgcttcgtccaacgtgttggcgaatccgacctggtcgccgaaggccaccaacaccttcttcaacagcgggaaactggtggaaccggaagacttgacgtacaccggctgcacgtacaccaatccgccgccgagcggcagtgtaagcagattgcctcgctgcacattggtggaaccggattcaagcaaattaagttccttcgacacgtcggccgacgcattgaagttgttctgtgcctgaccggggcctggcacattggaatccttcggcaactcctgcaatcgaagcgtgccatagttcgcgccgatcttgcctttttcgtggcccgcatcggaatcgacagacaggaatcccgtcaaaatctctcgagttgacgtgcctgcgggaatatacgacgacgtcaacgagaacaccggttcgttggatccaccggtctgcagcgtcaaatagtacggcggctgcagaatgtcgcgttcctgagcctgctgggattcggtcggatcgaccggagtctgccagaaatcctcaccggagaagaactggctggcgctcgacacatggtacttggtcaacagttctcgctgcaccttgaacaggctttccgggtaacgcaggtggctcatcagatcgccggaaatctccgacaactggtggtactggccggggaagatcttctgccatgccttgatcaccggatcggattcgtcccacacgtacaggtccacggaaccgtcatacgcatcgacggtggccttcacggagttgcgaatgtagttggcgttcttcgaagccagctcactcaccgtggccgaagattccgtagtggaatccttggaggcttcgcccagatcggtcatctgcgaatacgggtaggcgtcagacgtggtgtagccatcgacgatccacttgacacgaccatccacgaccgccgggtacacacggccgtcaagcgtcaggtatggcgcgaccttggccacacgctccttcggggaacgatcgtagaggatctgcgattcggagttcacacggttagagaacagaatctggtcggagccgaaacggatggcatacagcagtcgggagaagatattaccgatcttcgggccgccattgccaccgaacgtgttggtggcgccttcggaaccggtcgggtaatcgaactcccaagactgcgtaccttccggagcgcccacgatcgaatattcggaagcgttcggcgagaagtagatacgcggctcgtactgttcggattcggtgagcttgccttgggttggaatacccgcctcaaagaacttcggctggccgtcggccgtcaccttgttgccgtaggcggccaccacaccatagccgtgcgtgtatacggtatggtcgttgacccagttacgattgtcaagaccggcaaggtcaagttctcgtgctgcgatcaccgtatcttggctcacaccgtcgacctcatacttgtcgacggcaagagtatcggcaaacgtgtaatactgcttggattgctgcagctgcttgaatgtcggggaaacgatctgcggatcgagcagtcggatctgcgcggtcgattccgcggaatcagccaacgcaccagcctcgccttccgtagtggcctgatactgttcggtcttcacattgttcagaccgtatgcttcacgggtggcgtcgatattacgctggatataggtagattccatttcctgcgcgttcggattcacacggaaacgctgcagcagcatcggccatgccacggtaagcaccaagctcaccacaatggcggatgcgatggccacggtcggcaccttccacgctttaagcgcttcggaagcacgcaccgcaatcggagcctggccttccaacgcatgcgacttcatgatccacacgccgagaatcacaccgagaatgacggtgatggcagccatgatgaaggtgacgggaatcgtggcgttgaccgtggtatacgtggcaccggtgatgcggctaccctcctgcgtgaggtgggagaacacgccaagcacctgattcgtcgcccatgcgaacatgttgagcatcagccagatgccgatctgtctacgcgcacgcttggtgatgtggaacagtccacgaccatgcactggcatggtgattcggatgccgcccatcatcacatgcgtgacgatggagaagatgatgccggcaagcagcagcaacgacactgccgacatgatcagcttcaagccaggcaatacgaacacatagaaaccattgtcgatgccgaattgcgggtcggtggtgccgaaactctgcgcgttgaacatcagcaggatttcagaccaattcgcattaaactgcgatccgaacatcaagccgacgatcaatgaaatcaccacagccacacgacgtgcactctttgagctcacgcccttgcccacttcgatggtgtcgccgttaatacgaatcgtggaaccatcggcagcatcggggcgagcccagatcgccagcgacgcggacaggaatccgaccgcggcgatcagcagcgcatacgccacccacaggcctaccctggtacccaactgcgtccaaatcacgctttggaagccaagctgcgcataccacatgacgtcggtgatgaactgcgccaagccaaagaacaggccgatgatgatggcaagcgccagcaccacaccgattagaatcttgttgccgttcgacgatttgcgcggacggttcggctggcgtgtgatacgcggaccggacggacctcttggaggcatgttcgccgaagaccgggcggtgttatcaccatcggtttcgacattgagaatgatgggatcatcgttgccggatttattggcacgctgcccttgggagcggttcggaccgctttctgggtcgaacatgggaccaaacatatcaaaaaaagacatactaatagcctatcgacaggcacggaacggctttatgccgctagcctaatgtttacgcaattcacgaacacgaatccacccgttcttttcttatgcgatcgtattcgccatcaccggcatgtgatagataatgacactatgaggagagttcacgttcatttcgctcgttgtgctgccgcactgtgcgccatcgcactgccgctatcgttcgctgggtgttcatccagcgcgagtttgaatgctggctccaaccaatccgagcaatccaattcgcagcagtccgatgcatcacatgatgcgcttgacaaatccaacgtgccaagcgtggtggacgactcgccgcatggcagagccgtggctgcagtcaatgccatgagtcttgcagagcgcgtcggtcagctcgtcatggcacccctgtatgcgggatccgatccttcgacattgcaggatcttatcgtgaaccagcatgtcggatcggtgttgatcatcggcaattggaattcgggaacggctggcgtcgccgcagccacatccgcattgcaatcgtatgcgccggccaataatcagctgttgatgaccactgatcaggaaggtggtttggtgcagcatcttcaaggcgctggtttcgaccagatgccttccgccaccaatcagggttcaatgtcgaccaaccagctacggcaatcggctgccgtatggggttcccaactcaagtcggccggcatcaatgttgatttggcgccggtggtgggcacggtaacggtagatagggcttccaatggcccgatcggcgcactgtatcgtgattttggtcttgatgcggacggcaatgccgaccatgccaaggcgttcattcagggcatggcggattcgggtgtaggcagcgccatcaagcactatcctggtttgggttcggtgacgggcaacaccgatttcaccgccgacggcattcttgataccaccactacgttggacggtgcggaaatcggcgcgttcaacagtacgttggaggcgaacccttccatggtgatgatgtcgcttgccacctatcaggctattgatccgaataatcccgccgtgttctccagcgctttggtaacggattatttgcgcaatacggtcggattccaaggtgtcatcacttcggattctttgtccgccactgcgttgggtggcattcagccgagtgatttgggtgtgcgattggttgaggccggcggtgatcttgcctgcattggcgctttcgattatgttcagcaggttttggatggtttgaacgcaaaagccgcggctgattccgcttttgcagacaaagtaacgcagtccgcgattcgtgtgatgacattgaaatacagcatgggactcgcttcttgattgcgaaatattgattgcggaacatgcaatcgaatatcttcggtataggaataatcgcaagcaagcaacataaatataagaacaacaatccccgtcttccgaaatgaaagacggggattgtttatgtatggccgttagtttcagcaacagcaactggtgttgggatgcttgcgatcgtattcctctcgcatgcgccagtattcgcgttcggtcagcggggtttcgcagggatgttcgcttgcgaaatgctccagatagtggtcgtatttcgcttctccgctgaattcgcgcacataccagacgaatccggccttggctttcaataatgcggaccagattcgtctgaccatggtggtgaatccctgcatcaggctgcggcctgttccttctgcgccagctcatagctcttggccgcgtattcgcgctgcaccttcttttcgagcttggtggcgatcaggctggacggtgcgaaccattcggattccacgaacggctcctcagacgtggtttccacaccgaacttgcccttggcaagaatcttcacggtctggtagatgccgacgaccaggaagattcccatcatgaccatgaagaacacggagagcacgccgtcaaggtacgcattggagagtgcggccttggcgttgaccaacgcttcgccttccaaagtgccaccatcgatcagcgtctgatacttggaagcggtggcgaagtaactgatcggtccgacgatcttctggaagtcggcggtgaaggtcacggccacatcccaaacgagaggaacaacaggaatccacaggtacttcttatagccaagcttggccacgcaaacggtgaccagcatgaagcatgcggcggcaagcagctggttggaaataccgaaaataggcatcatggcgttgataccaccattcgtatcgcacacgccgacccacagcaggccaccccacagggcggttgcgatcagtgtggtgatgatgttgcccggtttccacgtcggatcagcgaacttcttcagcttgcgcacgttgcccagcaactcaccaatctgataacgggccacgcgggtgccgttgtcaacggtggtgaggatgaacaacgcttcgaacatgatggcgaagtggtaccagaaggccatggagtcatgaccgccgaggtaggacttgaggaagttggccatacccatagcgaacgtggtggcgccgccagtgcgggaaacgatggtgttctcgccaatgtcggaagcggcctgcttcaaagcgtcggcgccttcgtaggtcttggcattgccgttctcgtcgacagaatcccaagtgaccttcatctggttgccttcaatgtcggaaaccttcatcgaatccacggccttgaccgcggcctcagcctgctcgtcaggagtggaagtggcggtcagggtcacgccggaagcggtggagatctgcgaggcggacatgttcgtggagaagtagacgccctgggaaatggtgatggctgcaatcagtgcgatcacggcggtgaaggattcaaccagcatggagccgtagccgatcatgcggatctggttttccttctccacagccttcggggtcaggccggagctcactgcgccgtggaagccggaaagagcgccgcacgcgatggtgatgaacaggaacgggaacaggttacctgcgaaggtcggtcccgtggaggtggacgcgaattcagtcagagccggcatctgcacggacggattggcgatgagaatgccaagcacgagcagcacaagcgtgccgatcttcatcagcgtggacaggtagtcacgcggggtgacgagcagccagtgcggcaacgcggcggcggcgaaggagtagatcaccagtgcgataaccagttccttggcgttcaacgtgaacacgtcggcgattgccggaacgctggagatccaaccgccagcgatgatgtcgatcacgagcagcacgaagccgagcaccgtggtttcgataacgctacgatgcaggaaacgctggaagcagcccatgatcaaggcgatcggaatggtcataccaatagagaacacggcccacggcgaggaagccatggccttgatggccacgagcgcaaggaatgccatggcgatggcggtcatcacgatcaggaagatcgacaggatagtgccgccgaacttgcccatttcgtcggttgccatctgaccgaaggaacggccgcgacgcttggcggagatccacagcatgagcatatcctgcacggcgccggcgaaaatcacaccgagaatgatccacatcacggacggcagataacccatttgggcggccagaataggaccaacaagcgggcccgcaccggaaatgccggcgaaatgctggccgaacagcacgcgacggtcggcacgttcgaagttggcgccgtcatgcacgcgctcggccggcgtcgcgttcgcatcgtcggtacgcatgatcttgatctgaatataatacgcgtagaaacggtaagcgatcgcgtaggagcacaatgccacaaccacgaaccagatggcgctgatctgctcgccacgggaaaccgccagaatagcccaaccaatagcgcacacaatggcgatgacggcccacagcagggccttcggccacgtccacaccatcttcggcttcacaccgacagggagccccttcgaattgcggatgacgcgttccgcttcctcaggcgtgtaatcatccttgaactccagtttgccgggcgctggaaccgcggcattggcagtgcttgctgcactagtcatattgttctctctcgttagatataactcttctatacagccagagccgctcaacacagctccttattggctaaagaaaaagagtaggcgcgtcaatcgcatcaacgcatttcttctcacgatatgggatatcagcaataacaactgtggaaaatccctataaaactcacttcagatttgggcaatcctacaaaacagacaatcatgcaaaaacaagctgaagtaatgccatatacacgacgatgccgccggcgatcgagagcagcatgttgcgtttccatacgtgcagcacgacgatcgcggcgatggcgatcgcttcgggaatgccgtggcttccagcaaaaggattgacgtttttcagcgaatacaccaccagcagtccggtcatagcatacggaagcacgttgccaagatagtcgatgatgtgcggcggtttctttggctcgggaaagagcacgaacggcagaaaacgggtgatgatggtgccaagcaccgccatcagtacagtgacgacgccctgccatgtggtcatgatcatgaccgcacctcccctacttcgttacgatccgcagcggattcgaccaccatcagcatcatcacgtttcccaacatcatcaggtttcaaatcatccaaatacggacgcaacataatgaacatcaccagcatggcaatcaacgacgggatcatgaaattgtcagcaccgaacagcgccatgcaaatcaccggcaccacagtgcccgtcaacgccgccatatggcttttgcgtttcgttgtcaactattgatccacgaaaataaccacaaacaatgcggtcatcacgaaatccaaaccggtggtgtcgaacgtcaatcgcccgccgacaatgcctccgagcgtcgctccagccacccaggaaacctgattcagcagcgacacgaagaaatagaaccagccgcggtcaacatccgccggtatttgcgcgccgttgttgaccgcgaacgtctcatcacacatggcgtaaatcaaatacggttttttcgcccccatgttcttgaaacgccccagcatggacagtccgtaaaacaggtgccttgttcccatcatcagcgccaacataagcgtggcgaacggattgaatgcggaaaccagcagattcaccgtaacgaattccatggaaccggtgtagatgaatgcgctcatgcacaacggccacaggaacgaaaacccgcgggttcccataagcactccgtacgacatggccagaaagaagaagctgatgcaaatcggcagcactctggggaacgcggctttgaacgcacgcgtcttcactcccccattccgctggctcatccgcattcctccctgccatacgtggcaagcccgttcgcgaccacaatgccttgtaaccacccaattgtctaatcgttcaattcatggtaccgacagtcatgtttcgcaaacacccgcacgcatatcgacattgcttataacgcgttccatcgctcatccgcttcgcccgccagcgaaacatgggcatgcgtttgacttcaagtacttgaactttctatcttggcaacagaacgttttcaaggagagttatcagtgagtgacatgcacgaggttcgtcaggcgttactgaccggcgaacgcgccgaattccaagcatcaggcaagcgatatatcgacacgattttcgatgatggcgaatcaccgttgaagcatgcgcatgatattgagcttaagtcgagttcgttcaaatggaagtatccgctgtggtattgctcggatattttggcaaaggattgcacatggttcgagatggcacgcgcgggcgtgtggtatacgaataccattcgtgttgaggattgcacgtttgaagcgccgaagaatttccgccggtgccatgatgttgcgttgaggaatgttgatttcgtcaatgccgaggaaacattatgggcttgttcgaacgtttcactggaaaatgtgagcgctcgtggcgattatctggcgatgaattgttccgatattaaagcctataatctgcgtttggttggcaattatccatttgatggcgcacgtaatattgaaatcacaaattctcgattgatttccaaggattgcttctggaattgcgagaatgtgacagtacgtgattcattcatttccggcgagtatttggcttggaattcccgtaatgtcacgtttgagaactgtacgatcgaaagtctgcagggtttgtgctatgtggataatctcgtattacgtaattgccgtctaatcaatacgacgcttgctttcgaatattcgaatgtggatgccgatattcacagcactatcgatagtgtattcaatccttcgtccggcacgattcgtgcggctgtcatcaaggaattgactcttgacccaacgaagattgatccgaacaaggtgacgataattaccgaaaacaagtaaacgtcaccgtcgatcaaaaagtatttataatagttgagggtctgcaatttaacttgcagaccctcaattgttttatatcacccaacaatcggtgttgtaatcaaatactgatcacagattgtcggtgtcgatggtgatggtgaccggaccatcgttgatcaggccgacgcgcatgtgcgttccaaagcggccttcgcgtactggcacgccgccagaacgcagcgcctcgttgaatttgatccacgtgatgctggcatgttccggtttacctgctttgacgaagctggggcggttgcctttcctcacgtcggcaaacagcgtaaactgcgaaatggagaggatttcgccgccgatgtctttgatggaacggttcattttgccctgttcgtcttcgaaaacgcgcaggttgaggattttgtgggccagccaagaaagctgttcctcgccatcctcatcactcacgccgaccagcagcatgaagcccggtccgatctgctgcggttcgaaggtggggtcgatggtgcccagttcgttgacaacgtcaacgctggcttgactcactcgttgcactactactttcataaccccaccttaccgcgcgatcagtttcgccttggtatcggccggcttcagtagaacttttcgccgttgagctgctggcccaccaaaaccattcagcagatcgtccctgcctcatgtttgtcagtgtgtgctatgcgttgatgccgcgcgtcgcacagcgaccgaagccagcaaaccgatgagcagcatgcagcctgccaccaaaagtgtccaacggttgccctcaatgaacccggaagtcatcgcatcggcgattttcggcgcttcgtcaccgaattgggccgccgatccatctccgctgcggaacgagccaattacaccgccagccgagctgctgaccgccttggccagtccatcgccgactttagcgggcagtccaagggattcaagtcgtgccggcaacgtcccattgatggccatggtcaatgccgcgcctgagatggccgagcccatggcggtgccaagctgacggacggtggactgggtggccgatccttcaccggactggggaatcggcacttcggacagcaccacgctggtcagctgcgcggaagcgagccctaagccgcagccgtaggcggtcaaaggaagaagctgccaccacactgcgaattccaccggcatgaggactgcaatcacggctaccgcgatgatctcaatcaccaagccaagttggaccacgccgaccggagtgaatttggaggccagcatatgtgcctgactaccggcgataatagagcccaatcccatcacggccagcatcgcaccggcctgtagcgtgtcgagtccgcgcgcgttgatgagatacagcggaagcgcgaacaccagcgcgaactcgccggcggcgatggccgcagccgacagattgccccacgagaatgtcttgatgcggaacagggtcatgtccagcatcaccggtcgcccggctttgcctcgtgcaagttctacggttatgaagacgaccagcaggagcataccggcgaccagacaaatcggcaccggcgacagccagccgtggttccatgtcagaccacccatcttcaactgagtggaagtctgcttccaccagccgtaggtctcgccttcgataagtccgaatacgagcagggcagaagtcagtgcggacagcaccacgcctggaatgtccacatcaatgctttggaatcgaatggtagaagaagcggttgaggaagtgatgttcgaggtatggccaccggtctttggcaccaaaggaatggttgccacaaaaatgatgatgcctagcggaaggttcaccaggaaaatccatcgccaccccaaggtctcggtaagcacgccgccgagcaacggtccgagagcggcggctgaactcattaccgcgccccagactccgaaagccgcagcgcgatacttgccacggaacgtggcggacaccgtggacagggtgttcggcatgatcatcgcgccaccgatgccctgcaacgcgcgagcggtgagcagcatgccagcgtcctgcgatgtggcggcgagcaatgaacttgccacgaaaatcacagttccaatttggaataccagtttgcgtcctttggcgtcgccaagcttgccgaagggaagcagcagcgcggcgagtacgatgttgtacagtgatgtgacccactgggcgtcggtcaggtcgatgccgatatcgtcgataatggtggggatggagacgttgacgattgagctgtccagcacaatcatggccagtcccaaagccaacacccatagcgcgccccatggcggagtttgttccggatgaggtgacgtggacatcgtggaagacgatggcatatcgggctgaagctgatgttggaacttagatggctgttccatgatgccgtttcctctcatagtcataatgcagggtctgtcatgtttgactgccgccatactacacgcatggcgttgcgcgctcactcatccaaacgattcagccttgatgtttagccatgggagtaatccatgacaggcagagacttaggtgacgtgcccgtcacggaaccaacggaacccggctatcgggattccatagtcccggttcttgcatcacaatctggaggcggcacctttgtcgataagccacagcagttcctcaccatcggcataagagcttggcgcatgcggattgttgcgttgcgcgaatgctgcagcaaccgcatccgccttgcgtacttcagatgtgaacacccacgtgtgcttcgatcgtgcgatcatcggcacggtcagcgtcaggcgcagtggcggcggcttcggtgaatcgcgcacaccggcgacaagcacatgcggatcgtcgatctccgactcgccatggtcggggaacagggatgcgaaatgcgcgtccggtcccataccgaacatggcgatgtccaaagctggattctcacccaactgttcaatgagttcacgctggtattgcgcggcggcttcagccagcaccgcatcagtctgttcgggtgaggctgccgcgacgccttccaagttacgctcatcggacggcatcgcatgaatgttgcctgccggcatacggccgtcggcaaccagtttgccataccatgcctcacgcgcctgcttggcgttgcgatcgtcgtcatcggcggccacgaatcgttcgtcgccccaccatacgtgcacgcggctccagtccacggcatcgttcaatgggctcgcgttcatggcgtcgaacactcgattgccgtcggttccaccggtcacggcaatgtcaacgcgggtgcgattcggttccgacagaagatcggtgatggtcaacagcgtacgtgcggccacggcttcagccagaatctgaggattgggatatacaacggtggtgcgttctgccatatgcttttcctgcattgttcctttattgtttcggagaatcgattcagtgcttcgaattgataagatcccagccttgagtcacgacttccgcatagatctcgtccggatagagtcgacccaattcctcactcaagcattcctcgatggttcgtgcgggaacgctcatggtttgcggggactgccctggaacgttcaatacggcgatgccatcgtcggtggatgggcgttccaaactcagcacgccatcggaacgggtcagatacacgccggtcacggcggttgcattcggatcgtcttccaccacaacaggcacgttcagacgaagacgaagccatgcggccagcagattcaacggcaggaagttctttggtccggtcacacgcacgccgcttactggaagatgcggcggctggtcaagcatcgaagcgagcattgcgcgccaaacagtcaagcgagtccacgacatgtccacattcttcgacgaccagttgcggcgcagatcatccatggtccgcatcggattcgaggaatgcatggcatcggtgatacggctgcgcgccatggaacccagcaaatcgttcgataggttcgcgggggcttcgtttggccaccaagccaccaccggagcgtccggcaccaatagcggaatcaccaatgtatcagggtggtgaaccagcccaccaatcggacgcaacacgatgatttcgcccgcgccagcgtcggaaccgaatcgcacttccgcgtcgagaaaggtgtgcggcttgccatcatcggcagcggcatccaccctacgtgaattcggcgcgattgcgatcacacggcagggatgctcacggctggcgttgttcgccacggcgagatcatgctccagcgacgtctcattcgtggagatcagcagtgtgagcacgcgacccagagccgcttcgccacgctcctcgtgcaattcatcgattttcgccgaaatctcacgggtttcggtgttcttcatggtaatgatcacggcatcctccaacggtgtccatcgcgggccagcatttcaacggcttcctgagggccccacgttccggaacgatacggttgcggctggccaagcgtggaccagaactcttcgatcggatcgaggatctgccagctcaattccacttcgcgtgtggttgggaacagtggcggatcgcccagcaatacgtcaagaatcagacgttcataggcttccggagacgattcggtgaacgaacggccgtaaccgaagtccatcgacacgtcacggacctccatcgacgtgccacccggcaccttcgcgccgaaccgcatggtcacaccctcatcgggctgcacgcggatcacgatcgcattcttgccgagctccttcgttgcggtcgactcgaacggcagatgcggggcacgcttgaacaccacggcaatctccgtgacacgcttgcccaaacgtttgcccgtacgcaggtagaacggcacgccggcccaacggcgcgtatcgacatccagtcggatcgctgcgtaagtctctgtggttgaagccggattaatgcccttctcatccaaatagccgacaacctcatgagaaccctgccatccggcggcatactgtccgcgggccgtatgcgccgccagatccttcggcaagcgcactgcggacagcaccttcgtcttttcagccgtcagatcagcggcggagaaggagaccggctcctccatggccgtcaatgccatgagctgcagcaggtggttctggatgatgtcgcgtgcggcaccgatgccgtcatagtatccggcacgaccggccacgccgatatcctcggcgtgggtaatctgcacatggtcgacgtaattattgttccaaatcggctcatacatggcgttcgcgaaacgaagcgccagaatattctgcaccgtctccttaccgagataatgatcgatacggaacacactcgatgggtcgaacacctcggaaaccacacgatccagctccttagcgctggccagatcatgcccgaacggtttctcgatgatcacacgacgccaagcaccttccgacgatttcgccagaccgcaatcggccaactgtcgggaaacctgcgggaacgcgcgcggcggcaccgacatgtagaacgcatggttgcctcgtgtgccacgatcacggtcaagctcggcaacagtgttcgacaatcgttcgaacgccttcggatcatcgaacgtgccctgcacaaaacgaatgccgtcggcgagctgcgtccaggtcgcctccttaaatggcgtgcggcagtgcgcctgcacgttctccttcacgaaatccttgaaatgatcctcggtccaatcacgacgtgcaaaacccgtcaaaccgaagcttggcggcaataggccacgattagccagatcataaatggcgggaagcagcttcttgcgtgacagatcgccggtcacgccgaaaatcacaatactgcacgggcctgcaatacgtggaagtcgaagatcgcgcggatcgcgcagcggattcgtccactcttcaggcgtgccaagtacggatgaaacagtttcagtcatgtgcttcatagtatcgccaacacgtcacggacggcagtgaccatccgaaaacgtcctttccatattttgtgaaaacccacaaaaccagccgttttttagcggctgtgagcaatatcacaatcgatgatcaatgtattactctgccgaaaaatcatgcaacccggcgaacagacgattgaatccttcttgcatggtgcttcgcgggcaagccacgttgatgcgaatgaaatcatgcccgttgccgccatactcggcaccttcggagaacatcacctgatgattgcgcttgagatgttcgcacaacagagcggtatcgtgcgtcagtttcgaacaatcgacccacaacaagtaggtggcatggctttcaatcagggcgatgcgtcgttccggtgccgcggcagcattgtattcgttgatcatggctcgtgcttcggctttgttgcctgtcaagtatgcgcgcaattcctcaagccaaggctcgctctcgttgaaggcagcgagcgtggccgtcatggcgaaggcgttcggttcggccacttcgtccgtgttgagcgcacgccataccttatgcctcagcacgggatttggaatcattacggcagccgtgttaagaccggcgatattgaacgttttggtcggtgccatgcaggtcacggagttcattgcgcactgctcattcaccgaggcaaagggcacgtaatcatatcccggatcggtaagatcacaatgaatttcgtcgctgattacggtcacatgatggttccagcaaagctcacctatgcgtgcgagggtgtcgcgatcccagattcggcctacgggattgtgtggattgcacaggatcatcagcgtggtttgcggatcggccaacttggattccagatcggcccagttgatggagtaatgtccggaaccgtcgtattccaacggtgattcaagcacgcggcatccattattgataatcgaattgaagaaaatgttgtagaccggagtttggataagcacgttttcgtttgctgtggtgagttttcgtaccatgctggagattgccggcaccacgccggtgctgaatacgagcgattccgggtcgatatcaagattatgcctacggtgccaccagtcaacgtatgcctgattccatgcaggagggacgatggaatatccgaaaataccgtggtcaagacgctgttgcagtgcggctcgaatctgtggagcggtttgaaattccatatccgccacccacatgggcaacgcatctcctgcctcttcccacttgagcgaatacgtgccggatcggtctacgggagtgtcgaaatcgtaagtcatgccatcaaacttaagaacttcaagtggacgaagtcaaatgcaagctgtgaatgatcccggtttcacgacatgcattgtaatgactttgtcggtcgggcagccctgttgtatgagttcaaaaacatggcctttcggacattccatactggttctttcacattcatgctgacgcacccattgtgaacgaaccaaaccaaaataactaatgtaaatgatgtattactttccatgcgagaagtgcatgaaaactgtcaatcagccagcccagtcgaaaagttccggaccattgcgttgcaaatggcgttattgcatgcgtattgactaccatgaacatcaatacttaagaaaggtggttttatggcatatgcgttgataacgggggcttcgagtggcattgggcgtgagatggcggcattgtttgcggccgacaggcatgatctcatcattacggcacgcagtcaaggcaaacttgatgacgtgaagcgcacgctggaacatcgctatggcgtgcatgtggagacggttgcgcttgatctaagcgagtctgacgcaccgcaacagttgcatgattacacagtttcgcaaggttttgaagtggatcatctcgtcaataacgccggttttgcggattggacgggttttctcgacgccgactggcatcgccagcatgagatgatgcagctcaacatggccgcgttggttgaacttacgtaccgttatggtcgtgatatgcgcgagcagggtcacggacgcatattgaacatctcttctgttgcttcaatgatggcaggcccatatatggcgatatatttcgcgtcgaaagcgttcgtacgatcgctttcggaagcggtgtcgtacgaattgcgagataccggtgtgagtgtgacctgcgtatgccccgggccgacatccacagggttcgccaaggccgcgaacatgcgtggcatgaatttcttcacgctgaccaaaccggccaccgcctaccagcttgccacctacgcgtatcggaagatgaagcaggggcgcacgcttgcctaccacggctacctcaccaaagccggagccgcagcggaacgactactcccccgcgctctgacgcgacgggtcgccgcaatcatgaatggcggcaacccacgcaaccagcatcgcgaataattcaggaggcaactcaacgagtttcccttgcggctgatcatatttgccgcaacacaaagagccgcacacttttcataaagcgtgaggctcttttcatctgttaatccgctagattcgttgcagaaatacgtctatcaggcttcgatttcctcgcggcccggctcggcccacagcgtgtggaatgcgcccggctgatccacacgctggtaggtgtgagcgccgaaatagtcgcgctgaccctggatcagggcggcgggcaggcgcttggaacgcagtccgtcgaagtacgacagcgaggaagcgaacgccggagtaggcaaaccgttgacggcggcctgagccaccacgttacgccaagacttttcggcggtttcgatggcgttcttgaagtacggagcgaacagcagcgacacgttggcttcacctgattcgaacgcttcggaaatacggttgaggaacttcgcacggatgatgcagccgccacgccagatgcgtgccacggcagccagatcgatatcccagccatattcttcggcagcagtggtaatctcgttgaagccctgggcgtaggcgacgatcttggaagcgtagagtgcctgacgaatgtcttcgatgaaggccttcttctcatcgtcggtgaggttcaggttgccgtcagggccattgaagccctgcttggcggcttcctcacgcagatcagcttcgaaggaaagaccacgggcgaacacggcttcggcgatgccggtgaccggtacggccagagacagtgcggtctgcacggtccacgtgccggtgcccttcatgccagcatggtcgacgatcacgtcaaccagcggcttaccggtcttcttgtcggcctgatgcagcacttcggcggtgatttcgatcagataggagtcgagttcggtcttgttccactcttcgaacacgtcaccgatctcagccggagtcatgccaaggccacgacgcatcagatcgtagctttcagcgatgagctgcatgtcggagtactcaataccgttgtgcaccatcttgacgaagtggccagcaccattgagaccgatatgggtgacgcacggttcgccttcggccttggccgcgatggattcaaaaatcggcttcagagtcttccaggattcttcggagccacccggcatcatggaaggtccaagcagagcgccttcctcaccgccggacacaccgcatccgacgaaatgcagtccgcgagcgctgatttccttctcgcggcgaatggtgtccgggaagtaggcgttgcctgcgtcgacgatgatgtcgcccggctccatcaggtcggcgagcgcgttgatcatggcgtcggtcggctctcccgccttgaccatgatgatggcggtacgcggcttgacgaggctgtccacgaactcttcgagggtttttgccgggaagaattcgccttcgttgccgtgttcgttcatgagcttttcggtacggccgtaagagcggttgaacactgccaccttgttgccgtggtgtgcgaggttacgtgcgaggctaccgcccattgcggcaagaccgactacgccgacgtttgcttcagctgacatgctggccccttccatcaggaaaagtagtactttatgaaccgttctttagtgtagacccgagctaccccagaaccatggaccgtctcaagtctgacatcatgtcaatcacgcggcgcaatcgtacgtacgaaacgcatggcttcggcaggtgtgagcgacggcacgtaggcttgcgccacagcaagcgatatttgcggcagtttggccgcgtcgggatagcagatatacactttctcttcgtcggggtggaatttcagtttgaaacggaacagtgagtggaatccgtatgctggttccatgatgtctgcgaccatttgcagtgcatgacgtaacacttcgctttcctcgtgttcgcctttgttggatcccataccggccagtggcgccgccgataggctcatgaattccgcattgccttcgtcgcgcagtcgttcagccatgcgtgcaatcaggaattccatgatgccgttgacgctgtcggtgcggtgcctcatgaagtcaagcgtccaaccgatgattgtgccgtcgcgataggtgggcagccagctggttacgccaaggactttgccgttgccgtcgaccgcgtagagcaggcgtacccgggagtcgatcagctcgtcgacgccacccaaggtgaatcccatttccggcagggcctttttgccggcccactgtgcggaaatctcacgaatctgcgtttgtacggagaagggtgcctccttgaaagtggtgagcacgtcggtgatgccgtctcgtttggctttgttgatggcggtgcgcacgtcctgccatttcttacctcgggtttgccattcgttgggattgacgatcatttccgtgccgacgtcaagtgagtcccatccggctttggcgagttcggctcgctgtggctcgtgtacgctgtaaaacacgggcgtccaggaatgttgtgtgcagaatgttgcgaaatcagtgagatcttccgtatattcgtttggatctccgaatggtcctgtcaccgtcaatgcgataccgtacgacactcgataggcgattgcggaacgtccggttgcagaaaaccaataatcattgccttcccaagttgccatgaatgacatggattcgccgccaagcggaataatcgcgtcaacacgatggcgcgaagcgtcattcaccatggaacgatcccgcaaacactcccaaacacacagcagagcgataatccaaaacgccggaccgacgcactgatataccagcaaggagatttgcccgacaggtacaaactcaggttcgataccactcagcaatccgatcggcaacaatcgttgcacataatcggcaagcaatgcaatcaattgcgggctttcgttgaaatcctcgggagaggcaagcccatacccgacatacatcaatcccaacaacagaaaagctgacaatgcacctgccacagcacgcaacataatctcacttctagtgcgaatcgtaaaacactgacggaacgcaatgacgataacgataaaaatcaacggcaatgccatagtggaaaacatcgcgtgaaaagcaccgtgacgagccaacgcaggcaacgtatcagcctgcgaatcgccaacatattgcagcggaagcaccacataaaacagcatcgcaagtaccaccgtgcacgcattgaacagcacacttaacacggcggcaatgcggcgtccgcgatacagaccccatgcgatcaacagcagcatcagcgtcggcatcaacgacaccagccagtttccgggcatggtgaatcgcatcatacgatattgcgcgaaacagttggcatgcgaggaaccgttgaggcaatccaacacttgttccgtgtcgaattccgtggaacctgtcagcaagccgaacatggagagcaatccgaatgattgtcttgaggaaacggcaaccagcgaaccgaccgcctgtacgccggcagccataccaatcagcctgcgcatctcatacaaggcaccatgcctatacacatcaccttgactctcggaagccatcaaatagccaagcacatggccaagcaacgccgacgccagcaaacagtaatcgccggcttcaccacgatacaggaacaggatcagcaccacgctatagccgatcacacgaatacgccgacgccacagcatggcggtgaacgcgctggcacacatcagcgtgcccaccacaacaaccagcggccccaaaatcgcaccatcatgcgaaatcgcatgccattgcggacttttgcctgcgaacagcgagcataatcccataccgagcgctatgccgccaagcgtggtgatcagcgacacccatgccgtcttcgcctttccaatcaccgtttcgcataagccgaatgcgatgagtatcagtggaatgtcgatcagcagacgacccaactgaggcaccgacagcagtgaaatcggcgcggtataccagcgcccatgcgcgagcgcgtcaaaactcacgcgcgacaattgcggcggaaattgcgtatgtctaatgccgcatacgagctgcatgccgacattgaacagcgtgatgaacagcacaaaccccaaggtcatgcgatgctcacgaatccagtcggcaagatcggccataagcgcacgaaagccaaataatggtttcactgttgattcctgcgattgcgtcataatacagtacttccgttcgatgattcagattgaaatgcgtttgagattcggatagtcgaccaatttcggcttggcatcgctcagtcccgtgttgtagccgaatacggcaagtccgtaccgcaacgtgtcttgcacggcatgccagtcatgcgcattgtcaagcgattcgactgccgtaacatgcatgcccgcctgttgagcaaccggtgcgatgcgttcgacattgcgcacggactcgcgatcacgctcccctgcgccgataacaagcgtctggttcgaaggtgcatggttgcgaatggcgttgatggggatctgcttctcgtatgcggtgcgatcgccgtggaagaaccggctgatcatactgctttcactgccattggtcggtttgagctcgctgccggtgggaatgatggtaccgaacaaatccggatggttcgcaccgatctgcagcgaacatgtggccccctgtgaaaaacctgcgatcgcccagtcctgcgcttgctgtgccgccggaagattggctttcacccagtcgaccacgtctttcgtcaagtaggtcaacgcattgccgtacaccggcgaatccacgcatagggtgttatgcgaatcgtctcccaactggtcggccgcaataacaatgggtgcgagtccgccatgatgctgcgcgtaatcgtccatcatggtttgaatgccgcccgcggcaaacacgcgacccggagagcccggctggccgctcatcatcagtatgaccggcaacgccggcttgtgtttggctgtggcaagcgctgcaggcggcagatataccagcgcctttcgcgcttcgaaatgcgatgctgtggctggaatatttactttcctgacttcgccatgtgcgggaatattgctgacgctaccgtctgctttttcctgcttccattgcgtgacgctaatcaaatcgctgcgtttcgccattcccgtcaggtcggcttcacgataggtgtcttggccgagcagtgatccgatggtggcatattctccatacgcctgatcgatgccggtggcggcggaaagcaccgcgaataccgtcaatacaacggcgacggcacgcaacactcccctatgcggcaccgcatagcaaatcgcgaatccaatgatcgcgcaaccgcaaccggcccatgcgaccacatgcggccccagctcaacaccgaacaccacaaacacgtccgacagcaaccaggcaatcaccaatccggcaatgcctgcaataatcgcaatcactaccggacacacgactacggcaaacgtgcgtttgccaccgtcacgacttccggcaaccgtctcccatattgcagtacccagcagtatcgccgccagcactgcggttactgaaaacaacgttgccggaaaccagccatccaccaaacttatgttcatcaaccatgcacgcatgctcacttcttgctttcatattcttcatgtccaatgtgccagttgtagtccatgaaacgttggcacgacctcatccttgaggctgattttccttggaatatcgacgaaaaatactgtgagcaagctgaatggatgatgctcttaggcagcgtcttacctttgccgatcatcgatcatgccttgaacgcacgttccaatacccgccatacgcatggaacggaccccacgtcgggatcgccttcgaccaacagcgcattgggaagcatcagtcatgccggatcggtttgatactctgactgcggcacggtttcctccgatcgcgcttccttgcgcatgttccctgtacatgttccttgtacagcagacgcaatattcccatgcaatgtgattccagctaagaagacactacgaaacgcgtccaatgcatccgaccgacagccaagcggtatggtgttgcattatgcagtatgttttttcggcgtcgaatgtttcctgtgtcgtgccagtcgacggtgaacaacgcacgattttcagcggattatccgttgatgtgaagcatggtgagattgtggatttggtcggcccttccggatcgggcaagagtagtctgcttaccgctttcgcacgattgaatccgaatgcgaacggcaattttcagcttgaagggcgccctgccagcgaattcacaccgcagcagtggcgtagtcaggtggcgtatttgccgcagaagccggtattgatcggttcgagtgtggccgaggcgattcgtttaccgttcacattggctatccgtgcgggcgaaggcaagcaagaattcggcaggaaatggtcggccggtaagtctctcaaacccacagatctactgccggatgctcgcattcgagccacgcttgacgccattggctgcgcggatattgatttggggcgtgctccgcatgacttgtctggaggccaggccgcccgtgtgagtttggcgcgcaccttgcttacttcgccgaaagtgctgcttgccgatgaggttgatgccggtttggatgatgagaacgccgataaggtggcatccatcatggctcaggccgcagagcggggcatggcggtgattcgtattcgccatcgcccgccggatgggcgtgccacgcgcattctcacactggccaatggcgtattgcagagtgcgaatgctccgcacaccgcagcaaccaatgattccaatgatttcgcggcacagtccgattcggcgcaaggagtgcaggcatgagtggcaattattattccattgatatttggggtctgcttatcgcattggttatggtcgccgtggccgcaggcatttccgaagcgatgcgcatgggcattggcaagacactgctatggtcggcgtgccgtgcgttgctgcaattgtgcgccatgggtttcattatggagttcgtcatcaagtcgaacaatccatggctggtgctgttgctggtgatgttcatgctgatcgcggccgtgcaaatcaccctgtctcgtgccaaaggtgtgccgaaaggcttggccggtcccgtgtttttgagcttggtcatcaccatgctcattatgatttcgttggtcaccgaattgatcattcgcccgcaaccatggtatgcgccgcaattggtggtaccgttgaccggcatgctgctcggcaataccgtgtccgctttggcggttgggttgagccggttcttcgaaagcatgaaggaacgccgtgacgaagtggatacgctgctggcgttgggcgcgaccgcttgggaggccgcacgcccgtccatcgtctcgtcgattcgtttgggtttgctgccgactaccgcctcgctggcttccagcggcattgtgacggtgcctggcatgatggccggtcagatcatcgccggcggcaatcctatcgacgcggcgaaataccagttcctgattctcgccgccatcgccgcgttaacgcttctggccgacagtctcattatggtgatggcataccgtaagtgcttcactgcagacgatcaatacaatccgatcgcaggctgaacaacttttcatatagccaagcaattaatagacaatcagatttaacagaaaacggcgttcgccaagtgttcatataccatggcggacaccgttttctattgtttaccagctacgcgagctttgattttgcttttcagcgatcaacgcgtgcggaatggcgctttcctgatgttcgcatggcgatggcgtgactgccctgtatgcttgtcgtgacgttcgccacggccgccacgcttgacttccgtatgacggtcatagcgtttcgcatccgaggaacgttcgtcatgcttcttgcctttggaccgacgattatcgtcatactgacgttcggcacgggcttcagacttgcgctgcttcttgcttggcgcaccctgctttttcgcaagctgtccggacttcttctttcccagtttcctgcgattgtcggtattgccgtaatcgccgtcgttcctacgcttgttcgtcgtttcgcgctgctcgttgtcgctgcgctgctgctcatgcaggcgcgcatacttttcacgacgcttgctgttgcgcttttcctcgtgctgttcgcggcgttcctcttgaatttcaggatgttcccaacgatgttcacgcgcttcgaattcacgattgtcacgaccttcgaacttggcggcacggcgttccgcacggttcttcttcggctcgaacttcttcgcgctgtcgttacgctcctcacgctggtcgcgatcgcgacgatccttacgttcggacttaaacggcttaccgcccttgtctttgccgcgatccttgttacgcccgccggaacggtttgatctgccggaacgttcgccgtcggcactccccttgccgttcttcctacggcgcggatttcctgccggctgcgactgctcaagcgtccagccgaacaccggctcggccacttcgcctacgagttccaacacttccggcgaatcaggggtcacatcgatcggttcgaccgtcagtccggcctcacgcatcatgcgacgggtcctgcggcgctggttcggcagaatgatggtcaccacgtcaccggaatggccggctcgcgcggttcgtccggaacgatgcaggaaggatttcggatcttccggcggttcgacctgcaccacgagttccacaccggaaacgtcgatgcctcgcgcggccacatcggtggccaccataacgttcacatcgccggagttgaaggcggccagattgcggtcacgctggttctggctcagattgccgtgcaattcggccgcaggaatgccgttctgcgttaaatccttggcaagcttctgcgtctggaatttggtacgggtgaacagaatgcgacggcccttgccggaagcgagggtgcgcaccagctcgtgacggttgccctgcgtggttttgaacacatggtgggtcatctcgtcaacggtcgccgtcgcggaatcgacgctatgcaccttcggatcagacaggaaggtttccaccacttcgtccacgccatggtcgagcgtggcggagaacagcatgatctgcgcgtcgaacgaaatctggccgagcagtcgcttgactggcgggaggaagcccatatcggccatttcgtcggcctcatcaataaccgctacctcaaccttgtccaaggtgagcgcgccctgttcgatcaaatcctcaagacgacccgggcaggccaccacaatatcggcaccggcctgaaggtcacggatctggcgggcataacgcacaccgccgtacacggtggtggtgttgatgccgtagatctgggcgagcggcatgagcacatcgttgatctggttggcgagctcacgggtcggagcaagcaccagaccacgtggatgcggcacgaaatcgtcggcacgacgttcctcggcatgggcctgcttcacacgattgacctcgtggcggaactggctcatgttctcatactcgccggcatccacttcgcccaagcgagcgaccagcggaatcgaaaatgccagcgtcttgccggatccagtgcgaccacggccaagaatgtctcgcccagccaacgaatcgggaagcgtgtcggcctgaatcgggaaagcggttttcttgtcatcggccgcaagcacgcggaccagcggaccaggaacgccaagttcggcgaacgtcaacggacgttcctcttcctcgcccatcgcttcggaagcggctgcgagggtatcttcatcaaaaacggtatcgggcacaatggcctttcatgtcaaatattacgcacgttgcgcaaacctgataactgtagcctatgcccaatacttttgcttacgttccttcaatccttcatatccgttatattcacgccggattgcggttgatttcgatatcggtgacggtcagattcgctttgttgaccagattgaacagaatcacttcggccagctgatccgcacgcatgaaggtatgctgcttttcttctgaaacgtagtcatggctgtcacggtagaacggggtgtcgatgccacccggatagacacccacgattttcacactggtccccttgtatgcggcctgcaaactcttggtgtagcccttctcgccccacttggtggcacagtacacggattcgttggggttgcctcgcgttgccgcggtagacatgatgttggcgattttgagatcccgctcgccgtccgccttcagggtttccacgctccacagcaccatgcctttcagacctttcaggcacttgtccacatcggccgcctcgtatgcggtcggcactttgaacgaaggctgcccggcattgttgatcagcaaatcgatatgaccgattttcgcgattgcggcaacagagttcttcacgaacgattcgtcggaaatatcgcccacaaaagctctgtattcgtcggcagcaaaagtcttcgacaactccgcctgacgtacgccattgaaatcaataccggcaacgaaccatcccttggcgatcagctgtcgagccagctcatatcccaatccaagcgcggaaccggtgacgatggcgattttctttccgtctgcggtactcatatgatgaactccttcattcaaaaatggacacaaccccttttgcatcatcatacccattcaaccccacatgaagtcaaacgattgacgtaacacattcaacaccgttttcagcgagtccacatatttcgtatccccatgagccatagacccgtacaaccaaatttcagagatgccctatcgatgaagactccgacgtatgctttcatcttgaaacttctcaataatcgtcatatcctcatcgcatctctaatgccttgcacacgcgaaagctacacaggcgtacgcaaaaggcccttccggaacagggaacgtttgggaagggccttcagagcgatgcaaacgattattgcatcacaggatgtcggggtcgttcttgtcgatcgtgccggtggccttgccgatggccttcagaccgtggtaggcgacgagaatcacgatggtgccgatggcgatgccgttgaaggaaatgccattgaaagcgaacgcgaactggccgatggcgatgatcatggtgattgcggcaaccatgatgttcagcggcttgtcgaagttgaccttgttctcaacccaaatacgaataccgaccatgccgatcatgccgtacagcagggtggtcacgccaccgagcacgccagccggaatcgtgttgatgatggcaccgaacttcgggcacaggctcaacagcagtgcgaagccagccgcgcaccagtaggctgcggtggaatacaccttggtggctgccatcacgccgatgttctcaccgtacgtggtggtgccggaaccgccgccgaaaccggcgatggtggtgccaagaccgtcggcgaacagggcggtgccgatctggtcatcgtagtcgcggccggtcatctgggaaacggacttgacgtggccgacgttttcggcgacgagcacgagcaccaccggaacgaacatcggcagaatcgtgaagtcaacctgcggcaggtggaaagtcggcagaccaacccaagcggcatcgccgatggcggagaagtcaacctgaccacgaatgcaagcgtatgcgtaaccgatgatcacaccgatgagaatgttgagtcgaccaagcagacctttgaacagcaccgcaaccagcagcacggcaactaaagtcacgatagcggtgtcgggagcgaccttgaagttgttccacacgctcggagccaagttgaaaccgatgatggccacaatggcaccgttgacaaccggcggcatgatgatgtcgatccacttggcacccgcgaagtgcacgagtacaccgatcagagccagcagcaaaccagtgacgagaatgccgaaggatgcgacggcgatgcccttgttcgccgtggtgacggcggtgatcggggcaatgaagccgaaggacgaacccaagtagctcggcagcacgttcttgttgatcagcaggaacagtgcggtcgacatggccgtaaagaacagggtggtggacgggtcgaaaccagtcagaatcggcaccaggaacgtggcaccgaacatggcgatgacgtgctgcgcaccgatttcggcggtgcgcggccacgtcaggcgctcgtcaggctcaacgacttcgcccggcttcagcgtcttgccgtcaccgtggacctgccacgtgaacagattggacatgcgattgtctccttaactctcttgcgcggcaagcaaaaacgcgccgcgtgtcatagccattgtagtggggcgtggacacgggcgcgtttcgtacgcaagatgggggcatcaatcgtcgatatcggccaatccgatcatgcagtcaacagaccgacacacatcacaggtgacggtcaaccgcatgaacaacgtccaccaaatcgccattcgacagcactggacgcttgaattcacgccaatcttcgaccttcaccacccaacgaccttccgcaccgtcgaacaccggacgggcggtctgttcccaacggaaccgcttatacgtacgcccggtggccggatcgcgacgcgaataatggaagcacgtacaattagtgatcttccattcgtcggacgccgcacggtgcatgaattcctcgtcggacaagtcctccaaagtgagcataagcgccagcatgaggtcgccgtgactgaccatcaccacggattccgcgtccgacttgcggttcagggacgtgagcagattatgcacacggttttcggccacatcggcgatcgattcgcccgccggcggacgccaatacagcggatcagtgttcttgaacatccagttgcgcgcgtaattggttttgaaatcatctttcgtgatggtattgatctcaccccaggagcgttcgcgcagcacgcgtgtctcctcccatttcgccttaggcagggccatcgtggcagccgtctcacgcgtgcgcacgtacggcgagacgaggtaacggtcgaacaacggctgctgtgagaccagccagcggccgatgcagtccgcctgcttgcggccggtggccgtaagcctccacgaacggtcgggcacggtgacgttatcctgcgtatacagcgagttgtcaccctgttcaccggcactgataatcacgtttgcttcggattcgccatgtcgaatcacatacaaatcaaggggcattcccatattcgcttattcctttgctttcatccacatcctgcgcgcgtttctcgttctgccgttcattcggccggcgcgcatcatcattgaatactttcaccgtagtcgattcgaacgtatgccacacgcgaaaccacatcgatttcacgattggcacacccgaagttcgcgatgtcgttacgtccggttcaccgcatcgcccgcgacacgccgaggcgctactactccggccaaatgccgttctgcgaatacttggcgcggtactcccccggtgtcatgccgctatgttttttgaacactttcgaaaagtggctttgcgaccggtatgcgaggatctgtgcgatctcattgaagctgtattccgaatatttcagcatgttttcggcggcttccatacgtttgtcggtaatgtattgcgacaatgacgttcccgtttcgcgtgcgaacagttccgacagatacgtgggattcaaatgcacgtgctgtgccagaatcgcgacagtgattttctcatgcagatggtagtggatgtagtccatgcactcgttgacggctttggaatgggtgtcggttttctgcatgtcggccatggcccaagtgaagaaagtcatcatgtcggtgtgcagtcggcgcacgtcttccggggtcttgcaattgtcaagatcttgaatgtacagatcggaggcgttgtatgcgtcttcctcgtccatgccaccttcaatggcgaaacgcgtggccaaggtaatggtggtgacgaaacggtatttcgcgtttttcagaggatcgtccgacagatggccgtatagtccggaatcccacagtttcgcgctttccgaaatggcattgatgtcgccggagcgcatcatgtcatactgtttcatttcctcaacgtagcgatggtggcgtacccgatcctcacgcgaaagaaagtccagatacctcagtttcgcctcatcgacaaccgccattgctcccctgccattttgtaactaccttctttcaaggatatctccattgctcacaaaaccgatctgttttgcctagaagtaggtgctccagccgagtttgacggcgaggatgatgccggtgagcacggcggcggcacgcatgatgttttcgggaatatgccgggttacgggaggtgcgatggcactgccgatgatacatccgatgcacattatgatggcgaacggccaatacacggatccacgaatgatgaacatgatcgcagcggaaatattcgcgccgaacccgaccaccgttttcaacgcattaatctgatggaacggaccgatcttacccaagtcgagaatcgccaaggcaagcgtgcctgctgcggcaccgaaatagccggaatagacgccgacgaaactcacgccgacccacagccaccacggatcgttgcgcaacgtgccgcttgcggttttgctggcgatccgcgcggctcgttcgccttgatgcgattgcggcagcgcctgcgccacggcgtcgcgcgcggccgccttcttccgtggattgagtgcgatgatgatcgcgctgaacaggatcagcggcggcaccgcgcattcgaacacttctgccggcagttccagcagcaacagcccgccgatgatgccaccgaccaatccgatgcaggcgtagacggccacgcgcacgccttggcctctaagctccctgcgggcggaaagcagtccgccgatgcccgtaccgcacacgcccaccgtgttcgtggtgttggacagcacaggcggaatgccgaacgccagcaacgccggataggatatcagcgaggatgcgccgaccgcgtatccaacgaatcccgccccgatgccggctgcgagcaccagcagcaatgtggtgatggacactcccgcgatcatgaccgtttctcccgatttcccgactgatatgacaacgggagccaagcgtaatggcttgactcccgaaaatatcggttttgttcagaacgtggctgactgccgcgtttgaactatcgttgttcagtgattgcgcttggcaatcagcgactcggtccagtaggcggcgagcgggatcagcgcccactgcaaagcaagaccgggcagtccagcggccaagtcactcgtccaagtggcggcgatgctgttgccggaaccgaatgcgaacaccgccactgcagtggctacggtcagtacgacacggccggcaagttgggcgataaccacctttactaggcttggcagcttgatctcacgcagcagacctgcaaccaaaccgtacgcgcacaattcaatcatcatgaacggcagaacagccagcatcggcatgccggaaagcaggaagctagccagtggagcagctgcgcctgcaatcgcaccaaccgctggacctgcgatcaaaccgacgaaaataatcggcaagtgcataggcagaaaggcaacgcccaacgcagttcctcgtccggaaaccgctccgatcacatggaacaactgcggcaacgccactgcggcgacaatggcaagcacggttgcggcggctttgacgctcacgctcaagcgtggcagatcagtgcgacgcaaggaaactgctgtagtggaagtcatgttcattctcctttttaaaagctttcttttcacaagctttcgttcattatgaaaaattcgttatgtatgattcgttattcgtttgatttggcagtatctacaaccatgttggcaattgcgcgtgttccagtttgctcgaaataccgattctccaaaggaatccactcgtcgatgaatcgctgcagcatacgcggattacgtgcctcgagtctgcgtaactgctcattggaatcaatcatcaggcagatcatcaaatcgtagtattcacgcaatgcgggatgcatgctataactgccttcgacaatcgtcaaacgagcaggttcgacactatgcgaagccgcaaaatcgccggtatggcaatcccaaggacgatactgcacgatatttccggcaacgagcggagccagcacctcttcttcgaatcgttcccgatcgacattgcctcccggttcggcgaaccgttccggagtgcgttgttccgggcgcaggaaaaaatcgtccatatgcagcacattgccgtcgaaacgacgctgcagcaaagccgccaacgtggttttgcccgacgcgcatggcccgtcgatcgccacaaacacatgctcgcgttccgtaaacacacgttcgatgcgttcgatcacggcccgcgcgtcttgaaccgcctgcgcctcctccacgttttccatggattccttagattccttggattccatcatcgccgactccgtgcacactactcgagcacggtcaaacggtatgcacgcgaaccaagcccaagcccttcggcgtattcgagcgtgtgctcgccatgcctggtggcgatacgctcggtcacggacgcgccgtccggcgccacatgaatcagatcgacacacgcttggtcaagtgccaccgggtcgaacgacgaaagcacgccaatgtcatgcatgtccggctcggacggcgtggcgaagcagtcgcaatccaccgacaaacggttcatgacgttcaaatacatcatcttgccgttcatgtggctgatcacagcctcatccgcttcggccatcgactcgagaaagtcatcctgctcagcttcgacccacttgtctttagccacgcctgcggaatgaatccaacgtttgccgttcgacgatgcgatgccgatggacacgttcttcaacgcgcctccgaaaccgcccattggatgccctttgaaatgcgaaagcacgaagatggaatcatagtcgtcgatatgcctgccgacgatgtcataggcgatatggcggtgcttggctaccggaatctcgatctcgccgcccatgtccatgatctggatcggagcgatgtcgtcgtatccacgttccttgaacacggcaaggcttttttcgggagtctctcgattgccgtcgtatgccgttgcgcattcgacgagcgtgccgccgatctcctgcacgagatccttgacgagcgccggattgaggttattggatttctccgattcgccggaatggattttaatggccacgttgccttgaggcttgcgtccgagcgcatgataggctctgatcaggctttccggcgtgatcacagatgtgaagaacacttcgggcgcggaggcatcatcagtgcgatgatccaattcgtccagcttccttgcttcgaaatcagccatgaattctccttattctgtttgattttgcttccagagccagattaccaacttcaagtcggcttgaagcaaaccgacgcagcgcaacggccgcatgccacaccgatagtcatatatcgaaacagtccacgcatcaaccatgccaatcgggttcactggtgcggtgtttcgcatggcacctatgaaggaaggacgtgtatccatggccgagctcatcacaatggcgttgttctgtggtgcgttgatcgcctgcattatcgccggcatttccattattccggcgttgttggccggcgtggtgatcttcctagctcatgggcgtcttaccgggcatacgttcaccgccatgatttccaaaggtttcgcgaccatgcgtgccgccagcatcgtggtagtaacgttcgttctgatcggcctgctgaccaccctgtggcgcgccgcaggcactgtgtcgttcattgtgacgaatacggcaggtctggtgcatcctcatgtggtggtcctactcacgttcctactcaactgtctgatgtctctgctgaccggatcatcgttcgcttcggccgcgacgatgggtgtgatcacgatgacgttgggcacttccatgcaggttccaccggtgttcctcggtggagcgatactgtccggcatctatttcggcgaccgctgctcccccgtatccaccagcgcccaattggtcaaaacgctgacgcgcacgaacattttcgacaatatccgactgatgttgaaaaccgccgcggtaccgttcgtgctgacgtgcgcagtgtatgcggcattggcgctgtgcacgcatccttccaacagctccattgacattgccggactgttttccaacgcgttcgatcttgattgggtcaccgtcctgcccgcagtggtgttggtcgcgctggcgatcgccagggttgacgtgcgcatcaccatgaccgccagcatactgactgcattgccgatttgcgttgcagtacaacatatggattggaccgcgattggccacgcactggtattcggattccactgtgctgacgcgcgcgtcgcaccgctgatcgatggtggcggaatcgtttcaatggtcaaagtgatgctgatcgtatgcatttcatcgtcatattccggcattttccaagagacggaactgctggatggcgcgcatcggatggtcgcatcgcttgcccggcatatcagcgtattcggcgccacgctggtaacgtctctcgtggcgagtgccgtcgcctgcaatcaaacgttgtcgatcatgctgacaaatcaactatgcgaccatctggagtccgacgagcatcgcaaggccatcaatctggaggataccgccgtagtggtggctccgctgattccatggtccatcgccggagcggtgccgctcgcttcggtgggagcgcccacgtccagtctgacattggcagtgttcctgtacctgctgccgatcgtgcattggatttcagtatcgttggcacgccgctgaagtcatcgctttccgcaccataccgatgtccgaaccggccggaacacttgagacacgtgattgatttttgcaaaacatggtgggctcgcatagccaccaaggaaatggttttcgtcggcatcgtcactttggccgcctcaatagtggcttcgtggcttaaacagtttccgggattcagtctgttcggcgcgctgatcatcgcattgctcatcggcatggcggcccagtttccgattcgcaaatggtattccagccgttccgtggaacacaggtccggcgtgaaggacgcagcaggacttatttccaataaactgttgcgtctgggaatcattctgctcggattcaagctcaatctgaccgtattgttcacccaaggcatcaagtgtctgcccatcgcggccgtggtcgtgacactcaccatcgtggtgtgctacgtcatcgcccgcaaatttggcgtcgacccgcaactcgccattctggtggcgggcggcaccggcatttgcggtgcggccgccgtcatgggattgtctggctccatcaaagtaccgccggaaaaagaggatgaaaaagccaacaacgaagtgatggccgtggccatcatcgccatcatgggcaccatcttcgcgttactggaaatcacccttggaccattgaccggtttgagtaagacacagctgggcattaccgccggagcttccttgcacgaaatcgcccatgccgtggcggccggagacgcgttcggcgcggtggacatcgcaaccatcatgaaactgtcgcgagtgctgatgctggtgttcgcagccatcgtcatcgccgtttggtgggataaaaaccattccgaaatgccagcggacggtaaacgcaaagtgtcgttcccatggttcatgctcggtttcatcggcgcttccatcatcggcacgttcgtgccgttcatcggtgccatcgcaccgaatctggtcgatttcgcgtacatcgtgctcggcatggccatggctgcgcttggcatcaacgtgaatttcagcgccatcgccaagaagggacagaaggcgttcctcgccagtttcatcacgtctgtgctgcttatgtgctttgcggccggagtctcagcgctgttcttctaatcggtcttgcgagcccgatcgcctaggatatggacgggcgaccgggctcgcaaacgcgatgtttcccgacggcccacaccccgatttcgccattcgcatcccctcttacgcttccatccgtcatggcgtcatattctctgatgtcataatcgtcgacgtttttccgggaaaccttagacgcgcgtatggaagcaacacgagggagaatcgtcattgcgctttggacgcctgtctgtccacccaattctcggccacatcgatggcctcatcgagcgtgactttggctgccttgtagtacttggaatccttgatattgctgttttcaatgagtttttgaccggaatccacagctttggacaatgcggacagcagtttacggccagtcaacgtcagtgtttcgtccttgccaagcttgttgaccaatttgtccgccttgtcgagcgactgctgcagtttcttcttcgattcatccaacgattccgtggcggaagaaccgttcgaaggaacgtcgagcaattgccccgatgacgtattggactgagtattggaggatggtccgttcgttgtcgtgccatccgaatcgttccgcgaatcctgcagcgcattcgtgccgttcttctcccggatgtccttcaggctgttattcagggaatccgtggcgctgtctagtgttttggcgacgagattgagctgcgtgatggtggcgtccgccttacagccttccgtatcgaccgtgttctctgcgctggtggccgcgtccgcgaacgcgtcgatgatgtcgttcacgccgagcgcaccacggatcaatttctgcagctcgctaccgttttcggatgtgtcgagcacggccttacgggccgagctgaattccgcaagcgattgccggcatgtgtccaacgcctcctgccgtttgttgtggtagacgtacactcctgcgccgcatgccacagtgagcgccacgaccacggaaaggacaatcggccaggttttgcggggattggaaggctgttcaacggcctgatactgataatccatatgcgtccaccccttgcgaatcgacggatgtcatcgttcttcgtcttgttaacctcacctattttacgagtccgaagatgggaaaaacctgaatggacatcccacgcacgccgacgcgcgtatgcgtgcacgactccagcaacgagccgtacccgccgttagatggcaggcttcagtatcgtgacgccatgcgttagcgtcaccatgcaacgataggaacacactattcaatagtgcatcatgaaggcgtgacgttgccgttgtagatgactttgttttagcttgtcgctagagcgaagtcatctgcatggcctcgttgccaaggccagctccaagcctcacgtgactctcgccgccgcttggttcgcgtttcgccggatgccgcgttgcccgacgcgatgcgttggcccgtcttccgcttcctccacgcgcgtttaacgtctccggggcactcccggcgacttggatgttgatggccgcgttcacatcacggtcaatggcaagcccgcactcctcgcaatggtaaacgcgctcggacaaggacagtttggttttcaccatcccacagtttgagcaggtcttcgagcttggataccagcggtcgatgacatggagtcttgcgccggtgcgtgcggccttataagttagttgacggcaaaattcatagaacgaggcgtcctgaaccgattgggcgagcctgtggtttcccaccatgcccgccacgttcaagtcctcgatgctgatgtccgcgtaggtatgggagagcatggtggtggtcttgccgagcgcgtccgaacgcaggttcgccacccgtgcgtatagtcgggcgacctgcgctctcgccttgcggcggcggttggagcccttctgcttgcggctcagattccgttgggcttgcttcagccgcctgaggttcgatttgagtgcgtgcgggttgtgtatcacggtgccgtccgacaatgtggcgagttccttcacgcccaagtcgatgccgacgctcccgcctttcggcggcgatggaatcggcaggtcggcgcgttcgacggtcaggctggcctgccagcgtccaccacgcttggatacgctcatgcgcagcaccttcgcgccgttcactcgcttggacacgttctccatgcagtgcacgcggcctatcttcgggagccgcagcgcatgagggccacagtcaatgagaccaaacgaacccgtcgtgtacgcgaatctgggaaccgccttgtccttggatttgaagcgcgggaagcccatcctgcggcctttccgctgccctttgcgggacttggagaagttcttcagggcgtcggccaatgattcgagaccgctgttgtatgcctccttgctgttctccggccaccatgtttctcccgtggtctcgtccacggcaagtgtgttcttggcttggttccaccacctgcgcagggcgtagtacgaccattcgggtttatcgccgcgttcgagcatgtccttgacatgagcgagtcccgcgttgtaggcgaaccgcgccgcaccagcatgggactccaagagtcgttcctgccgtggcgtcgggtcaagcgccaccttgaccgcttcaagcatcgcgtgccgccttcaacgccgcgtccgtcttgcgcttggctgcgcgacgcccgtacagccgggcgcagaacgaggtcagcacctcggtcacgtcgcgcaccagatcgtcgtccagctccgtgtcgtccaccacgatgattcggcgtccctgcgctttcaacgcgctctccaccagccccgcgttcatgcgggcgagcctgtccccgtgctccacgatcagcgtgcccacggtcgggtcggacaatagccggttgagcttgcgccgcttgtcgttcatgccggaacccgtctccgtgaccacctcgggcttctcgacgcccatgctaagagcgaacgccttcaaccggtcggcttgacgttgcaggtcgttcttttggtcgccgctggatactcgcgcatagcagacggtgcggggttccatgcttttcgatcgcggcatgatctcgtatttcgggtcgtggatgagccacatgccggtcggcgtctgttccacaggaacgggcatggtgccctgacggcaccatttccacacggtctgcggatgcaatccttccagtctggcccattcctttaccaacatgagatttattataacataggattacttaagaaaacaaacagttcggtaacgggcaacaacccttgcgcaggtgccgtaagactccgcggacaaagcaatgaggcttcccccgcgagaagggaagcctcatatttcattcattctattcagcgatgatgacgccgaatcaccgatcatcctttgggaacagcgcgtcgaaggcatgttccatcacggacttacggcggatcacaccgacgagtctgccatcaccatccaccaccggcagtttcttgaactgcttcttggcgaggattcgggccacctctccaacatgctggtcgggcgtggcggcaacgaccttacgcgtggcgatgtccatcaccttcttgccggagagcgcctgcaccttggaggccacggtttcgtcgtcgaacaccaccatcgtcgaaccggtgccggtgggaaccgtacgggattcataggtggcaatcgatttcaggacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgatcccgccgatggactgttcccgggcctgcttgaacagggaggcggcgggggccacgtatgcgccggcgtagtgatgctcggcgggctggccttcagtggtttcgaccgcgacctcggcggaagcttgcgcctcgtaggccttggcgttacgtgcggccttctccttggcacggctggcgacggtgaagatgcagatgatcagggcgaccagcgagatggcagcgcacagcaggtaggagaacgcgatgccgctggccgtggcggacttcacaccctgggacatgtgtgaggcggtcacggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgtaaggccgccgatacccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatatgaatgcgacgaaggccacaagaccaacaacgattgaggtaatgacgaccggactggcccatcccatcgtggaagcggacgagaagccatagagcaggccaccgaacgcaatggtcgaaaggatcacggacaggatgttgagctttgggttcttcaactcgccgacgttcttgagcatcatcgtgcctccgacaaggatgaccagtgtcacgactgcgatgccaacgaacattgggcgccatccgaaactgtcaatcaccagaccaccgataaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcctacgatgatgaatcgggtgtgcggatcaataggctttgcggaactggcggcggacccgaattccgcggttttctgtgaggtcacagcatttccttctgttggtaacggcatgtgtgggcgatccggccccatacttgtgtcaagacgcggggacactgatgagtccgggataaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccatttgtggattggcaaacagaacattgccgacgaacgacccacggcaggcgcgtgcgatgaacatcgcgtagcgatacaggttcatggcatctccttgatgggttttcgtacggcaggtatcgagaagcctatcatcattcaaatcgacggtgaaacccacgcatgctcaacaatacacaaaatcttcacaagaggattgggcttaccgcatacgctccgcctgaataacggtccggggatgaatcagaggcgagctaagggttgcgtctcgtgtttccgtcatgatgtctggcaaaatagtgaagctgaacatgcgaggcatcgaccggaatcggaaagggactaatcatgcgagttctcggcaatatcctgtggatcattcttggtggattggccatcgcaatcggatgggcagtggtggaactgattctgtgcatctccatcatcggcattccgctcggcattcaagcgttcaagatggccaagcttgcgctctggccgttcggcgcggaaatcgtcaacctgtagattccaaatactacaaagccgccaaagcaacccttgacgaggcgatcaccgacgtcaacaattggattgaccagcaagccgccaaggccgaataataaaacacacattatgttgctgcagcagccaatccttgcagaacaatgtcatgacaaaggcctgagaagacgacttctcaggccttatccgtgccgcttctcagtcgcttgtagcgacagctcccctcaaaagaggggagccagagaaacacttacttcgagacgttgaatttaaattcgacgatatcgccgtcctgcatcacgtagtcacggccttcctgacgcagcttgccttcctccttgatcttgaccatggagccttcggcagccacgaaatcgtcgtaggagacgatgtcggccttgatgaagcctttttcgaagtccgtgtgaatcacaccggcagcctgcggggcggtatagcccttgtggatctgccatgcacgcacttccttctcacctgcggtaaggaaggtggaaaggccgagcgtatcgtagccgactcgcgccaactgatccaggccggactcctcaagaccggcgtcggcgagcatttcacgcgcgtcggcctcatcgagttcggtcagatcggcttcgaactgcgcgttgaggaagatggcgggggccggagccacggatgcggcgagcttggcctgcatgtctttattctgcagttcggcatcgtccacgttgaacacgtagatgaacggcttggcgctcatcaagtgcagatcgtagacggaatccttgtcgaaacgaccttcgcgagtcgccttatcaatggtttcgccagcttcaagaatggtcttcgcctgcttgacggcttccatgtaagccggttcgatcttcttgccgcgcagatccttctccagcttcggcagcgcgttctcgatggtctgcagatcggcgaggatcagctcggtgttgatggtttcaatgtcgtcggacggatcgaccttgccgttgacgtgcacgatatcatcgtcttcgaaggcacgcacgacctcgcagatcgcgtcggcttcgcgaatattggcgaggaacttgttgcccagaccttcaccttccgaagcgcccttgacaatgcctgcgatgtcgacgaacgtgacggtggccggcacgatcttctccgtatgcacgagcttggcgagcaccggcagacggtcatccggcaacggcacaatgccggtgttcggttcgatggtggcgaacggatagttttccgccagcacgttgttgcgggtcaatgcgttgaacatggtggacttgccgacgttcggcagtccgacgattccgatagtaagagacatggttccctagcttagtattaggcttcgatggcgtcgactgctttgataacggcaccacggaacgcgctttcctccaacgatgcgacacccctgatggtggtgcctcccggagagcagacagcgtctttcatggcacccggatgcgtttcgttggccaaatagagcgcgcccacgccttccaccattttggcagccagacgatacgcggtagcacgctgcaatccatatttcacaccggcatcgcccaatgcttcgatgtacatgtcggtgaaggccggcgcgcagccggcgatgcacatgccgatgcccatgtgtgcggtgtccacgcgttcaatcaggctgattgacgaaaacaggctttcgaaggtttccgtctgttcctgcgtgagcgtgttgtcgatttccgtgaccagcacgcctttgccgacagccatcggcgtgttcggaatggtgcattggatgtgtgcctgctcgaaagacgttccgaacaggtcgcggaatttgttcagatcccagcctgccgcaatggacacgacgatggtgtttggctgcgccagctggtcagcaatcggtgaaatcaccgcttcaatctgatacggtttgatggcgatgacgaccatgtcagctgcttcggcgacttgcgcggcggtacgcaccgcttttgcgccgagtttggcggcgttgcgttccagcttgtcgtaatgcgcggcacaggccacgatgtcgccgccattgacgacgccagcgttgactaggccttcggcgatcgcctgtgccatattgccgtatccgatgaatccgatggttggattggccatgtttctttcctttgctatcgatactcgtcgttgccgaacaatcgtcagaacaactccgccaaatctccgcggttcaacgcctcggtaaacagatgtctgaacacggtggaaccatgcacgccgtcatgttcaaactcgttggtagtccaataatgtgaacgaccgacgcgagacagcgtgtcgagctgcaatccagaatcgacgtacatgtcgtcaaaatagacggcagcctgaagcggaacctcattacgagccaactggtcggcatcgtagatcgtgccgaaatgcgtgtcttccataagcacgtccatggccggcttgaacggacgcaacgcacgttcctgctcgaacatccacgggaacatggcctcgccggtgaaattaagcggacgaatgccgcccgcgaattccggatgctcgccgcgcacgcgctgggcggcccagcgaatcggcgttttcagctcgccgttggcgtagatgaactcctgcaacggccaatacagcggacgagacgaggtcgcatccatcacagaagacaggaactcgtcagacagttccgccgaggccgaggccgaaccgtcgccgtcaaggaacgcctggtcaagaatccaatgcacgcgttcaaaactcggcttcataccgaaatcggatcccaagcattggaagcgttccaccgtgagcggatcgccgttcggcaatgtgacctcgcgcgattgcagtatgtcggcaaccgctgcggcacgttcgatatcgatcgggtaacgctcgtagaactgcttcgtctttgccgccatgcgcgggaacgtatgacggtacacgtcggtcgcatcggcgggaacgtgaggaatgccgcccgtagtgaagctggcgataactccttgcgggaacagcgaaagatacgtcaacgtcaggaatccgccatagctttgaccaagcgtgacccaacgtgcgcccccgaattcggtgcgacgcagatgctcgaaatcacgaacgatcgaatcagcgaggaaacgcttcaaaaacgcggcaccggccttgccgtcgccgtccatgccctcaatcacatgcgtgtcgacacgagacgaacgccccgtaccacgttgatccggcaataccacgcggaaatgcttgatcgcttcctcgatccagccatcggaacttgggccgagcggacgtggaccggaaccgcctgggccgccctgcaggaacacgagtagcggcaggtcgtcatgcacatgttcgggagcggtgaccacacggtagaacaggctgatcgattcgccatcgaacccatgaccgggctcgtggcccgtccaatccaacggcaccttgatggaacgatcctcaatatgcaatccgggcacgtagtattcgctcagcaacgtcatgcattcacctttcctttggcgtcatcggcatattcaatgcgagtagtggcttcttgatggcttccatcccacccacacgcggagacaaccttacctcacaaaagcggctttatcttaccgccatttcattcctgcgcatgatggcgccacagcgtatctggcgctagggtggagcatatgtcgaatttcaagcagcgtctcttgtcgtggatgcatggtcatgtcttcgcaggcgatctcatcctcacgcttgttataggtgttctgctgttcggcgtgaccggcagcatcacctataatccgggattgctgtttgaccttaatccttccatacagatggcgtgggaagcggcaatgctgatcccgctgctgattcgtcgatggcggccacagaccggagcgttgctctgtgtggcattggccttgacgcatctcatattcggcccttgcatattgggcgccgatattctggcattggtcatgctgtattcggtgatcgtctacggcaatcccaaaaacacgaaagccttcattattttggcgttggccatcggtcttctggcttcggcgttgatggcatggaccatgaccaatgggccgctgctcaccggtggcaaagtgcatacgtggagcagttggaatggctcaaatccaaatggcgcaatggtcacggaagtcactctcggctccatctacacaggaacatccatgtcgggagtcgccgacatggtggcgcaatacatgctggtgctgacgccgattttcgaagtatgtatcatttccaccgtcattgtagcgttctggcagcgtgcccgtctggcaaccgttcgcatgatgcgggaacgcaatgaggcaatcgccgcgcgagaccaggacgaacgcgatatcgccgcgttggcggaacgagcacgcatcgcacgtgacatgcacgatgtggtggcgcacaccctatcaatcatcatcgtgcagtctgatggcggccgctatgcaggcacgcatgatcccgcggtggctagaaacaccatggagacgattcgacacgaatcggaacgcgcactgcatgacatgcaacgtcttctgggagtattcgggggttcaccgcacgccgattataacgatatcggcaatcttgtggaacaagcgcgaaacgtctcccccgacattcgaatccgacggaatatcaccggcaccgccagcccagaacaactcggtgaacaagcctcgatagcttcctaccatgtagtgcaggaggcgctgacgaatatccgcaagtatgcggggccgcacgtcgatgtgcatatcaaagagtcatggaacaacggtttgctcactttgagcgtcaccgacaatggtcgtggcgcggcggccaatatcgacgggcatacgccaggttacggcctgttgggcatgaaggaacgcatcgaatcggccggaggctcattgcaggctggccctcaactcggcggaggcttcgaagttatggccaccctgccttacggcggtaaagagccagcgacagacgaaaccggcgaacagtatgcctcggaacagtccgaatcttgcaacacaactgccatatccagcaaagcgaaattatccgacgaagcaatcgcacctcacacagccgtcaacatatcggcgcgaatcccagatcaaccatcggaacagacgcaggaaaccaacccaccaaccggtcgcgatcatcgttcgaacgccctgcaacacttgcgcattaccgcacccaatctgcatgatttgctcacatcgttgaaactgaaatccgtagaacttgccaatacatccaattcgcgagggctgaattgggtggaacgtgtttccgcgtggacgcagcaccattatgtactcatggattccgttggcgccgtgatattggtcatgctgctgaatcgcatgtcgattacgttcttttttgatagttcacgcgatgcgcagctctctcatgcgatcgccgcatgctgcttgctggcgctggctcttcgacgaaggctccccgagacttgcgcgcttattgtgttcgtattgtcggttgtgcaattggtgtttttggggttgattgaggttggacatatcgtagcgtcgctgtgtgcgctgtattcagccgtattgtatgggcgtgaacacgcatggcgctggaccggtcttgccgctgtcacctgttcagctctgatgggcttgaaaatcgcagccgaccagcacggatacactaccttgttcggcgccatcgccgcttccgcgggcttaacaaaaccggtttcagccacgtcaagtagtagtgcagcgttctttaccggtgccatgtatacggctgcagtgctgatgctgtgcgccggcatcatggcgtgggcacgttgggcgcgttccagcgattcaaacgcactggtattgcaggctcgcgaagaggcactggtggccgagcaggagaagcagcgtattctcgcggcgaatatggaacgtgaccgtatcagtgccagcattcaggctgaagtcaccgccacgttgaacagcgtgatcagccaggccgtcgatggtattcatatgttggacagcgccgaagcacaaggcaaggagcctaccgccgacgagatttccgcagcgttcaaagccattggcgagcaggggcgcgccgcgctcaagcgtatgcgcgaactgcttagcgtgcttcgtgagactggtttcagcgatgacgctcatgccggtagtgcgagcgaactgcagttgaggcccgcggcaccgttggaggagcagctgcagcgcgtgtctcgatagccgattcaagtttttcagggagatttaagggtttgtttcgcgctgtgagcggaacaatgccgataaggtggagagtatgagcgaggaacagaagattcgtgtggtcattgccgatgatcaggaattggtacgtgccggtttcgccatggtgatcggctcccaacctgatatggcggttgcggcgcaggctcgcgatggcgcggaagctgtggcgttggcggaaacgctgcatcctgacgtggtgttgatggacgtgcgcatgcccggcatggatggtatcgaggcgacccggcagatcagtgcgttgcggcatcgcttcgctgccgatggaacgcaatcagaagtcactcataccaaagtgatcattctgacgacattcgacttggatgaatatgttatggctgcgatcactgccggagcttccggttttctgctgaaagatacggaaccggaaacattgctgaattcgattcgcacggtttttcaaggtaatgcgattatcgcaccgtccgccacgaaacgtcttatcgagaaaatgatggaaggcgatttcatggctgcgaacgttggtaggcctgaaaattccgcaactacttctactacggattcaacatataccgatccggaattggatgacctgaccgaccgcgagcgcgaagtgcttattgagatcgcgcatggattgtcgaatcaggagattgccgacaagcttttcatcagcctgccgacggtgaaaacgcatgtggcgcatattctggcgaaaatcaatgcacgtgaccgcgtacaggcggtggtgttcgcttacgaaaaccatttggtctgattggtttgttgttttgcgtatgcatgatacgcaaaaaggactcctaccatgtttgtggtaggagtccttttcgttgtgtttgctatgaagctcaggcttcggcgagcgcctcaacaggaggcgtgctcactgccctgcgtgcggggaatacgctggcgagcagtgctgccacggctgccacggcgagtacgatgccgttaatgccccattcgaacgggaacaccactttgccgtacatgctgaacaccacgtatgcgcccagccagccgaacagtgtgccaagcagtacgcccgagatgccggataccagcgagatgagcagggcttccaccgcgagggagcgtcgcaactggcctcgcgtcatgccgatggcacgcagtgtggcggattctcgggtgcgttcgatcactgacagcgacagcgtgttggctacgccgacaagtgcgatgagcacggccacggcgatcaaccccaccagaagcatcatcatggagtcaatcatgttcgcccatacgatgcgttcggcgatcggtccggtcactgtcgcatcagtgctcttctccaatgcggcctgcatgtcgttgtagatgccgtcgacggaaactcccgacttgtcagtgtctgccttgaccagcaacacatgggtggcggcgtcaaggtcaccattggtgaaatggctttcatccacgaatccgacagctccatattgcgcggatacacgacggtagtcggcttggttggcttgcaatgtcagcgaacgcgtagcgtcgccgttctggttccattcagtggagaaatcagccgtgccattggcgaactgcagctccttgccggtttgcgcattgtatgttggcatgagcacgctatcactgtcgatggaggcgttacccaagttggcacgcatgacctgcttgacctgatcgatgtttttcacgccgaccagcaatgcggacgtaggctgggttccatccgctttctccaaggtcacggaaaccgccggcgcatacaacgtgtcggacacgccgttgatgtcagatacatccttgaccatttgctggctgatgtcatcgcccatggccacgatgtcgacgctataacgggtggcgagcgcaccattcatagtctctttggcgctagcggcaccggttgcgatggtggagaccaaggtgacaccgatgagcagagcggcaccggttgctgcgatgcgtcgcggattcttctgaatgttggcgtgtgcaactgttgcggaaggacctgtcagcgaggccaacgctccaacgcccttcatgagggtcggcatccagaataccgcggtgaccaccatgccgaggaacaccagtgcggcaccggcgatggctatgagcagaatcatcgtgaattgatcgccgctcgcatcctcgccgccgttggtggcctgcacctgccagatggagaatatggccatggcgataccgaccgccaccatcagaataccgattatggctcgcgtaaggctggaacgacggttgtcggtcagttcaatcggacgcaatgcctccaatggcgttaccgcggtggcggaacgtgcggatcccatggatgcaagcaccgtcaccacaatgccgaagagaatcggtacgacggcggcttgccaggagaagttgaaccgcatacccgcctgcatgatgtcgctgacgcacatgccccacatgagcaggcttccaagcaccacgccaagcacggatgcgacgaagccgagcaccaccgcttcgaacagcacggaaccatacagttggcctttctttgcgccgatggtgcgtagcaaggcgagtgtgcggcggcgttgcgccacgagcacttggaacgtgttggcgatcaccagagccgccacgaacatggcaagcacgccgaagcacataaggaatgtggtgacgatgttggtttggttgccgcttaaggatttgatgctttcgtcactgatttgctgtcgtgacatcagatcgaaatgctttggcagcaacgctttcacaccgttgatggtttttgcggatacgctgtttccatccaaggcaaggtcgagatacaccattgttgttccggtggcgttgaaatcgtccactccctgcattgcggcaagcagattgttggatcctacgatcgcaccaccatagtatgagtaggcgccgttcggatcggacgtgagtcctaccacgcgcacgttgtccgccttggctttgccatcgtcgcctaccgcatatcgggaggtcaggcttacagtgtctccaacgccgacgttcaactgtttcgccatgtcttccggcagcgcgacttcgttggaatccttcggctggtccccttccgtgatattcacggggagcatgttcttctgtgccgcggtggaaatgatctcgccgctgacggtgctgtctcccttggaaacgctgacgccggtttccaccgaggcacggacgccgccaaccccttcgatgccggcgatctggtcgagatgaaagtcgccgacagtgctggaatacgcctcgttgagttccttatcgctcaggtcggagctgttgacggtcaccgcatagttggcgtttccgaacatggcggtcagctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggtggattctgttcccttcttcgaatgcttctatagtgcgtttagcgggaatgtctcgcggaagccacattcattgtggcggcctcacgttccttcatcagcagttcactcatctggtctgctgtcggcttgtttacgtccgccacgatctggccgtcggcgaacacgagcgcacggtcggcgtaagacgcggcgaccgcatcatgcgtgaccatgatgatggtttggccaagttcgttgacggaacgtttcaggaagctcagcacttcggcgcttgatacggaatcaagattgccggtgggctcgtctgcgaacaccagtttcggtttggtgatcaatgctcgcgcaatggcaacacgctgctgctggcctcccgatagttcgttcggacgatggttgagacgttccttaaggccaagcgtttccaccagcagacgcaaccactgtcggtcgggtttcgctccagccaaggtcaatggcatgagaatgttctgttcggcggtgaacatcggcagcaggttgaagctttggaagatgaatccgatgtcgcggcggcgcagcaacgtaagctggttgtcgttcatgcgcgtcagatcgtcgccattgaatatgatgtgcccgccggttgcacaatccagtcctgccaacgtgtgcatcaacgtggatttgccggaaccggaaggtcccataatcgccgtgaattttcctttttcaaaagcgacgttgacgccacgcaacgcatgcaccgtgttatttccggaaccgtagtccttcacaagatccacggttgcaatggccgtattggtagctttgatggtgtccctgatatccatgctgtcattcctttctttggattacctccaaaattacggaaaaacagctgattcgaatatcatgcgttggtctgaattatcatctcatccttgagaatgagcaaagacgaggcgcctaataccattgattcatcaatcgtcgagaagtacaccatcctgcggaggttcgagccagtacgactctttttccacgctgacggtggaagcccaccatgtctggtccacgcctggcagcgaacggatggactcatccaccacacgccacaggtcctcgtcatctccggcgatgatttcgatgaggtagtcggcgccattcaaaccgactccgctcattgcatatgtcacctcgtcgattgctaacaactgttcgacgtcgaggcgatacggaggcttcacaccgatgccgagaaacgcttggcggaatccgcctaaacgcatggggcttaccgtggccataatgcgcatcacaccggaatcctccagttttttgacgcgcccacgaatcgcggtgtgcgtcacaccaagatgttcccccagcatggcgtagcttgccctgccgtctttctgcaattcgttgaacgtgtgcacgaatcgcgcgtccaaccgatgcacgggaatatcggtgccgacgctggcctcacgtttggtcatgaatccagtttcgccgcgttcggccagcagacggttgaccacgctgacattatggtcgtcaagcaccaatcgaccgcaggagaacacttgcagacgggtcaatccgggcagtgcgcgcaaatcgtacttcaggaaatggtccataccgtcggctgaatacaccacggcttcggcgatgatgtcggcatcgcccagcgtgcagaccacataggtgacctgaggcatggctttgagcatggcgagcgcctcgttgcgattgccgttgatgcgcagtcccacaagcacctgactgtaattgccgagactcaacggattgcatacgggcacaatggtcatgatgcccgcatcggtgagccgtttgtagctttccgtcgccgcatatacggaaatgccgattttatcggcaagcgcctgcatggtcatgcgtccgttgcattgcagtgccgataccaccttcaaatcacgtgcggtgattgtggtacgcccttcatcctgtgtcattgcaccccctatgacagccatgtcatcaaccacacgctgcctgcggcggcggcgatggcaatcacgagaataatccagtcggcaatgctcatcgtgagattgacccgatatgtgcgtttcacaccgttccgattcaggttgagtccgcgcgattccatggcccagcccacgctttggctcattttgtaggcgcggatcaatacggcgatgatgatcggcagatacgatttgaaccggtctacgagacgtacgaatatgttgcgttttttacctgccgcattgactttgccgctcagatcaagccctcgcgcacgctgcgcttcggacacggattggaagatggaaaagaacacgggaatataccgtaatgcggttgccagggtaagcccggccttgtagggcataccaagcgaggtaaggccacgaaccagtttggtctggctggtggtgaacagcgtgatgaaacatgcaaagccgagcgctggaatgcgcagacccatcaccgccgccatgagcaggttctcctgcgtgagacgcaaccatccccactgccagagcacgtgcgttccactctggtcaaagaccggccaaagcaccacgatgaacacgatgagcacggcgaggatcttccacacccatccaatgcgttcggcgggcacacggtcggtggcgagcatcacatgttcgagaatgaggatgccgaggatgaacgcccagttacgccatacgaggcaaagggccagcatgacgatggagatgaggaatttgacgcgcggatcggtgcgatgcaaccatccgtcgcctggcacatacaggtcggcatccatcagcgttcctccttgtcgcattcatccttggcgattttcaacaatacgtgggtcgccgataccggaccgcgcgacttgtacggctgccgcgcctgtcgcgcgggcgattgttgcgcttcctgcgatttgttgatcggtccatattgcacgatatgaccgtcttccaattcgagcacgtgcgtgcaataccgatatacggcacgcatgtcatggctgatcatgatgacggtgacgccatgccggttgagtttttccacggttccaaggaatcgtgatgcgagacgatggtcgagacccgccgtaggttcgtcgaggacgagtattggcgtacgcatggcgatcaccgaagacaatgccaccgcacgtcgttcgccgtagccgagcgtggccggcgaaacatcctcataccggtgcaggtcgaacaatgtcatcatttcgtcgacacgtttgaacacggtggccgcgtcaagtccgagcgcggtcgggccgaacgcgatctcctctttggtgctggagcagaaaatctgatggtcgggattttggaatacgaatccgacgtgcgcggccatttcgcccacgctatgcttcgacacgtcgagcccatccacattcacgattccttgcgtgggttgaatcagcccgttcagatgcttggcgagcgtggttttgcctgacccgttgcgcccaataagccctacgaaggcgccctgttcgatatccaagctgacgtcgtccagtgcgggagacgcattgccgccctgcccatagcggtgcgtcacatggtccagactgatgatcgcatgcttcggcttggcgtcgttccctaccggcaacgccttgatgactggagatggtccgtcactcacccgcacgccggaggattccaacagtctacgttcccgggtaaataggctggcgtctccattgcgcaccacttcaccgttgaccatgaagagcacctgatcggcccagtaggcgatgtgttcggtatcctgctcggccatgatcaccgtcatggaacgggtctggcgaatgcggtcgagcacgtcgaacacttcctgcttgccttcggggtcgagggccgcggtgggttcgtcaagaataagcacatcgggttccgccgcgagcgcggcggcgatggccacgcgctgcatctggcctcccgacaggctggtcggcacacgcttgcggtatccggccatgccgactaagtcgagcatgatgtcgatctgcttgtcgatgatgcttggggctactccgcggttttccagcgggaaagcgatctcatcctcgacactcgagcagaacagctgcgcttccggatcctgttgcacgtagccgacgcgctccgacagtgccgagacggagtgcctgctcgtattcatgccgttaacttccacgacgccgctcatggtgccgtcggccaggttcggaatgatgccggccaatgccatgcatagcgtggacttgcccgctccggtcggtccgatgatgccgacgaaggatccggaccggatgtcgaagctgacgcgcttgagactttccaccggcttgcccccgtcggtcagtggcgcgtacttccatcctaagtcgcgaaccgtaatcatgacgctcaccccgtgctttcacgcattttttccgcagccggtaaccgcatttcacaataaaacccgtggaatcgcctttcatcggcaaatccacgggcctgccttcacatgatattaatgtatcactcccccgccttaataccgaggttgcccaaacgtaccagcggcggataggcctgacgaacggcggtgaacagcgcgaagcccacaatcagacccaccgccatctggaaggagttgcccgcgatctcacccaacgccgggccaaatccggaaaggattccgcctgcgatgaaatagccgaacaccttccatacgcctgcgatcaccgaaccgatgatgatgttcgccggattgaacttcttgacgagcaggcccacgagcacggcctgcaggccatcgatgacgaacgtgaagatggcccactgcggataaccggaaatcagatcgctcaacgccgggccaagaccgccgataatgccgcccacccatggtccgaacgcatacgcgctgaaatagatcatggtgtcggacaggttgaggtagccacggatcggggtcgggatcttcacgagcatggtcagcaccgtggtgaccgcggtcataatggcgatcagcggaatggtgttgacctgcaacgcctttttgatatcgttcttgacttcttgagccataatcgcctctctcttctctctttacgtaatccgcaatatcattaccactatttatccttttgaaagaaatctgaacttctttctttcaaaagatagaatttagatattacttttcgtaacaatcgcagattctataccatctgcgctacattacgatgacaacgtccgcgaatatggcgaaacggtttgtggcaccaaccttctcttcggtgccacaaaccgtttcatttgctcaggatggcgttattccgccgatccgatacgcctcacttggcgagaccggattcgcgcagagccgcgaaaccgcccttgagatcgtcgaggatgtcttcgatgttctcggtgccgatggacagacggatcgtgccctggtggatgccctggtcctcaagctcctccggcgtctcctgagagtgcgtggtggaggccgggtggatcacgaggctcttggcgtcggccacgttggccaacaggctgaacaggtgcaggttgtcgatgaacacgcgtgccgcgtccttgccgcccttgatgtcgaaggtgaagatggagccgccgccgttcgggaagtacttcttgtacagctcgttgtccttgcggccttcgatggacgggtgggagatggattcgacttccggaacggtcttcaggtagtcgatgaccttcagcgcgttctcgacatggcgctcgacgcgaagcgacagggtttcggtgccctgcagcagcaggaaggccgagaacggagacagggttgcgccggtgtcgcgcagcaggatggcgcggatgcgggtcacgaacgcggaaccgcccagagcctcgtagaagttcagaccgtggtacgacggatccggctcggtcagggtcgggaacttgcccggcacttcggcccagttgaagttgccgccttccacgatcacgccgccgagggtggtgccgtggccaccgatgaacttggtggcggattcgaccacgacgtcagcaccgtgctccagcgggcggaacaggtacggggtggcgaaagtgttgtcgacgatcaccggcagatgatgcttgtgtgcgatggcggtgatggcttcgaaatccggcaggtcggcgttcgggttgccgaaggtctcgaagtagacgagcttggtgttctcctggatggcatcctcgaactcctgcgggttctcagcggagacgaaggtggtggtgatgccgtcacgcggcagggtgtggcgcagcaggttgaaggtgccgccgtagatgttcttggcagccacgatgtggtcgccggactgggtgatgttgcgcacggcgtattcgaccgcggcggcgccggaagcgactgccaaaccagcagcgccaccttcaagggctgcgatgcggtcttcgaacacgccctgggtggaattggtcaggcggccgtagatgttgcccggatcggccagaccaaaacgcgcctcggcgtgatcaaagttatggaacacatagctggtggtctggtagatcggcaccgcgcgggaatcggttgccgggtcggcctgctcttggccgacgtgaagctgcagggtttcgaagcggtagttcttggaatctgccatggtttctgctccttgtggggaagtggttcgttgcttgtcttgctgaccacccgccttgccgtgtgtggcggttggtcaggtgttggtagcgacaataatccggccgcgctccgcaatgcaagccaaacgttatcgcacttgcctatatccccttataaaccgttgcaatcattgccatccaggctttgcaaaactactctggtagccatcaaaaaacttgcgacacgccagcaaacggcatcatggtgactcgccgtacgaggcgatggggcggtgaagtcaggcaagcggctaaagtcatggtcaggcaatcgcaagagagggttcccatgaatgatgtgattctgttcgaccgtgacccacggtacattccacgtgtggccgcggtgcacgacatgtgcggttacggcaagtgctcgctgacggcggccattccgattctgtcggcggccggatgcgacgtatgccccgtaccgacggcgctgttttcggcgcatacgcgctacagcgtgttcacgttccacgatacgaccgaaattttggacggctatctggatgcgtggcgcaaggagaacgtcgatttggacggcgtgtattccggtttcctcggttccgccgaacaagtcacgattatcaaacgtctgtatgcggattacccgcacgccttgcgtttggtggatccggtgatgggagacggcggcgaaatctacgccacatacacgccggaattatgcgaggcgatgggcacgctggtggatggcgccgacgtgctgatgccgaatctgacggaagcgtccatgctgacgggacgcacctacccggggcagaacatcgacaacgcggaagtgaacggcattattgacgcgctgcttgccttgggagcgaaaaacgtggtgctcaaaggcgttgaccgtcaggatggcatcattcgcaactatgtggcatcggccacttccggagcatccggcaagcaagagcttgcgcacgacaagctgccgttcatgacacatggcaccggcgacgccttcgcatccgcattatgcggtgcggtgatggccggcagacctctggctgaatcggcgcatatcgccggtgaattcgtacgccatgccatggaaagcacgcaattccagccgaaccacactgagcgcggtgtgagcttcgagctgaaccttgacgagttgacgcgtctggttcgccgctgaacattccaaccatatgcggtttcgggcgctccatggccgctcgccttgtggagcaatgtggataacggcaagttatccaccaactatcccaaacacgcccgaaaccgcatcctctatccacattcgccgttcgcccttgcttcgcgccggtcctttctgctggacttgaatcatgaacggcaacacaacacataacgttccgaacgcaacgcagcgctcggaacagcttcttgattccatcgcacggcgactgcatgatggcacactgtgcgcacgacaggtcggcgaactcggcgaacagtatgcggccgcatggctggaaagccaaggctggcagacgctcgaccgcaactggcactgccgatatggcgaactcgatatcgtttcacgcgacgatacgggaatcatcgtcttcgtcgaagtcaaaaccaggcggacgctccgctatggcactccgcaggaagccgtgacgtcatccaagcagatcaacctgcgccacgcggccgtgcaatggctgtcggacagcgaccatcgcacgccgcataacggcgtgcgcttcgacgtcgtcaccgtcatcgtccgtgatggcaaaccgcttgtccaccatatcgaaggagcgttctgatggctatcggcagcgcgctttccgtgggtctcatcggcctgaaagccttcatcatccaaatccaggcgttcgtatctccgggactcccctacttttccatcatcggacttcccgacacctcgctctccgaagcgagggaacgtgtcaaatccgcatgtcaggccagcggtgccaaatggccggaaacacgggttacggtcaatctttcgccggcgtccatgcccaaacgcggatcctcacacgatctggcgatcgcagcgagcgtgcttagcgcatccggaacgataccgcatgactgcttgaacgacaccgtcgtgctcggagaggtgaatctcgatggcacggtactgcccatcaacggtctgctgccgattctgctgcatgcacgcgatcaaggcgtatgcaaggtgatcgtaccgcatgccaatttggacgaggcggcccttgtgcccgacgtcgacgccattggaatacgtcacgtcggcgaactgatcgaactgatgggaggcaccgcgaactatacgatacccgatatgatccgagacgtggatgccaacgacggcgccatgtcggtatgtcctcctcccggagatatgaacgaagtcatggggcaggaaacggccaaatgggcgttggaagtggcggctgccggcggccatcatctgatgatgaccggtcctcccggcaccggaaaaaccatgctcgcctcgcgcattcccggcattatgagtccgctcagcgaatcggaacaactggaagtcgcctcgatccgctccctatgcggcacattgcccagctatggcatcagcgatgttccgccattcgaagcgccgcaccataccgcatccaccgcatccttggtcggcggcggcgcgggattggctcaaccaggcgcgatcacgcgggcgcatcggggcatcctattcatggacgaggcgcccgaattctcggcacgcaccctgcaaaccttgcgcgaaccattggaatccgggtatgtggcgatatcccgcgcgaaaggcaccacctactatccggcacgattccaactgatcatggcggccaatccttgcccctgcggctacgcatacggcaacggcgagcgctgcacgtgcagggaaaaagaccgtatcaagtacttcagccgcctgtcggggccgatcctcgaccgcatcgacattcagatcgaagtgcctcctgtggaacgcatcaacccaggcacggttccttccggcgaatccagccacgccatccgcctgcgggtcatggtggcaaggcaaacggcacaggaacgtttccgggaattcggatgggtctgcaatgcgcaagccaccggaacatggcttcgcgccaacacgtccacaaaagccatcgagctcgtgaaccatgcgttggccagcgaacggctcagcctcagaggggcggaccgagccatgcgactcgcatggacgctatccgacctgtcaggcaaaacctctcccggaccggaagagatgatgcaaggaatctccatgagaacgaggttgacatgaacgagaacacaaccgccgatacgagcgtcaacgcaaccgccatcgacgatgagaccctgtcacgcgcggtgctcacctattgtctggacagcgccgatgcgatgatgtacgcgctggtcaaaggcatcggatcagccacgcataccttgcaactgcttgccgacagcggtccgggcaatcatgaaagcgtggccacggcagcctataaaaccttggacgcggcgctcatcaacggcattacacgttggggacgcaccatcaatgctcgaggtatggcctccttccacggcgcaatggtctcgtggcagcatcgcctgaccacattgcccagcaccgaccccgaggagctcaaaacgtggttcaccgcaaacggcacgcagtggatcgtcgcgccgcatcacccctactggccttcgcagcttgccgacctcaccatacacacggactgggccgcgccattatgcctatgggggaaaggtgacccccaagcgttggtgtcatgctccgaaccggtcggtgtcgtcggatcacgcggcgtaagcgagtacggaaggcaaagcgcacacgagctcgccaaacaagcggcccgagcaggccatctcatagtgtcaggaggcgctctgggcaccgatgcggccgcccactggggagccatccaagccatggacgagatcggaacgcccctcgcaggacgcaccgtcgcggtattcgccggaggactcaactatatcggtccgaaaagcaacgagcgcctcttcgaaaccatcatcaaccattccggcgcgctcatctcggaactctgccccggaaccgttccggaagccagacgattccttatcaggaaccgcctgatagcggcgctatcatccaccctcatcgtagcccaggcacgcgcacgctccggcgcgcttaacaccgcaggatgggccaacgaactcaaccgccgtgtattcgccgtgccaggagatgtaaccatgcctcacaacacaggatgcaaccgactcatacaagaaggccaagcctccatcatctgctcgctgaccgatatcgacgaattctgccacgcagcgcatcgcccgcaatcagccgacgcggcagacaacgacgacgaaccgtcggaagagtcaaccgacaccagtctgtcgcaaccaaccaacgccactgcagccatactcaaagccatacgaacatgcagcgcgaaatacggccacgtctccactgacggtctactcgccatcctggccgaaagcaatcccggagaatactcaatctcacgaatcagcatggagctgggattaatggaactcaacggacttatctgcacacagcatggcaacatcaccatcaccgacgcaagcgccacatgacatcacgcccaacaacgccaccgccaagcctgcacagatcaacggaatccatcgaaaacatacgcatcagacacgcataatcacgcatgcagcggcaaacccgccaaccggcaaaccgcaatgaggtcacaccttgtgcgaaaatcgttgctatgagtccgaagcatgttgaagatatgtatgatgcagtaatcgtcggcgcaggcgcggcaggcctgtccgcagcattgggaatgctgcgaagcgaacaaatgcaagccctgaaggaagccggcatcgagccgaacatcctggtgatctccaaactccagccgttgcgctcgcacaccggttccgcggaaggcggcattgcggccagcctcggcaacgtcgaaaaagacgactggcactggcactacttcgacacggtcaaaggcggcgattggctcgtcgaccaggacgcggccgagctgctcgccaaagaggcgtcggaaaccgtaatcgatctggaacatgacggtgtggcgttctcccgtactgaggacggccatatcgcacaacgacgttttggcggacataccaaggatttcggcaaggaaccggttcgccgcgccgcctatgcggccgaccgcatcggccatcagatcctcttctccttgtggcagcaatgcgtggccgaaggcgtggaattcgccgaggaatggtacgtgaccgatctggtaatcaccgaagacggatccaaagtcgaaggcgtagtggcatttgacacgcataagggccaaacgcacgctatccacgcacgcaacgtgcttctggccaccggaggcgcaggccgcctattccacaccacctccaattcatgggatctgaccggcgacggcatggctctcgcactgcaagcgggactacagcttgaagacagcgaattcgtgcaattccacccgactggtctggcgcataccggcattctgctgtctgaagcggcacgagcggaaggcggcgtgcttcgcaatgccgatggcgaggcattcatggaaaagtatgctcccggccatgccgatttggctgcacgagatgtggtgagccgttccattatggctgaaatcgatgccggccacggcgtggcggatccgaaggaccccgaagggccaaaggattgcgtgtggcttgatatgaccggtattgatgccgaccatatgcatgaggtactgccgcaggtggtggaaaccatcgaaaaatatgcggatcttgatccgacacacgatttcgtgccggttaagcctaccgcgcattacaccatgggtggcattccgatcaccaccgacggcgaagtctaccgttggcagaacgacgaacgaaatgtcgtcgaaggcctgttcgctgccggcgaatgcgcatgcgtgtccgtgcacggcgcaaaccgtctcggcggcaattccctgctggatgcatgcctgttcggcacccgctccggcaaggcgctggcggaacgcatttccagcgctccagtgaacgatcccatggctgaatccgacgccgacaatggttcggatgcggtccagcaggccgctgacacccgttccaacgaactcaaggatctgctggtgcagcttccggaagacgaggagcatgcagccgacaatccttaccagctgatggccgatctgggtaccgtcatggaacgcgctgtcgccgtgcgttgcgacgagcagggtatcgaacaggcgctaacggcattgcatgatgagtttgcgccccgtgccgaagccctgcacgcgcattccgactcccccacgttcaaccaggagatcaccgccatttgggaggtccgccaccttctggaactcggcaaggccgtactcacctcatccgatgcgcgtcacgaatcccgtggctcgctgaagcgtcttgattttccggaacgcgacgatgagcatttcctggcccattccatggtgaatgcctccggccagatttcctggcagccggtgcacattgtgaatatgccgccaaaagcccgcgaatactgattccgctgggcacggcgtatggcagactagttgacggttttattggaaaggcgggtacatgagcggtatgggaaacggcgtgaatacggtgacattgcgggtgaataggtttgccccgcgcgccgagcgtgcccgcgaccgcgaacgtggcggctctccgttcgccagaaaaagctctccgtttggggattccggcacgtcggcgcgccgccgcccgcgcggcaagcagtggttgcaggattacacgttgaacgtgcgtccggaagacacggtgcttgattgcctgttgaagatcaaacgcaccatcgatccgacgctggcattccgctattcgtgcggacatggcatgtgcggttccgatgcggtgtccatcaacggcacccccaccctgctgtgcaccgcgtccgtcaaggattgggccaaaccgtcgaatccgacattggtcgacgatgaaggattccgacacaccggagatgtttccgacattcaggaaaatgcggtcggcgcaggggatcttggcgtcatcgagctcgctcccctgccgggtttcccggtgcagcgcgatttgattgccgatatcgatcagatgctcaaccaaatcagaaaactcaagccctatctgcaggcgcgtggagaactcgccaccactgcggacggcaagatcaacgctttcgaatatctgcagaatccccagcagcttgccaagtatgagcttctcagcaactgcatcgcctgtggcacttgcgaaggcagctgccctgtgtatgcgggcggcgaagcgttcatcggacctgcagcccttatcgcggcgtctcgtttcatcaacgattcccgcgacggtcaggcgaacgcacgcatggatgccattgattccgccgatggcatcgccgcatgccagtcggtccgcgcatgtacccgcgaatgcccgcgtggcattgacgtcggcgaggaaatctggcagctgatcgcccaagtcaaggaacgctgaacccatggatagaacgtcatataccaatctcgccaagtcatgggaatacgttgaggaccatgcgttctcccgccagtcaaccgacttgaatgctattcgcacccatgctgaagaagcaggcattccgcagggttcagcagcccaagccgagctgttgcgcatgctcgtgcatatggtgaatgcgacatcggtgatcgccgtcggcaccggttccgtggtggaaacgttgcagctggtcaacggtttggataattccggtcagcttacggcggttgattcctcttcccagggcattgcgctgattcgtacgttgtttaatcggctttccgacgagacacagaccacgcttcgcgccgtcaacgctcccgtcgacgtgtttttgccacgtctgaatgcagaaaactacgatttgattgtagttgccggcgacgcggaaaattacggcgcttccttcgagcaggctccccgcctgttgaagaagcatggcgtaatcgtgttcaccgatattcttgcttttgattcagccacgtccgcaggcggcgttttgaatcccgccaatcgtgacgccaaatccattgccatgcgtggtttgctggaaaccgtggaatccgatgagcgtttcgtcactgccctcaccccgaccggtacgggcctgctcgtagcagtcaaacgctagtatggccgttcccagcggcctaccgtttcctcatacaaaaagccgacactcacggataagtgatgagtgtcggcttttgttgtgtctggcgtatggcgcggaatgccatacgccggaacgtcgttatttgacctttggatgtgtgtcgatcatctggctgaccacaacggtgccgtcttcgagaacagattccacttccccagcagcatcctcgtcagcagtatgatgcttatgcttcgaggatgcggcagcggcaagctcaaacttcttggattggcggctcagcagaatgccggaaatcaccgccgcgactatggaaccgaccaacacaccgaaacgtgcttcagcagacagttcggcatcctgatatgcaagcgaggaaatcaggaaagatacggtaaagccgatgccacatgcgcaggccgcggggaacatgtcgcgcacacgcaatcccttagccattttcaatccggccacatgcgtggaaagccatgccgtgatcataatgcccaacggcttgccgaccaccagagccaccataacggcaacgacgaccggcgaaatgaacagggccaacgtcaacgattcaaaatgcacaccagtggcgaacaaggcgaaaatcggcagagccagcaacgcggaaaacggctgcagcttgtccgcatagcgttcggcgcgtggggttttctctccgaaacgctcatgagccggcgtgagcaatccaacaagcacgccagccaaagtaggatgcacaccagcttcgaacatcatcacccaagccagaatgccgacaatggccacggcaagccatggcactttgcgcatacgcaccaggaaataccatacgacagcgcatacggcgatgccgacgaaccagtaccatgcgttcaccgaagagaagaacaccgcgatcagaataatggccagcagatcgtccactgtggcaagcgtcatcaggaacgcgcgaatagagcccggcagcgctttggcgaacaaagcaagcacagccaaagagaacgcgatatcagtggccgtaggaaccgcccaaccatgagacatctcaccaaaggtgaaactcgttcccgaagcgatggccaacggatcggatccgaaaccggagaacaggaacaataccagcaggaacaacaccggaggagccatcataccgcccacagcgcacagcatcggcactgcagcagccttggggttcgacagcgaacctgtggcgagttcctgtttcaattccagtccgacagtcaggaagaacaccgtcagcagaccatcctgcacccagtgtcccaatcccatatcgatattggtgtagggaatggcgatgcggaaattctccaactcttcgaacgcatgcgccgtgaacggcagattggcaagcaacagacctgcgagggcgaagccaagcataatcagaccagatatgcggtcggaagcggctatgtatcgtattttcgcccagagtccctgcttacgttcggtcattgctctcccgtctgttgccgcgagtatccacggcccgccattcacttaagaaaagcgtctgcggtattggcatgcgcagacgcttcaatagcggttccagtgtaccgagaggtgtcggcgtttatgttttcaaaccgtctttttcactggtgtttacggttttattcggcatggcggcttttcttgtaccacaccgttcgctcggagagaaaccgaacgtatctcgacaacagccgctttacataagcattctggtaggtttgcgaatcgcattgactcgaacactattcacggcagcgccgccgttacttccagaaaaaaagaaagcctcctccgcatttcgcgaaggaggttcatgtgcgcgagacaggattcgaacctgcgacctgctgatccgtagtcagctgctctaatccgctgggctactcgcgcaacgccatctcatttatttacgccacctgatgaccggtggccggtgcgcgagacaggattcgaacctgcgacctgctgatccgtagtcagctgctctaatccgctgggctactcgcgcaacgttgcttgttttcggcaactcgaataagatacacccaaatggccgcgcagcaaaatctcggcgtgtcgcgcctgttttcgtggatttcgcaccggcatccatacttgcttcaaccctacgaaatctgaactctcgcacatacgacgcgcaacacgccgaatgcactacgcggcacgtctgcgaggaatctcctccgtggaaaccttcaatagtttcggagtgccggaaccattgacggacgcctcatccaccaccacctccgatacgccagtcacgcttggtagctggaacatcgtgtcctccaaggttttttcgataatcgatcgaaggcctcgggcgcccgtgcccctgcgaatcgaagtggccgcgatctgccgcaccgccccctcagtgaacgtcaacgtcaccccgtcaatcgcaaacaacttctgatactgcttgaccagtgcgttctccggtgcgaccagaatgcgcgccaaatcatcctccgtaagctcctcaagcacgctcaccaccggcaatctaccgatgaattcaggcaataaaccgaaatcggcaagatcgtcggccgaagcctgggcaagcagctcacgattcggcacctcatgatcatgccacgcggcaccaaatccgctttcacgagcgcccaaacgctgcgccacaatatcggcaagcccgacaaacgcgccgccgcagataaacagaatgtcacgagtgtcgatctgcaccgtctccatctcacgatgcttacgcgaaccctccaccggcacggatgccacagtaccttccaaaatcttcagcagagcctgctgcacgccctcaccggacacatctcgcgtaatagacgtgttctcgccgctcttacgcgctatcttgtcgatttcgtcaatatagacgatgccctgctgcgctcgcgccacatcgccgtcagcggcctgtataagccgttgcagtacggtttccacatcgtcgcccacataccccgcttcagtgagtgtggtggcgtcggcgatgacgaacggcacattcatgaccttcgccagcgtctgcgcaagatacgttttgcccacgccggtcggccccagcagcaggatattcgatttggacacctgcacgccggccagtggatcgtcgctcgcatgcgccgcacgatcgcgcaatgccgcggattcgcgcatttccatattgacgcgcttgtaatggttgtatacggccacggaaagcgttcttttagcggattcctgcccgaccacgtagttgtcgagataggcgctgatctgtgcgggtttcggcagctgcaatgtgttcagctgggcgtctttgacacgttcttcggaaatgatgtcgacgcacagttcgatgcattcgtcgcaaatggccgcacctgatccggtaacgagcttacgtacctgattttcggttttgccgcagaacgtgcatcgtgacacttcatcgttgtagctgaccactcgtcccattcgcacccctttgtttgccgtacctgccattgagcaatcgccatcatgcaatcatcattgaagaacagcatacccctgccaacgcccggcaggggtattgatttgtgaagatgcgacttcagatggaacctcgcatatgcgccgttcagctacggtgttccagcacttcgtcgacaatgccgtattccttggcctcaggtgcggtcaggaaggtgtcgacctcgatgtctttgcgaatcttctccacatcgcgaccggtatgcttggccagcgtgttctcaagccattcacgcatacgcagcatttccttggcttggatttcgatttccgtcgccttgccgaagccctgatcgatggccggctgatggatgagcacgcgcgcgttcggcagcatcagacgcttgcccttggctccggcggccagcagaatggcggctgcggaagcggcctgtccaaggcatacggtctgcacatccggcttgatgtactgcatggtgtcgtagatggcggtcatagccgtcatggaaccgcccggagagttgatgtacatcatcacatcacggttcggatcctggctttcgagcaccaggagctgagccataatgtcatcggcggaagtgtcgtcgacctgcacgcccatgaagatgatgcggtcttcgaacaagcgggtgtacggatcctgccttttgaaaccgtacggggtcttctcttcgaactgcggcagaacataacggttctgcggcgcgaaagcggcttcgcgggctgctgcagcctggaaaccaaccactccggtcggtcctgcgagacgctctgcgcgggctacgaatcgggattcttcgcttgccatgttcactctcccttggtggcgttcatcgtgtcgtgcgtggaaacgagcttatccacaaaaccgtattccagcgcttcctgcgcggtgaaccagtggtcgtactcgttgtcgcggtagatttcctcaacggtatggccggtctgttcggcagtcagctcgctcatggtcttcttcatgtccatgatcagttcagcgttgatgcgcacgtcggtggcggtgccgccgatgccgccggacggctggtgcatcagcacacgggcatgcgaggtcaggaatcgcttgcccttggtgccggagctcagcaggaactggcccatggatgcgcacatgcccaagccgacggtcgccacgtcaggctcgataagctgcatggtgtcgtaaatggccatgcctgcggtgatggaaccacccggggaattgatgtacagccaaatatccttcttcggatcttcagctgccagcatcagcatctgtgcgcagatgcgattggccatttcgtccttgacttcctcgcccatccaaatgatgcggtctttcagcagacggttgaaaatcggatcggcgggtccggccggcatatcttcgccggccatgacgggcaggggtgcactgaggttgctcaccttgtctccttttcctatgttctctatagtttcacagcctaccgcttcgaagcgacgggtggtgaaattgcgctcacagtggagtcttcacgctagaacaaaccttacttgacgatggtgttgtattcgggaacgcccatatagttgtagctcacttccacgtttttggccgatgccgcggtcacgttggtataccacaaaggaatcaccggcaaatccttcagcaacacacgttcgctctgccgatacaggctcacggccttgtccaaatcggtctccgcagcagcctggtcaatcagcgcatcaaattcgtcgctcttgtaatcaccattgttcaaacccttgccgtccgctgccgatgagtcgtatgcctgcaccagatagccttccggatgcggataatcggattgcatgcccgatttgaatgccgcgtcgatggtgcgctcctgaatggcgctgcgcagttccttggacgtggcgaacggatagctttccgcatcgatgccaagcgcgttgcgaatggaattggccgcagcctccacccactccttatcggtgccatcggcgctgtatgcgatgcggaacgttccgctccatggcgaaatcgcatccgccttcgcccacaattcctcggctttcgtctcatcatatgcgagcacgccatccgtgtcgagatcggtgtcatatcccttgatcaccggcgcaaggaaatcggtggcggtcgttaccgtgccaccgaaaatcgcattggcgatattctcacggtcaatggcatgcgcgatggcttgacgccgatacttgccttcctcaccttggaaatgcttgagattctgcgaaatcgtaaatgctgagaacgacggaccgggcttgctgacggcggtgatgttcttttcattctgataggttttcaacgcggaagtcggaatggcatcaagcacgtcaagattgtctgccagcagatccgaataggccgcgtcaagactttgatacaccttgaaatcgatgcctgcgttcttgacttcgcgcggccccttgtaggagtcgtctttttcaagaatgatttcttcgccgcttttgtacgccttcagcttgtacggaccgttgccaatcggcttttgcccgtattccttgggattcttaatgacttcggatggcatcggcagaaacgcgatatctccgattttgtacaggaacgccgaattcgacgctttgagcttgaccttcagcgtagtgtcgtcgaccacggtaaggcctgacaattgcgcggttttggaaccacttgcatcctgcagctcatcatagccctgaatatcttcgaaaatggaggctccgacctgtccattggcagcattggccgcgaacgaccagcttttcgcgtacgtgtcggcggtgatcttctcaccattggagaacgccagattcggtttaagtgcgatggtgtattcggaagcgtcgtcattcggcgtgatcgattcggcctcgaccaacgtctcattaccttccgcatcgaaagtgaccaggccgtcatacagctggctgacgattttccaaccggccatatcgctggtgtcacttggcagcaagccattcgatggttccgtgatattgacgctgaccaccttatcggcactggtgacttcctgctgggaatccttcgcctccacggatccacagcccgcaagcagcgcaactatggaaagcgccgccgtaatcggcttgagcagaccggtagtgatgccgctatacgggtgttgtagtctcattgctgtcctctcaataacacggtagagacagcatagcaagccgatattccttgacggaacgctttcctcactttacgctacaggctttttctatagcctgctattacgtttcgcaccaatacggaacgccgcaatcaagcaacagatggcaatggccacgataccaatcatggtagcgaacgtccagctgccaccgacagccgtagcgtgacggaacgtggcacccccctcttcgcctgcgccagcctgagccaccgacagaatcgtggagaacagcgcggtgcctgccgcgccgccgaactgcaggcaggtgttgaacacggcattgccgtccggcatgaactgaggtgcgatgttacgcaacgcattggtcatgatattggaaaaaccaagcgaataaccaaatccgaaaatgaagtagaaaccggcaagcgtgacgggtgtcagtcgcatggaaaataccagcagcagaatcggcccacaaatcgcggcgaaaaacgcgccgagaatcggacgcaccggtccgaaacggtcgtacagcatacctcccaccggtgcgaaaaacgcgccgatcagcgcacccggcagcaccaacgcgccggacaggaacgcgctggttcccaacgaaagctgcgccacattggtgatcacataaccgaaaccgatgccgacgatcggcagcagcatgtaggcgatcaaatgcaacaacaccatcgggtcacgcagccagcccaaacggatcagcggcgagaacgaacgcttcgacgaccagccgaaaaacagcaatgcccccaatccaacgatcagactcaccacggcgaacactgccgacaccgtggcgctgccgccggaaaccgcggcgctgacggccactccagcttggttcaggaacatcaccaatccgcacaatgcaagcacaatcgacacgaactgcaacgaattgagacgcgcctcttccgtcgggcgatgctgttcgacgcattttaaaccgaccggcaacgagaccagcagaatgatcggaatgacaatcacgaaaatcgcacgccatggcagaatgctcgacaccgcgccaccaacggtcggaccaattgccggagcgacggtgatgaccagcgaaccgacgcccatcaaacgaccgactttgctctttggcgactgttcaagaatgatgttgatcatcaacggcgtggccacaccggaacccatgccttgaatcacacgggcaatgagaatgaccgggaacgcatgaccgacaatcataatgagcgagccgagcacggcaagcgccaccgcggcaaggaacaacgtgcggtgcttgaaacgacggttaagatacgacgacaacggcatggtggccgcgaccaccagcaggtagatggtggtgatccactgcacggttgcggtgtcgacgttgaattcccgcatgagttgcgggaaaagcaccgtcatcacggtttcggtgagaatgccgatgaaggcgagggagccgaccgccacaatcgctccgatgagtttgccggggatgcgttcgtctgaaatcgccgcttcctgagttccggcgtttgtcgtaatcgcctgcgattcagtggctgcagttgttgtagtaatgttccgttcttccataattccttatccgcgcactttttcctacggccctgtgcgatgccgtctatgattcattcgtatgaaaaccactgtgtagtgtaatggaagccctgacctagatgggaacggcatgcgtaaggctggacgtaccatttcggcacgtccagccttacgcaaagggaatcagaaacaaatggtatgaactggagccgttcctcctattctttcttgttgaaggcggtgaccgcacgctgcagcaccacgaagatcaggatcatcaggccgaccacgatggtggtccattcggccggcacgccgaagtcggaggtcagcgggtcgatggtggaacgaaccagagcgccgatgacggaaccgagcacgtagccgaagccgccggtgacgatggtgccgccgatgaccacggaggccacagcatcaagttcccagccgacgccgaccgtgttgatggaagagcggatgttggccgtgtacacgatggaggcgatggaggccagtgtggcggaggtcaggtagatgacgtactgcgtgcgcttgaccggcaagcccatgagttccgcggaggagcgcgagccgccgatggcgtagatggtgcgtccggtgcgtgtatggtgcagcaggatgtacccgaagataaccacgagcgccgcaatgatcacaccgacattgatgtacagatcttgggagatcttcggattgtcgatgatggtgatcttctgcgaaatgaaatcgaagttgttattttcggggaaggtctgcgccttggtcgaaatgatggatgcgatgcctcgcgccaggaacatcgaagccagcgacgcgatgaacggctgcatgttgaattcttcgatcagggtgccggtcaataggccgaacgccacgccgatgagaatcatgacgaccatggcgagcggagccgcgacgcctgcgttggtgagtttcacaccgacgaccgcggtgatggcgacgatggcgccaaccgacagatcgatgccgccggtcaataccggaagcgtcatagccacggccagaataatcaggtaggcatggtcgatgaacagggacgacacgaatccaagacgcaggtaggtgccgaacagcgcctgacccatgatgatcatcagaatgaagatcaccactgctgcgatggttggaatcatctgagcgtcaagacgacgccgagtcggtttcacggtcttcttgacctgagtagctgttgcagaagtcatgctgccaccgccttagtttgcgtcttcagcgcgcacttacgttttatttccgcgccaaggttatgaatcttcggagcctgcatcacgcagatcacgatcaccacgacggcgaagaatgccggtgttgcggcggaatcgataccgagggtgatgatggtcttgcggatcatggcgatgatcaccgcgccaagcgcgctgccagccagggagaacttgccgccaagcagcgaggttccgccgataacgactgcgaggatggcatacatttcaagatcctgcccggtcttgaccacgtcgacgcgcatcacggatgctgtggcgaacaggcctgccacggctgccagaagaccggaaatcgcgtatacgaggaagaggatcttcttcggcttgatgccggtcatgcgggaggcttccggattgatgccgacggattcgaccatcatgcccatggccgttttgcggcacagcaggccaatcagcgcgacaatgaccaatgcgatgacgaaattggcgggaatgcccagaatgaagccgttggccatccatttcagcggcgcgccgcctgcaacggagctggcatcagtgttctggccggaagtgatgaccttggccaatcctcgacctgcgagcatcatgatcagcgtggtgatgaacggctgcagtcccagaatggaaaccaatgcgccgttgatgcagccgacaccgaggccgatgagcagtgcgaggaaaatcgccagccacacgttaacgccggaagtcagcatctgcatggccgccgcaccggcaaccgccataacggaacctacggaaaggtcgatgcctgcagtggagatcaccaatgtcatgccggtggcgatcatgagataacgcgccgattcctgcagcatggtgatcagcggtcccgaaagacctccggtgttcttattccagctcaacgagaggaattggtgatcggagatggtgcagatgacgatcagcacaatcagtgcgaccacagaccatgtgaggtttgacgacagcagcttcttgacgagggaatcgccgtcctgctttgttttcttgtcgctcatcatgcctcctttcctgtattgacgttcgtgttcgcgatggtttggacgatggtttcctgggaaaccgtgttgtcattgacgagttcggcgatcttgtggcgatccttcagcacttcgatgtcgtcagaaagcctgaccacctcttccatttcggacgagatgaacaccacacccatgccctgagcggcaagatcaagcaccacctgctggatttccgccttggcgccgatatcgatgcctcgcgtcggctcgtccagaatgagcaggtcgggatgcgtggccagccaacgtgcgatcagcaccttctgctggttgccgccggacaggttcttgatgagcttgttcggatcgttcggacgaacgttcagctccttcatgtacttgtcgacgatctcgtcggcttccttcttcggaatcggcttgaacatgcctctcgtcgcctgcaaggcgatcagaatgttctcgcggaccgtcagatcgccaataatgccttcgtctcgacggttctccgtggagtatgcgatcttgttgcgcaatgccgtgtacggatcggagatactggtcttcttgcctttgagctcgtacgtaccggaatccggcttgtccgcaccgtacagcagtcggccgagttcggttcgtccggatcccaacaggcctgcgaagccgacaacctggcctgggtagatatctaggtccgtaggattgatggtgcctttcagaccaagctgcttgacggagacgatgggctgttcaccttcagtcacgtcacgatgcgccttcttggcgccgatctggctcagctcgtccgcgctcttgccgatcatcatgccgatgagctcgtcacgcggagtgtccttggtcatgacttctttgatgaacttaccgttgcggagcacggtcaggcgatcggtgatctcgtaaatctggtcaaggaagtgggacacgaacaggatcgccacacccgaatcacgaatcttgcgcatgatcttgaacagatcctgcacttcgttggcgtcaagcgatgacgtcggttcgtcaagaatcagcaccttggcatcgatcaccatggctcgggcgatggcgaccagctgctgcatggcgatggaaatggagctcaacggtgctctcggatcaagatgatccagacccatctgggcgaggaatttcttcgattcctcataggttttcttccagttgatgcccagcgtccctcgcacctcatgaccaagcatgacgttttcgccgatgctgagattggtgcacaggttaacttcctgatacacggtggcgatgcccgcgttctgcgcatcaccggtaccggtgaaggtttgcggcttgccttccacttcaatggaacccgcgttgatcctgtacacgccggtaagcgctttgatcatcgtcgattttccagcgccgttctcgcccatgagagcgtggacttcacctggatacagacgcaggtcgacgccgtccagggccttgacgcccgggaactcgatcgtgatacctttcatcacgacgattggttgcttatctaccatgtcttcgccttacgaaaattgttatcgttttgtgatatttgcccaagatggaacgaacggtgcatcgcgctatgcggtgcaccgttcttgggctatgtgaaaaggagagatgctattcggaaagttatctgatcggatcagtacgcacgggtaccggcatccaaggcttccttggcgctgtctgcatcgaaggtcttggattcgatctcgatatcggattcaacagacttgccatccagataatccttgacggcgttggcggtttccttaccgaagatcgggttgtactcgatgacgtaggaaagatcgccgtcgaccagagactgcagagcggccttggtgccatcgatggtgatgatcttgaccttgcccttcagaccagcggcatcaacggcctgtgccgcgccgagacccatctcatcgttctgggcgaagatgaactgcggattgtcggacttgtacttgtcgagcagacctgctgtcacggtctttgcctcatcggtggaccagttggcggactgggactcaagcaccttgatattgcttgctgccttgttatcccaaccggtgccacgatcggtcaccacggacaggcctgccggtccttccagaatgaagccgttggcgccatctgggaagctcttgttgacgaattcagcggccttctcgccggcccagacattggacgggccgatgtgcgagacgactgccttctttgccgcatcgctcttgatatcgatgttgcggtcgacggtgaagaccgggatttcagcttccgccgcgttctccaagcagtcatcccaaccggaatcgttggttgcggatagcacgatcgcgtcgacttcgtcgttgacgaacttgttgaatgcctgaatctgcttctgctgatcgttgttctgcgtcggggagtacaccagatcgaatccggcatcctcgaatgccttcttcagatcgttctcgttggccgtacggaagccgccttccggaccgactgccacgaaaccgatggtcttcttatcgctcttgctggagctggaatcgccatcggagctgccgccaccgcaggccgccatgctggccatagctgccgccgaagcacaaatcgcaatagctttcttccaattcttcatgaaaactcctcctcgagtatttctattgatgggcttccttgccatcagtgttttcagtatcgttcgaacaatccaaggtctcaatccatagcaataacgtttcgataacaagtcaataacgaaacgataacaatggcggaattacaactttttcactattgcacagataacgacgtaacttgggaatcagcaatcgtccatgcaccatccaacgatccgtcgaccgttctcgccactccgagatggtcgagtacgacaagcctgcgatatgtgccgacttctcctgtggccatatcgaccgcaccattgtcgggtagcgcctgactcgtttcaggaccaggcaccatctgacgtcgtccgatctgcgcacgcccccgctcgtattgcgtggcatagagaaaagtgacgtcgttatagaacgtcatcatcgacacattggactgtgtggaaaccaaagcgaacgcttgggacagcccagccacggagccatcatggtcccggcatatcccgatgatggccacacccgactgcgctcccccatccgattcgatggagaatgcgatacggtccccctcaggggaaagcctcatggaatggagcgtttgtgctgatacgaggccgggaacgtcaagggtgagaaccgtgccggcatcatcgaccatgatgtgcttgccagatgtgtcgatgccccaaatctcggagtcgtttcctttgcagatggttttcatcatgcgtcctgaaaacatcaatgcatgggtggaaccgtcctctgcgagccttttcacatatccgtcacgaccaagcacggctccgccctgtgctgagaaaacgaagcttcgcacgtccgaaagatccgtttgcgccacacgaatggcgctgtaggatttcaacgacacgatattgccgacgctcaacgtatacatgggattcagcggagtctgcgcatcaagagacgacgaatcatcggcatgcgaatagtcatggtttccagacatcaccttgatttccgtctcggcgctgccgtcccccaacgataggcgaatctgcctgaccaaaatgccacgttcggcatccgtcattcgttccatcgccgatgagagactcatttccatcaccgaatcgcgcatctgcacaccgtcgggctgcaacacgatccgcttggtattggtgtcgcttaccgcgccttccagccatgccgcatttccggcaagcagttcctgcacggcgcgcgtccgccaatccctccagcaaagccaacgaacatcggggatcagttctttttcggaagagcccaactgatatagcgaaacctgacggtacacctgctcgaaatcgtaggagctgatcatcacgcctgtcggcagtttgctgatccgccattggccacgcactttggagagggagaaatcgtaggtttttgcccctccgctcgccaccgccgtatacacgccatgcgcatccagttccccttgtatctggaggctgacgctcaccacggttttctgcccgccttgccctgactccaccgtgctggccttacgcacgaatttcggcacgtcggcatataccgtagtccggttatcggcattccaccttgatgcggcgccatcggtaaggaactgcttgcccgtggcgaacccgtcactctgcactcccgcaggcatgacgtcgaaaaatcctttgacgatggcttccggctgcgcgtcatcggccggcccgtcgggagacgtgaacactcttcttgtgctttgttcctccggggtcatggtctgcaccggaccatcttcaggaagtcccaatatgctcgagcatccggccagatgcatcatggagcatcccagcaataccactaatgagaccgcggcaatcacacgacgaatgtttttcgcagtcatcacagcccctccaccatgggtttattggtcagatagtccacgaatccgttatcggcaacgccaaagcctccgaccacccgcatatcgtcgccatcggtcgcgaatcgaatcggagcgttgttcataccgcaatcgacatcgtccggattgcgaggcaacgtcaccaaaaaccatgttccttcacccagccgcgatcgcaccgcaacatcaccatgatgcagtttcgtgtcagccagtacgatggacatgcccaaaccggttcctccggtagtgcgcgctctggaaggatccgccctccagaaccggtcgaacattctggaacactgttccgaggtcatgccaacgccgtaatcgcgcacgctgattactaccattcgctgattggcggcaagacggacctcaaccggcttgccctccgcgaaatcgatggcattagcgagaagattgcgtacgacacggcttatacgacgcgtatcgattctcacaagcacttccacgttgggcatatgcacatccagtggcacatgtttggtctgggcgatggcggaaatcgcttcaaccgactgttcgatgggctcgcgtatatcggcctccaccaaatcaagcgccgcatacccggcgtcgaaacgcgaaatctccaacaaatcggcgagcatttcctgaaatctgcggatctggccatccagcaattccaccgttctctttgtggtggcatcgtattcgtctttgtgcatcgacagcatgtcggcggccatacgcatggtcgtcaccggtgttctcaattcatggctgacgtccgaaacgaagctgcgttgcatatccccggctttttccagctcttcgatctgattctccaacgattcggccatttcattgaacgatttctgcagcacgcctatctcatcggccctgtccaccgccacgcgggcgtcgaaagttcccgatgccatgatttccgtagccaaggcgacccgccgtaccggagtgataaccgaacgcatgaccagaaaaatgatcatcccgatcaacacgctcaacgccacgcacaccatcagcatgttgatctggatctgactcagcgcctgctgctgcgattggtaggagtacagtgcgaacacttccaatgagcccatgttattcgacgaaatcaccgatcccaaaaccgcgccgggcgtacctccggaagttctcggaatacgtaccggctgatagtagatcaatccggacgtatcggcacgcatgcggttgcgcatagatgacgacaccagatttgaatattccggctccgtcgataccggcacgaatccacgctccgcagaatccgctgcatcacgttccatcaggtacacgccgaccagattgctcgaaccattgctttgcaattcggacgccagattgctcactaactgctggtattggtccgttccagttagattcgaggcattcagatgcttctggacgcgcacaatctgcgatgagaaatcgctgcgcgagtcatccgtcgcctgcttcagcacggatcccctgatgacgtacatggaaaacaaagacagcaacgcggccgtcagcaacaccaccagcatcgacacggccaccgttctcgcctgcaatgatcggcgcacctgctgtctgtcacgatgccagatacaccacactcgatgggttctcatcagcatggttcgcttataccgtcggggctacgaacttgtatccgatcccgcgcacggtctgcacgatccgcggattctccggatcggtctccaccttcatgcgcagccgttgcacatgcacgttgaccaatctggtatctccgccactttcgtatccccaaacacgtttcagcaagttcgcacggctcagggcttcacccgcgtgagccgccagcacgtacagcaattcaaactccgtcggcgtcagctgcagatccacaccatctttggcggcggtatgctcagccctatccattacgagcgtgccgcattgcaatcgttcagtcaggtcgccctcatccttgcctgcaggcgcgtttaccttgggcatgcgcagccgagccctgattctggccataagctccaccacctcgaacggtttggacacataatcatccgcccccgcttccaggcctttcaccacatcggtggtgtcggatttggcggtaagcatgatgatcggcgtattcgagttctgccgtatgcgttgcgccacctggacgccatccaaaccggggagcatcacatcaagcaacatcaaatccggctgcaatatcgggaacatttccaccgcacgccacccatccaagcaggtcacggttttaaatccttcgctctccaatacgatggatagcatctcgcccaaagcctgatcgtcgtcgacgatcatgatcaatcgttgattagactcatcctgcatatttcgcattgcttcgtcattcccttcaacactgcgtccaagtttgcccagactcgccctccacgttgagcacgaacgtatgttaacgttcactaggtcagcattgtacacggatatgggtgaactcgtcagcggcgggaagaaacgatcagcccctatcaccgttcttctcatgcaggattttgcgaattttctccagtctcggtttgatctcatgctcgtagccgcgatcgttcggatggtagtattcccgccctgccagctcgtccggcatgtattgctgcggagccacggctcccggccaatcatgagcgtaccgatacccctcatgattgccccaacttttcatcagggcggtcggcgcattccttaggtgcaagggtacctgaccgatcaatcccgcgtccacatcggcgagcgcgctgttgatggcgttgtaactggcgttcgacttcggagcggtggcaacggcgagcgcggcttccgcgagaatgatgcgcgcctcgggcatgccgatcatggacacggcttgtgccgccgcgacggtgacctgcagtatctgcggagccgccataccgacttcctcggaagctgcgatcataatgcgccgtgcgatgaatcgcggatcctcgccggcgcgcaacatccgtgccaagtagtgcatggtggcgtccgggtcggatccacgcatggatttgatgaatgcggaaatcacatcgtaatggtcgtcgccgtctttgtcatagcgcacggtggccacgtccatgacctgcgataccacgtcgggagtgatgattggccgtttcgtaccttttttgcgtgctttgtctccggtaagcgcccccgcggcggcttcaaggatcgtcagtgtttttcgcgcgtcgcctccggccatacgcacgatttcgtcaacggcttcgtcgttgattttgacttcgtttttaagcccacgctcgctttcgatggccctcttgatgagcgttttcaggtcgtcgggttccagcgattcgagtttgacgaccacggatcggcttaacaacggtttgatgatggaaaagcttggattttccgtggtggccgcaatgaaagtgacgtcacggttttccacgcttggcagcaatgcatcctgctgcgatttggagaatcggtgcacttcgtcgatgaacagtaccgtttccttgccctccgcgacaagacgatcatgggcgcgtctgagtacatcccgcacgtccttgacgccggaggtgactgcggaaagctcttcgaagactcgaccggactgtttggccacaatataggcgagcgtggttttgccgactccgggaggtccaaacagaataatggaactcggcgcggtcagcgagcctttggacgccggattggcgagtctgcgcagaggagagccctgtcctagcacccgcgattggcccaccacttcgtccacgctcgacggacgcatgcgcacggccagcgggcgtgtcatatcttcgggagcgtccatcgcaccaaacaaatcctcagtcataatttctactgtaccgcaacatacgcaataattcgaacacacgttcgacatttgagttcatgccagccgctagactggcaatcatggctgacgatacgaattacggttctttgggcgccttggcgccgaattggagcgatggcgagcgcaacatcgacacggacgagatctacgaacgctttttcgagtgggtggcggacgtcaaaggtgttgagccgtggccccatcaggaagaggccatcatggacctgctcgcgggcgatcatgtcattttgaacacgcccaccggctccggcaaatcactggtggcgttgggtatgcatttcgctgcgttgtgcacgggccgtcgctcgtattacacggctccgatcaaggcgttggtgtctgagaaattctttgatttggtggaggtgttcggtcgtgagaacgtcggcatgatcaccggagacacgcacatcaacgccgatgcgccgatcatctgctgcactgcggagattcttgcgaaccaggcattgcgtgagggccgtcatgccgatgtcggctgtgtggcgatggacgaattccattattatggcgattcggagcgtggttgggcttggcaggttccgctgctgacattgccgaacacgcagtttttgctgatgagcgccacattgggcaacgtcgatgcaatcgccgacaagttggaggacatgacggacacggacgtcgacatcatcgccgatgcgccgcgtccggtaccgttgacgtacgagtacacgcttgacccgttggagaaaaccgtcgaactggcgttcggcagaggggaaacgccgatctatgtggtgcatttctcccaagacgccgcattggagacggcgaacgccctggcgagcacgggagtgtccagcaaggagcaacgtgcggccattgcggaggcgatcaagggcacgaagttcaccacggcgttcggtaagattctgcagcgtctgctgcgtaccggcgtgggtattcaccatgcgggcatgcttccccgctatcgccgtctggtcgagcaactcgcccagcagggtcttcttccggtgatctgcggcactgacacgttgggtgtcggcatcaacgtgcccattcattccgtggtgttgaccgcattgaccaagttcgatggcacgaagatgcgcaagctgcgtgcccgcgaattccatcagatcgcggggcgtgcgggacgtatgggcttcgacacggagggcttggtcatcgccgagggtccggaattcgaaatcgagaacgccaaggccctcgccaaagcgggcaacgacccgaagaagctcaagaaagtcaagcgcaagaaggcgcctgagggcttcgtcacgtggaatgagagcacgttcgataagctgatcgacgcggaccctgaaactttggtgccgcatatgaaggtcacgcattccatggtgttgaacgaagtggcgcagggcggcgacgcacgctaccgcatcgatcgcctgatcgacgattctgcgcagactccggaacagaaggagcgtcttcatgatcgtgccgacgagatcttccagaccttgttcgacacgaatgtgatcgaaacgaaagaccgcgatgatggtggcaaggactatttcatgaccgtcgacatgccggatgatttcgcgcttgaccagccgttgagcccgttcctgctggctgcgttggaactgcttgatccggaatcggaaagttacgcgcttgacgtgatttccatggtggaagccacgttggaggatccgaagcaggtgttgcgcgcgcaggaacgtcaagcccgcgacgcggcgatgatccgcatgaaggaagacggtcttgactatgacgaacgtatggaccgcttgcaggagatcacgtatccgaaaccattggaagacatgcttcaggctgcgttcgacgaataccgtcacgatgtgccttgggccaatgattattggttgagcccgaaatcggtgatccgggacatggtcgaaacggcctccgatttcaccggttacatcgcgcgctacaatatcgcccgctccgaaggcacgctgctgcgctatctgtctgacgcatatcgcgcgttggcgcgtaccgttcctttggagaagcgcaacgaacagttacgggacatcatctcctggctgcgcgttgtggttcgttccatcgactcctcgctggtcgacgaatgggagaacgcgggagccggcaccgacgcttccgaagccgccgcgaacctggccgcgcccggcgcgaagcaggccgtggtggaggatcgtcgaggcctcaccgtgctcgtgcgcaacgccatgttccgccgcgtgcagctcatggatctcgacaaacccgacgagctcggcgcgcttgacaaagactggggttatggcgtgcacgaatgggaggatgcgctcgacgacttctacgatgagcacgaatacgtcaacacggatgcgaaggcccgtagccgcgaactgttcatcctcgacgattccaaggagaacagcgagcacagttggaaggtacgtcagatcatcgacgattccgatggcgaccatgattgggccatcaccggaaccgtcgatttggacaccacacagtcgagcggcgaagtcgtgttcttcgactacagcgtttccaactgacgtcgcatctcgtcggcgtcgacttccaggggcggccagatcatgttcatgttcttcaatacgttacggagcagttcagacacaaccgcccttgaataccaacgattgtcggcaggcaccaggtaccagggcgcctgctcggtgctcgtacgcgcgaacacgtcctgccatgcggccatgtagtcgttccaacgggcacgcgcttcaaggtcgctggggtcgaacttccaatatttggtcggatcctccagcctgccgaggaaatgctccttctgctcttctttgctcaccacaaggaatattttgatgatggagcatccgtccgcaaccaattgcgattcgaatcggttgatttcgtcatatcgcgcctgccatacctcttccggataggttttgtaaatgcgcggcatgacgatatcttcatagtgcgatctatcgaaaatggagatccaaccattctgcggcagttcccgtttgatgcgccacaaataatcgtggtccttttcctcgcctttgggagcaccgaaaccgtgataatgcatgcccatcggatcgccctggctgaatacgtgacgcacgatgccgcctttgccggaagcatccatgccctgcagaataatcaacagacgacggcgggaacctttcactccattggcgtacataagccgctgatatcgtgcgatttcagaagaactgatcgcaatgaatcgttccgcatcatctttgttgccgtcgaaacccggcgtggaatcgccatcgattgcagcgaccctcgtatcatgatggaatcgcaataactgactgggcggaagcgtccacacggaactgagcaactcgctggccttggcaacattcgcaagcccttcggcaacggaactgcagttctcccccttctcaagcctgtcctcaaccttgttcaacgtcttcgcaatggacgacgtcttcgcatccttgtctttgtctgacatgtcaagcctcctcgcttgtcccctatgatagacgatgcggcgattgaaccgtggcatcgccgcacccaatcgccgcatcccgcttttctgacgttttgtctgacttctttcacgcaatagggcgctgattcctcgctctttgcaagaaaccagcgccctatcggtcttctcagatcaaatgacgtcactgcttgggcttatcaccctttgatttgtctgacttcggcttgtcgaatctcagcttgtcctgcttggacgtatctttgatcggcctgccgttcttatcgaactcgacttggctttccggatgcgtctcatcgaatccctgaacatagcgggtctgacgccaatggcgaatcgacgcgttggaaccacgatggtgcacatggtacaggcgctgggcaccgccaagtggcacaccttccctagccacggcgatctggttcacgttcgacggatccataatggcgatcggagcgaccggttccggttcggcaggtgccgcagtgtgcttctgcatgcgttccggcagccattccgcaagacggctcagcagccagcatgcgatgaagtagatgacggcagccacaaccaatgtctgcagaatattgaagtacatcgaaccaagtcgacgcgattcctgcagcaaatcggtgtacatgatgatcgagccgagagcggtatccttcagtaccaccaccaactgcgtcacggcggcaggaagcatggcgtagatggcctgtggcacttcgatttccatcagcgactgcgtgcgggtcaagcccaaggcgagcgacgcctcacgctggccgttcggcaggttgccgacaccggaacgaaccagctcggccaccacggaaccgttgtagatcaccaatgcgagcaccacagcccagtatgcggggcttgacatgcctgcgaaagcgaaccaacgccagaagaagatcatgagcagcagcacagggaccgcacgtgcgaactcaacgatggcgccggaaaccgcacgaatcacgatattcggcagcagacggccgataccgaaaatcagaccgaacagcactgcgccgatcactgccaacacggaagctcgaatcgtggcccacaatccgggcagatagaaatcggtccatgcttcagcgtcaagcgccggcttccacaactcccagctcagctggttctcgccatccggcggattgtgaagcctcatgagaatgagcacaactacgattgcaaagacaatgccggcaatccagttgacgatacgaatggttttacgggtcttaggaccgggctggtcgaacagcaccgcgctttcatcgcttgccatggtgcgtcacctcctcaccgcgagcttgttggacagatacgtggtcagcatgccgatcggaatgatcagaatcacataaccgaatgcgaagatcaggaagatcggaacaatcacgtcggaacggtattcgatcatttcgctcatcaacgacgaggtttcggtggcgacggaagccgcggccgcaaccgtggaattcttcagcaatgcgatcaacgtgttgcccagcggtgccacggagccacggaacgcctgaggcagaatgatctgggtggcggactgcatgaagttcaatcccagcgcacggcaggcttcagcctggccaagcggcacggtgttgatgccggatcgcagcgattcgcacacgaaggccgccgtatacaggctcaaaccggtgacggcaagccagaagaagttggtggcgaacgtgtcggagaagctgagcttcagctgcgcgtaggcacccagcaccatgaacaccatgatgatggtcaacggcaggttcttgaacagctcgacgtaagcacccgagaccatacgcagcgacgcgaccggcgagatgcgcatcatcacgaggatgacgccaagaatcgtggagaacaacgccgaccacagggtcagttcaatgttcaccaagaacgcagccggcacattgtactggctgaacaatgagatgaacgcttccattatctctccccctcagtcggctccggcggattgtacttcgcgttcggcgtgtatgcggtgcccttcgtgttgtcggaaatggcacgctgccaagaaccatcctggatcatatcggcgatggcgttgttgatctgggtggccagcttcgtatcgcccttcttgatgccgacgccgtaatactcctgggtgaacggcttgccgaccacgcgcagacggccgcgggacgcggaggcaagaccagccaaaataatgtcgtcggtggtcaccgcatcaacaatgccagagaacagtgcggtagcgcactccgcgtaaccaggctgctccatgagctgcacttcgttggcgaacttctccttgacggtgaccgcggaagtggaaccggttacggagcacagacgcttgccattaagatcctccggaccattgatggaggtttcatccttacgcacgagcagatcctgacccgcaacgaagtacggtccagcgaaggagacgaccttcttacgttcgtcggtgatggaatacgtggcgacgatgaaatcgacatcgccattctgcagcatggcctcacgctgcttcgacggtgcctccttccatacgatctggtcttcggaatagccgagtttcttggcgatgtacttggccacatccacatcgaagccgacataggtgccggacttcttgaatcccaaaccaggctggtcgaacttgataccgacgcgaatcttgccatcggcgtcgtccgcgccacaggcggacactgcgaacacgcatgcgcatgcgcagaaggtcgctataaccctgcgtagcatacgcttcgccctcatagaaagtctcatatcgaaaatccttcttctgtcttattcccgtcagtcatttcagtgggtgagaatcttcgacaggaagtccttggcacgatcggtcttcggattttcaaagaagtcctccggcgtgctctgctcaagaatctggccgtcggacatgaacacgaccttgtcggccaccttgcgcgcgaagcccatttcgtgggtcacgcacagcatggtcatgccttcgtgagccagctccaccatgacgtcaagcacttcattgaccatttccggatcaagcgcggacgtcggttcgtcgaacaacatgaccttcggctgcatggcaagcgctcgggcgatggcgacacgctgctgctgaccgccggaaagctgcgatggcatcttggaagcctgcgaagccactcccactcgggagagcaggtccatggcgagatcctcggccgccttcttatccatgtggcgcaccttgatcggcgcaagcgtcacattctcaagaattgtcttgttggcgaacaggttgaacgactggaacaccatgccgacctcggcacgcaggctggcgagctccttgccttcctggggcaatggcttgccatcaatgcgaatatcaccggaatcaatggtttccaaacggttgatggtgcggcacatcgtggacttgccggaaccggatggaccgacgatgaccagcacctcgcccttcttgacggtgaggttgatgtccttgagcacatgcaagtcaccgtagtgcttttcaacgtgggtcaattcgaccagcgggcggtcgctgtcttccgtacccggcatgatcgggcgcgtctcttgcgtttctttgatatctgtcatacggatagtatatgaaagccatgtttccgcggccgtcaccaccccctgacgtgctcgaaatatgagacaacgttgtcccaaaatgcatcatagcgcgttatcgaccgcaataccgatatcttgagcgccgtacgtggcagctaccaccatcgtggcaattcgatagccagcaccgctattacgaacaatacaaccaccgcaccgaacaccactcgttcgggcaccttggatttgaaaccatccacaacgcgacgccacgtatcaccaatgctcatgcataccaacgtaggaacgccaagcaacgagaaagagccgaacaggcgaacgcaagatgaatttcaccctacattcgcctgtcttttacatgcagattcgtatgaccatccgtcacacgatcgcagcatttcatccgcgatcagcgattaagcaatcgccggggccaagagagcactcagagcactttggaaaggaacgtcttcaatcgttcgctctttggatggttgaagatctcgtccggagtgccttcctcctcgatcacgccggcgtcggtgaagatcacgcgggtggccacttcgcgggcgaaacccatctcgtgggtcaccagcaccatggtcatgccgtcttcggccagctcacgaatgacttcgagcacatcaccgaccatctccgggtcaagcgccgacgtggcctcgtcgaacagcatgaccttcggacgcatggccaaggatcgtgcgatggcaacacgctgcttttgaccgccagacaacgagcgaggcatgacatcggccttttcggccaatcccacggttttcagcaatgccatcgcatgttcacgcgcctgctcgtcggtttccttgtgcaccagtttcggcgcaagcgtgatgttgtcaatcacgctcatgttgttgaacaggttgaaatgctggaacaccatgccaacctgctctcgaacctggtcgatgttcacatgcggatcacccagatcatgaccgttgaccacgatctggccgctggatgcctgttcaagtccgttcaggcaacgcaacatggtggatttgccggcaccagacggtccgatgatacagatcacctcgcccttgcgtaccgtaagatcgacgcctttgatgacttccatatgaccatagtttttatgcagattcttgacgtcgatgatcacttcgccatcattgttgccgtgattgcagttctcgctcatcgattcaccttcctgtcaacgatattggccagccatgtgaggatggtgatggccacgaagtacatcacaccgacgatcagcaacgtttcggtgacgcggaagttcgccgcatacaattgctgcgcctgatacagcaattcaccaaagccgatggccagcagcagcgaggaatctttgatcataatgaccagctggttgatgatcgacggcatggcgattgcagtggcctgaggcatgatcacgcgcgccatggcctgatgatggttgaggccaagcgatcgtgctccctccatctgaccagagtcaacggactgcacggcgccacgcacgatctccgccagatatgcgccggaattgagcgacaacgtcaacgcacctgcaacccaaatgttcacactgtgtccgataagctgcggcacaccgaaatagaagaagaacgcccacaccagaatcggagtgccgcggaacactgcgatataaaccttggacacgcctctcagaatcttgttctccgatactttcatcaagccgaaagcaacacccaacgccagtgcgatcacaaacgacagcaacgtgatcaacagcgtgttcttcagaccagtcagcaaagccggcatcgactgtttgaccagaccaaagaaaccgaccttcttctgcgcctcaccgtcggcaccgttgtcggtgaccttgccggaaatcgcctcgacctgttccttcgcgccatcggcacccaaatactgtgcgacaatcgtctcatactcgcccgaagcgatgagcttgttcagaccatcgtcgatggcggccagcagatcggcgttcttgcctttgttcacggccatgccgtattcaccatgcggcaccttcggagtcacgatcttcaaaccgttgttttgggaaacaccgtaggcaagcaccggatagtcgtcgaacacggcatccgcattgccggatttgaccatctcatacatggttgatgactggtccacggaagtcacggtatagccgtattcgcttgcatgctgtttggcgtaggattcgccttccgatccggttttcgcgacaacggtcttaccgtcaagatccttgtagctggtaatactatcgttgttttcagcgatggccatctggataccggactggaagtaaggattggaaaaatcgtaggtcgccttgcgttcgtcggtgattgacatgcctgcgatcaccacatccacctgattggagctcaaagcctgcaatgctgcattgaaacccaatgattggatggtgacttcgaatccttcttcttgggcgatggcacggatcagttccatatcgataccggtcatcttgccgttctcgcgatattcgaacggtgcgaatgtggtatcggtgccgaccgcgtaggttttgcccttgactgcggagggatctccgacttcggcggcgttagcactaactggggatgcgatgagtgcactcactgccacaatcagtatcatcgccaacgcgagaagtcgcatccagacaccatgaaaatcatgtttttccaacgattgcttcaaattcatactacagattcagttctttctcataatatttcagatactcatctttactccaccataccggcagcaagagaaaatagacagcgtaaacaataaaaacaggctgtccttgcacggtctctcatgcaaagacagcctgttatctcaaagcgaaaacactatcagtcttcgtcttcttccggatcataatcaacgccggtttccgcacgctgttcgtcggaaatcggagccggggcgccggtcagcggatcacgaccgccgccagccttcgggaaggcgatgacgtcgcggatggagtcggcgccagccaggatggcggcggtacgatcccaaccgagagcgatgccagcgtgcggcggagcgccgtacttgaaggcttcaagcaggaagccgaacttgtcggcagcctcttcaggagtgatgccgagcacatcgagcacacgatcctgaatgtcatcacggtggatacgcacggaaccgccgcccatttcgttaccgttgcacacgatgtcgtaggaatcagacatggcgtgttccggatccttgtcgaaggtgtcgatccaatccttggacggcatggtgaacggatggtgcatggaggtccacttggagtggccgactgccacatcgtcgtcatccggatcgtcggtgggcttgaacagcgggaagtccacaacccaagtgaaagcgaagtcgtccggcttgagcagaccggcgcgatcggccagttccacacgcacggcacccagcagctcctgagcggaggtgcgacggcctgctgcgaagaacacggcatcgccgtcttctgcgccaacggcttccttcaggccagcgcgctcctcttcagacaggttcttggcaacaggtcccttgagctcgccgttctcagcgaacaccacgtaggcgaggcccttggcgccgcgctgcttggcccaatcctgccaagcgtcgaactggcgacgaggcgtggccgcgccacccttgaagagcaccgcaccaacgtacggagcctggaacacgcggaacggagtgttcttgaagtagtcggtcagctcgatcagcgggttgccgaaacgcagatccggcttgtcggagccgtacttatccatggcttcctgccaagtgatgcgctgaatcggcagctggatctcatagcctgcggacttccagatggcggcgatgaccttttcggccatggccatcacgtcttcctgatccacgaacgccatttccatatcgagctgggtgaactccggctgacgatctgcacggaaatcctcgtcacggtagcagcgggccagctggtagtagcgttccacgccggaaaccatcagcagctgcttgagaagctgcggggactgcggcaacgcgtaccaagaacctggcaccaagcgggccggcaccacaaaatcgcgagcgccttccggagtggacttgatcatggtcggggtttcgacctcttcgaagcccatctcttccagagcgtggcgagcagccttcgacatctgggaacgcagcttcagattgcgctgcatggacgggcggcgcaggtcgagataacggtacttgaggcgaacttcctcgcccggcagcttgttctcggactcgttttccaacgcggtggacacctggaacggcagcgcgtcagacttggcgagcacctcgatgttttccgccacaacctcgatcttgccggtggccagatgatcattctcgttaccgtccggacgcaggcggacctcgcccaccacctgaatcacaaactcggagcgcagcggacgtgccatgtcttcgtcgtagataactacctgcacaagaccggtgttgtcacgaagatcgatgaaggccacgccaccgtggtcacgacgacgatcgacccaaccggagagcgtcaccttctgaccgacgagttcctcggtcacttcggttgcatgatgtgttctataagccgtctggctcatgcttcccctattccttgttctctaatgattgaagtcttgcgatttcaggcttctacggtaacggtttgctgggcatacacagtatccggctcccaagactgtgcgttggccggctgctggtcgcccgtgatgatgttcttgacttcgtccgaagcgtcctgcgcggacttgtccgcggggaaccacacgtatgggatgccgagcttgtcggcatacttgatctgcttgccaagcttggctgcggtcggagccacatctgccgcgacgccacgggcgcgcagctggttggcgatttggttggaagcggaacggtcctcctcgttccacacggccacgagcacggaagccggggacacgcgattcgcgtgggcaccggcggtgtgcagcatgtatgaaacgagacgggacaggccaatggacaggcccacgcccggatacttcctgttgccctgcgatgcgagattgtcgtaacgaccgccggaacagatggaaccaagagccgcagcaccgtcaaggaacgtctcatacacggaaccggtgtagtaatccagaccacgcgcgatcttcaaatcagcgatcacggagcccgggcgaatacgagcggcctcgtcaacaatcatcgccaacgtgtcaagaccctgacgtgcgagcacgtacgcctcggaatcattggcaatgccatgcttctcgcacagcgtgtcgaacttgccggacagttcagcgccgtcagctgcggtcagttcagccagctcaaggcacgcacgtgcctgattctcgtcggctccacagccttcgaccagcaacttggccacttcgtcggcaccgatcttgtcgagcttatcgatctcacggagcacgccctcgacatcggtcaagccaagaccacggtagaaaccttcagaaagcttacggttgttcgcatgcacggtggccttcggcaaaccgaactcacgcagacgttccaatgccgataccatgaccagcggcagctcgacctcgtaatgatcgggcagatcaccgttgccgatcacatcgatatcggcctgcacgaactcgcggaaacgaccttcctgcgggcgttcgccacgccagaccttctgaatctgccaacgcttgaaagggaatgccaaatcgccggaatgttcgaccacataacggctcagcggaacagtcaaatcgaagtgcagaccaaggcggtcctcaatcggagtgtcggactcatgaccgacctcctgaaggcggctcagcaggtaaatttccttgctggtttcgcccttcttgagcagactcgaaccctgctcaacagcacgagtttcaatgccaatgaagccattgagctcgaaaacttcacggagcgtgtcgataacacgctgctccacaacacgttcagaggggagccactctggaaatcctgaaatagatgcgccttttgccacgattccctataataaatgaggttgcggaaaatgcagcgcgtttttcaggctttgaaagcacgttcgcacgatccgcatcccctgcactacatgaagcttacttaaaggagctggccatggccgacgagaatgtcaccgcgtccgagaacaccaatgaaaccaccgagcaggcaacgacgcccgcagtcaaggccagcaaaccggccgttccgagcccggcttcgatgaagccccatgctccgagccccgcggccttcgccaagaaagctccacagcacaccgctccggctgccgcatccaccggcttctccgatgccgatgtgaagaccgccgaagcattcggccgtgtcgccgacgatggtactgtgttcgtcaaggacggcgaaggagaacgtgaggtcggtcagttccctgatgcctccaaggaagaggcgctggctctgtatgcccgccgttaccttgatttgaaggccaagttggacctgttcgcgaacaagctcaagtccaacaatgtgaagtcccgcgaaatcgacgagaccatcaagacgctgtccgcggaaaccgaacagccggcagtggtgggtgatctggccgctctcaaggcccagttcgaggcgctgaaggaggaaggcgcagccaagaaaaccgcgttgaccgaggcacgcaaggccgctatcgccaaggccgtcgaggagcgcaccgccattgtggagaaggccgaggcgctggctgattccctcgacgagaacaccaactggcgttccaccgcagacaagttccgttcgctcttccagcagtggcaggagcatcagcgcaacaacgtccgcatcgacaaggaagatgcggacgccctgtgggctcgtttctccgcggcccgcaccaagttcaatttcgcccgccgcaagtgggtgcagaaccgtgacgaagagcgtaattccgccaagtccaccaaggaagccatcatcgccgaggccgaggcgctgcaggattccaccgcttgggttgaaacctcccgcaagttcaccgagctgatggatcgttggaagaaggccggtcgtgccggtcgtcgtgacgatgatgccatgtgggagcgtttccgcgccgccgcagacaccttcttcaacgcacgtcaggccgatcgtgaccagatcagctcctccgagaaggaaaatcttgccaagaaggaagagctgctggtcaaggccgaggcgctggttcccgtcaaaagcgaagaagaggccaagcaggcccgtcaggctctcgccgccattcaggaggagtgggaccagatcggttacgtgccgcgtgacgaagtgcgccgcatcgaaggccgtctcgatgctgtagacaagcagatcaaggccattgaggatgccgcttggaagcagtccgatccggaagccgacgcccgcaagtcctccttcgaagaacagctcaacgctcagctcgctgagcttgatcagaagatcgccgcggaatccgatccgaagaagaaggccaagctcgaatccgagaaggccaccaaggaacagtggctgaacgccatcaagtaagtcgcacatcctgatatttggttgcgccacagagatgcggtcaaatatcagctggacttcactcaggcataatcaagaaggctggtacgtaacgacatccgtcacataccagccttcttcgtataatcgcacgtgttctcacatgcgcaatcaccatacagaatattcaactatcattcgccgaattcggtagcacaaatatcggccaccgcatcaatgcaggcatcgacgatgagcttacctcgttcggcgctggaacctgcaggagtggccagtcctccgtaatccggaacgtcgcccttgcgcaccgggtagcgcacgtaagccttcggtgtgacattgccttcgtcaatcacacggtccatatgcaccaattccggctcgtaatgcatcatcaatgaggtttccgtcactgcggcatgttccaacgcccaaccggggaacacgagtccgtcgaacacctgctcgaccacgttctccggcagcggatcccaccagttggtttcgacgatggtggccactcccctggtttcgcgggtgatcagatcgattgcctcgataatgaatgcctcgttttcgaaatgcgcgttcatcaccacgattttggtgaaaccgtccgcgatcagctcgccaagcacatcatgcatttgattgatcaccgtcacaccgttcatgtcgatggtgccggggaacaatgggccgcctccggaaagcggcttcgacttgtacccgtagttcatggtcggtgccacgatgccgtcgatgcgttcggcgaggtcttcagacacatggctggcgatcatggcgtccacaccaaggggaagatgctggctatgctgttcggtggagccgattggcacaataaccggctttgatttcgatgcttcgatttccggccaggtcatatggtccatccgacggctgctgctcatgattgctcctttatgtgctgttgttggtttgcgtttcaacaattgataatgattgcgatgatgccgtccccgcgaatcgatgttgcaatcgatgtttcagggacggcgtttattgtttcgaggaattgtttcgtaaaaaccgtttcttctcagatgcggctcagatccttatccgtgttttcgtgagagaggatcatggcgaccagtgccacggcggccaccgccaccatgtaccaggccggagcgatgctcgaaccggtggtgtagatcagccaggttgcgatgaacggcgcggttccaccgaagatggcgttggcaaggttgaagctgaatgcgaagccggtgaaacgaaccgatgtcgggaaggtttcagtcaggtagctcgaaagcgtaccgtcgttggcggtcagggtggcgcacatggcgagctcaacgatcagcaccggccagaactgtgcggtgttcagcgccatgaaggccggaacggtgagcacgatgaaggccacgcatgcaccaatcagcaccttcttgcgtccgaacatgtcggagatgtgacccatgccgaacaccaaagccacatacagtaccaggcagatggtggtgatggtggacgactgtgcggcagccatgccaaccgtgtcgctcagataggtcggcaggtaggtgagcaccgtgtagaagccgaccgcgttgagcacgcaggcaccgaagctgatgaccaaagtcttgaagtggttctggaacagctcgcgcagcggggagacgctcttagtggtggaagcgaactgctgcttgtcgtccaaagcttcggtcatggaagcatacaccggcgaatcagcgagcttggtacggatgaaatgcacgatcagaccaagcgggccggccatgaggaacggaatacgccatccccaagaggtcagtgcatcagagctcagcgaagcggtcatcacggtggcgagcgtggagcctgcgagcagaccgatggcggtggatgccggaatcagcgagcagtagatgccacgcttcttggtcggcgcgtattcgccaaggaaggttgcggcgccggcatattcaccggaagcggagaagccctgcaccatgcgaagcagcagcaacagtgccggagcgaaaatgccgatcgcagcatatgacggcaggcagccaatcaggaacgatgcacccgacatgaacatgatggaaatcgcaagagcgcccttgcgtcccttcttatcgccgaagttaccccaaaacagtgcaccgatcggacgaagcacgaatgacagtgcaaacacgccgaacgtctgcagcatggcgaccgtgtgattgccggacgggaaaaacaccaaagcgatggtggtcgcgaagtaggaataggaagcgtagtcgaaccattcaatgaagttgccgaggaaagacgagacggccactttcttgaccatcttctgctcttcggactgttcagacacggaagccctgttggcggttgcgattgttgcactggcactcatcatgtcacctgctttcttctgctgaatctgtctgtacgttcgcgttttcttcatacccggcgaacgttgtgactctgactatcgcccgaagtatttgcgccaaagtgaactgattgttaaaccgcaaccgtttgtttttgacgttttgccaagttccccttgcttacagcgccgaagtggaagatatggtgtgattatgttgcgatttcgccattttcgcacctaaaagcagcattgaccagctgattttatcggtaggcgctatgcccacgatctgtgtcactttgtccaatcggttgtacaacgtctgccgttgtatacctaattgctcgcatgcgccggtcttgttgtcgagattgtcgaaacaggcgcacaacgtgtcgatcagcatggcgttatgcataagctcatgcccaaccgtctgcgtgatcaccatgcgcacggcctcatcggtacgttccattcccaacatgcgttccagcaacgaggaatccacacattcgagggttccatacgggcattccgcatcgttcgaaatgcatgttcgaatcacactgcgcaacgcaccgaacgcgtccatcaatgaaatcgtgtccaacgctgcgcgtccatgcacggtatatacgtattcgtttgcagcgacttgcgtcaacgcatgcaaacaccgatctgaaaataccgacacatcgccgccgctgtcttgcgccgcgagaaaaccgatcattaaatcgccttccaacaaacagatcgattcgcaaccgccgttggattcgaaatcgtcgatcatcgacacgattgccggcatggcgttggccaccgacttgagtttcatggcaaatggcatatacacgcccgaagcggcgaatcccaacgcatcaagcatggcatggccctcacgcgcttccatcgacgaaacatgcacgccatcttccggccccgcaatcagatgcgccaccatgccgacgcgcgctcccccatcgagatacagtgtcaaaaccggagcggcaatctgttcgatccttctgcacatcgcttcatcgaacaccgtattgcgctggctgatctccaaagcacccaaaggccgtttctgttcctccagtgcaagtacaatgccgcaatctgtagcggtattgatgttctgtccggctcgggcgacttcaagaccgtccacgtcgaatatgaccacatcctcgccgaacaggttcgcaatgccatcggcaacggctttgggattggacgcttgagcaagctcagaacgcaacgaagttgacataacgtccacttgcatctgcatacgcatctgatcacgcacaatcatggtattgacgctctggcagatatcgacgaaaggaatgcgacggcgcaatccaataatcgtaagtccttcatgcttggctgccttcaccaacattttcggcagttgggtgacttcttcaaccaattcgaccatcaatgccgcaatatcagcattcacgaggcttttcacatattcgtccgcacgtttttcacgaccgtccgcaactaaagatcgcccctccaccaccagaagctcacctcctgccagaaatgaggcgacgtcctcgcgttcgttggtgaacacccaacgcaccggattatccaagctatcgccagcaacttcaacctgtggttccgccgtcgcaaccaaggcatcatcgagcacttccctcaccgtaacagtcatacaaaccgtccaatccgaagtaatacacatgtcacatcaagtaacgtgaccgcaaagcaatacgccgacaataaccatcaacgattacgtcaaaggttcccttccgtaacccaatggacatatgacaaaacgtctgccggaacccgaaaactcgcatgaaaactcgtattggaaggagtgattatgagcacgcaactgttcatcaacgcacacatcgccaccggcatgccgggcagcaccgcagccgaaacagcggcaatccaagatattctcgtcgaagacggcaagttcatcagcattgcacccaatctcaaagcaacactcgaagcacaaggcaaagatatggcgagcgtggaagtcgtcgatttgggcggaaagctggtctgtccaccattctgcgacacccatctacatcttgattacgtctttaccgcacgcaagcccggcgcggtgaacgagtcaggcaccctgttcgaaggcattcagcgttggagtgaaaccaaggcagatctcgctgtcgacgagatcaaggaacgcgcgaaaatcggcatcgccaaggaaatgcgtcatggcgtgcagttcattcgttcgcacgccgatgtgaccgacccgaatcttacctcgctcaaagctctgctggagcttaaggaggaactgaaagatactgtcacgctgcagatcgtctccttcccgcaggagggcatgtactcctatgaaggtcctcatggcgaatccgtcgcggatttggttgaggaaggcctgaaaatgggtgctgattgcgtcggtggcattccgcatttcgagcagtgccgtgagttcggcgaacgttccatgcacaccgtggtcgaactggcttcgaagtacgacaagctcatcgacgtgcattgcgacgaaaccgacgatccaaactcacgttatcttgaactgctgtccgcactcgcctatcgcgccggtatcggttcgaagaccacggcaagccacacttgctccttgggatcggccgacaatgcctatttcttccatctgaccaagctgttgaaggccgcacatatcaatttcgcctgcgcacctacggaaaatctgtatctgcaggggcgtcaagacacgttcccgaagcgtcgtggcatcacgcgagtcaaggagctcaccgaagctggggtgaatgtgtcgcttggtcaggattccatgcaagatccctggtatccggtcggtaacggcaatatgatgctgattctcgattatgtgctgcatttggcgcagatgatgagttttgaagagatcgatgatgcgttgaagttcctgacagtcaacggcgcaaccacgctcggcatgcgcgattcgtatggtcttgaggcaggcaagcccgcaaacttcattgtgcttgatgcttccagcgtgttcgacgccgtatacgagcgttgcgaagtgcttcgctcggtacgagagggtcgcacactgttcacccgtaacacgtcaatcactgccgatctcgatctgctgacactgtaattcgtcaagtttcgaaatactttcggcatacgaaaggccttgaaatcattacatacgatttcaaggcctttcgtgtgtcgcgttacttacgcaccgattgcttattcaacagattctgcggattccgtaagttctgtcgattccgtcgattcggcaggtgcctcggtttcagctgcgacttcaccttcagcaggctccgtatttggctcttcgaacgcctcaccggtaaaggtgaactcgcccaggatgccttcgccttccgcatcgaccttcacgcgctggccatcttcgagttcgcccatcaggatcttctccgaaatggcgtcttcgacgtcgcgctgaatcacgcgacgcaacggacgcgcgcccagcagcgggtcgaagcccttctgcgcgagcagatccttggcagcgtcggtaagctcgagggacatgtggcgatcgaacaagcgatcattgagctgcttgacgtcaagatcgacgatctgacgcacttgcggctcggtgagctgcttgaacacgatgatgtcgtccagacggttcaggaattccggacggaactgctgcttcagctccgcggaaacctgatccttcatgcgctggtagctcgactcggtgttggcacccaagttgaagccggtgttggcggccttggcgatgtctcgcgtaccaagattggtggtcagaatgatgatggtgttcttgaagtccaccttgcggccctggccatcagtcagatgaccgtcatcaagcacctgcagcagcgtgttgaagatatccggatgggccttttcgatctcatcgaacagcaccacggagaacggcttgcgacgaaccttctcggtgagttcgccgccctcttcgtaaccgacgtatcccggaggagcaccaaacaggcgcgaagccgcatatttctcggagaattcagacatgtcgacacgaatcagtgcgtcctcgtcgtcaaacaggaattcggcgagcgtcttggccagctcggtcttaccgacgccggtggggccagcgaagataaacgaaccggacggacgcttcggatccttcaaaccaacacgagcacgacggatggaacggctcaacgcggacacggcctcgtcctggccgatgatgcgcttgtgcaactcactttccatggtcatgagcttcttggactcggcctgggtgagcttgaacaccggaatgccggtggtctgggaaatcacttcggcgatgacatcctcatccacaaccatcttcacatcggattcgccctcacgccacgaagattccttctgcttgcgttcggcttccagcttctcctgcttatcacgcagctcagcggccttttcgaagtcctggcccttgatggcctggtccttctcttcggcaagcttggcgatcttcgtgtcaagttccttaagctccggcggagcggtcagacgacggatgcgcagacgcgcaccggcctcatcgatcagatcgatggccttgtctggcagatgacggtcctgaatgtaacggctcgacagatcggccgcggcctgcaacgcaccatcggtgatcgtcacatggtgatggttctcgtaacgcgaacgcaagcccttaaggatctcgatggtttcggcaatgctcggctcatgcacctggatgggctggaaacgacgttccaaagcggcatccttctcgatgtacttacgatactcgtcggtggtggtggcgccaatggtctgcagctcacctcgcgcgagcattggcttcaacatgtcggaagcgccaagagcgccatccgcggaaccagcgcccacaatggtatggatctcatcgatgaacagcacgatgtcgccgcgggtcttgatctccttgagcaccttcttcagacgctcctcgaaatcgccacggtagcgcgaaccagccaccatggatcccagatccaacgaatagacctgcttgcccttcagcgtctccggaacgtcgccggcattgatcttctgcgccaagccttcgaccacggccgtcttgccgacacccggctcgccgattagcaccggattgttcttggtacggcggctcagtaccaccatcacacgctcgatctcactcgaacgcccaatcaccggatcaagcttgccggcggcagcttcagcggtcagattgcggccgaactggtcaagaatcgcggaaccggtctggttgcgacgatcctgcacgccaccggcattggccaaatcgcccttgccatcacccttgccatcaccggaattgccacggatcaggtcgatggtggcgctgcgcagctcgccaagattgacgtccatcttgatcagcacctgggtgccgacgccttcgccttcatgaatcagaccgagcaggatatgctcggtgccgatatagctgtgccccagctgcaacgcctcacgcagcgacagctccaacacctgcctggcatgcggggtgaagggaatgtggccgttcggcgtggcattccccttaccgatcatctcttcgacctgtttgcgggtgtcatccaaggtcacaccctttgaggccagcgccttggctgcgacgccgtcaccctcacgaatcaggccaagcagcagatgctcggtaccgatgtagttgtgctggagggtacgagcctcttcctgcgccagcacgatcacgcgccgcgcacggtcggtaaaccgttcgaacatgcttgtccttccactcttgttagtccatcaacactctaccgattcgcgatgacgtttgttttcatccgcgcgtaaattgcgctctcgacgcaacgcaacggatatgcttgacatatagcaacgaccaaggaggtcaccaagatgagcgacaccaccctaaatgcaaccgaatccgggatgctcgcagatatccgcttgcacgacatcgtcgtcggcgtcgacggttccgacgaatccttcgccgcattacgctgggcgctgaacgaggcatcgcttaccggccagcaggtcaatgcggtgttcgcatggtcccattcctgggatatgggctcggaaccggaagatgaagagcagtgggccgaagtccgccatgagatcgcgcaacggcttcgcgactgggtttccaaagcttcgcagggcatgaccatcaatgaggatcatgtcaaactcacgtcggtcaaggccacaggaacgtccgcattgctggagatcggcaaggatgcgcagcagatcgtagtcggacgccgttcactcggcagagtggcacgctggttcctcggctcgctttcggaatcgcttgccgaagccgcacaggttcccgttaccatagttcgcattctcgacgacgaggaatccagcgtgcaggatgccatcgccaacgcgcttacgccttcggagaacacggtgacgtacgatttgcccggctcccctctgcctaagaaccagcggccgatcgtggttggcgtcgatggttcggaaacctcgcgacacgccttgcgattcgctatcgacctggcggctttgcatcacgctcccctgcaggtgatgttctgctggcagctcaaggatcttggcgtcatcgagggatatgagaacgccatagcgccgattgccgtcggtcaggaacgggcggaacgcattcttgacgagctgctcgattcggttgagattcccactgccggcattcccgacgatttccagatcgaatcgcacgccttccatatttccgctgcgaaggggctgatcgcggcatcccgttacgcacgccatctagtggtcggttcccgtggattgtccggcttggacgcgcatttccttggttccgtctccaagcaaatcgtcaatttcgccgactgcaccgtcactgtcgtgcactaaacctttgaggatatgaaagaagtccgcttccttacatagggaacggacttctttcatatcctcgataagacaggattactcagcttccggagcgttttcctctgcagtgtccgtttcctcggcttcggtgggttccgcatccgtcgcttcatcctcttcggattcgacgataaccggctcttcgtcatcgctcaaatcaacggtggattccacctccggctcatcctgctgggccgtatgttcgagcacttcctcctgattcgcatcatcatccacggtattggcttcgatatcggcttcggaggcttcttcctcatcgttcggattgccgtcttcattcgccgacagctgctcgatcagttcgacggaaccgcgttcatcacgcggcgcctgcgcgatgatatcgatatgcaggtcgtcaaatgcaggtttcgactgcacccacaagtgagacggttccggcggctcgatttcggaatgttcgccacagccatggtcgatggatacaacacgaccgtcatcaggactccacttgttagcgcacacgccgaacagaagattcagttcgcctttcagaggaatgaagaatccgcacgtcgagcatggattgccatccgatgttttggtggacaacgatttcggtccgcgcggtccctcataccagcgtttcgcggtctgggaacggcccaaaggcgtgagcacgtgcctgcgggacagatcgaattcctcaaccgcctcgtcgatgtcctcttcggaggtcaccgatgctacggcattctcgtcttgcgaaccgtcaaccacgtcagcgtccgctccggcattgtcgccgccgtccgccgcttcgacggtctgcacatcgtcggaaacgctttcggcagactcaacgggctcagttctgcggaacccctcttccatacgtggatcatcgggatcggtgccgatcgaatcggtcaccgccaaatcggtcggttcaagacgatccttccatggaatccattccggtgggcgcaacgccttgtcggtaggcaccagcgatgactcattgaccgtccaatggtccaactcagcatcgcgatacaacgtcaccgaccactgccatccctcatacccacgtatgcaggtttcaaaacgaaaatcagtaacgttgtctcccaagtcgatggcttcgacgaagtcaccgacttggccatcctcatcggcgacttcgatggccaccgcctgggcgatcgccttgggatccattgtggtatcggacatgaattattcctgtacgtcgaagttatcggccacggcacgcatcagcgtggccagtttcttgctttcagccggagacggataatggtggcggcgcaactggttccccgcggaatccagcagcttgataagatcctccacaatggcggccatatcatccggcttcggtcgagttgctttgaccagagacggcgcggatgccacaagggtgaggcccattgcctgcggaccacggcggccctccaccacggaatactcgacttttgcacccttacgcaacgtcttcacgccctccggcagggcggctgcaggcaggaacacatcggcaccctgctcgttctgaataaaaccatagcctttgttcgcatcgaaccaacgaacgcgtccgctaggcattgtcacctcactcttacgtaatccacataccttcaggcgaacgaaagaacaatcgtccgccgattacaaatcaaagatacagtttagcgcaagaggtgggatatgtaaccatctcttgcgccaacaatcgtcagatcatgcctttttgcatgtttgcatcattgttttttcggcctgcgcccacgcttgtcgaccttgcgttcgtcactggtctgcgccaacggacgtggttccacaggagccaccggaagcactaccgtcagtgtcaatccagtcccgtcactgccggaagcgcagatgaaaccatggtgtgccttgaccacggactgggcgatcgccatgccgagacccgtaccgcccttctgtcgtgctctggacggatccgccgtgtagaaccgttcgaagatcttcgagcgtgcatctgcgggaacgccgggaccatgatcgctgaatcgcacaattgcgtaattcatgccgacttgcatggattgccccacctcgatggcctcgataaagtgatgcaacgactgctcgttggatggcatgcgagacaatgattccgggctgatggacgccggaagcacgcccatggacacttcaaccggggaatcggccggcgtgtaccgatggatgttgcccacaatgttcgtgaccacctgacgcaagcgtgatgcatcgccggtcaacgtgatgtccggcatggttcccggctggaaggcgagacgcgaaggatgttccatatccgatcccgcctgcaataccacctggccgcaggtgatgccacgatccgggtcgagcgcgtgcagatcatcagccgcatcattgaccacggaagtcagcttcacctgctgggtgatatcgatgccacgtccttcatccaaccgcgccaatgacagcaaatcctcgacaagcaccgtcatacgcgcactggacgcttctatatgttcaatggactcatcggcacgttccaatgctccgggcatgtcacgctgcattttgtacaactccgcatatccgtgaatcgcggcaagcggagtacgcagctcatggctagcatcggaaacgaaccgtttcatcttctcggtcgtttcctcctgcgcgtggaagctttcctcaatacgcgtcagcatggtgttcagcgacatggacagcgatccgacttccgtattttccggcaaatcgggaacacgttggctcaaatcccctgccgcaatcttcgcagcggtcttctcgatacgtttcagcggagcaagcgtgctttgcacgacgatggtgccaagaatggcgccgatcaacaccaccgcgatgccgaccatggcacagaaccgcgtcaacgtgttggacgtgtcgatctggtcactcagcgacaatccgatgaacacgacgccgctgtctttgacctgccccgttttggttttctcgctccaaggcagcgccacaacacgccacggcgactgtgcggcctgcatgatggcatgatccggcaccctgctggtggtaacgtgcaccaccgcctgtgtggtgaacggctctccgagcgtgaccccgtcgatactgccgtcggaaggcagactcggctcggacaccacgccctcacggagcataggcaccgacccagcgccggtacgcttgtattcgctgtcccgcacctcgacataatacgtgttcaccaagctccgtccatcctcgctcgtggtgctgtccagcgaatccatgctattgaaaatcatctgcgcctgattcaccaactgcgtgtcggttttctgtagcagataattgcccacaagcgtgcgaatggaaaaggaaatgccgatagtgccaatggtcaacaacacaatgatgcaagtgaccagcttggtgcttaacggaatggcctgcaccttcctgccgatccgccgatgccaaggcacacgttgcagacgcggctggccgccgttcttctgcgtgttctgcgggtcagccgacggctgacgggtatcctgactcatcgcgggaccgtttagttcttcggcgcacgaatcatgtagccgatgccacgcttcgtttcgataagcggagccaccttgcgcttctcgccgttctcatcctccaccgtaagtccgtcgaccttcttgcgcagatatgaaatgtacgattcaacaatcgcggcgtccccgccccaatcgtactgccacacatgatccaaaatctgcgccttcgagagcacacgcccctcgttatccatcaaataacgcagcaacttgtattcggtggggctcaaatcgatcggctgtccggcacgggacacatcatgcgaatcctcattgatctccagatccgcgacgcggataatcggatcatcctcaacctgctcctgggtacggcgcagaatggcacggattcgcgcaacgacctcctcaagactgaacggcttggtcacatagtcgtcaccccccacggtcaaacccatgaccttgtcttgagtatcatcgcgagccgtcaaatacagcaccggcgtagtgatgccttcctgacggatacgacgggtcaccgtgaaaccgtcgatatccggaagcatcacatcaagcacaatcaaatcaggctgtattttctcgatgacttcgatggcttcagatcccgaagccgcggtattcacttcaaaacccgcaaaatgcaaggatgccaccaacagctcacggatggacggttcgtcgtcaacaacgacaatggatgcttcaataggcttgctcatgctttaagcatcactctgttcactggatgtttcctgaacggattctgagtcttcctttgacgtctgccctccatcatgcgcttcaacggacagctcaccatcgacactccatgccttcaccggctcggaacgcacagtaatcgcggcatgccttcccgcatgcttgcgcaccttgcgcttgatgatgccacgcttgcgcagaatatggaacaccaccataatcacaatcagcagcaccagcacggctatcatgccgccaacacccaacagcacggtctgcgacgacgtcgaggtcttcttctgcaccgcgatctgatccatcatatcggttgcggatttcgaccaatccggagtgctttccatcaaaggtttctgcgcagcatcggaaagcgcatcgaccgtcgacttcttcttcaaccattcgtcggaattcgacgaaacggcaaccacgagattgccatcgttcgaagcgaccgccagcaaaaccgtattcggtttcggatcaagcgattccaacagcgcgctcgcccattttgcaggtttttcttcggtgttgaaacttgccaggtacagcaaatgcacggtgacgcccgtttcctgctttgtcgcgctgatggcatccgtgatctcggcgacgtttgatccgagcagattctcagtgtcggtgatattttccgtggccgtgattccggtgcccgtattgtcttccgcgctgccgacgggagttatccacaacatcatcgcacaacacaacagcatagaaagaagcatgcaagccgctacattccaacgatttctgaagttttgccgttgtcgcgacacaccgattgggcacattttcgcacatcctccgaccacaaccctggttttttcattcatcgcgttcactgttgccatacagtccacattaccgttcagatacgtcaagtgcgagcgaacggtaccaaccgagcacacaaaagtacctggcaacgaaaggatcatcatggcacagtttcaggtggacagcgagcagattcaatcctcgagcgcggcggtaaacgcctccatccaagcgatacgtcagtcggtgcagggcatgtacgccaatctcaacaatctgcagagcgtctggaggggcggagcggccacacagttcaatgcggtggcggaacaatggcgtgccgcccaacagcagatggagcagtcgctcgaatcgattcagcatgcgctgacgcaggcatccgcactgtatgcggaaaccgaaatgcaggcatcgcgtctgtttgcgcagtagcggcaggtacttccgacgcaatcaaagcaatagctggcgcaaacaaaaagtggagcccgcgtccactatgggaaacggactccacttatagctttttgcttatgccgtcaggctttgccaaaccgttggatcagtagcccatgtcagcgccagcggccggagcggctgccggcggttccggcttgttggccacaacagcctcggtggtcaggaacagaccagcgatggaagctgcgttctgcagtgcggaacgggtgaccttgaccgggtcggtgacgccggcggccagcaggtcctcatactcgttggtggctgcgttcaggccctggccgtcaggcagggaacgaaccttgtcgatcaccacgtcgccggacagtccagcgttttcggcgatctgcttgatcggggcttcgatggcgcggaacacgatcgcggcaccggttgcctcgtcgccttcgagcttgacatcgctctcggccttggctgcagcctggaccagagcgacaccgccgcccggcagcaggccttcttcgatggcggccttggcgttgcgcacggcatcttcgatgcggtgcttgcgttccttggcctcgacttcggtggcagcgccaaccttgatgacggcaacgccgccagccagcttagccagacgctcctgcagcttctcacgatcgtagtctgaatcggtgttggcgatttcggcacggatctgagccacgcgggcagccacgtcttccttggagccgccgccggccacgatggtggtctcgtccttggagacgatgaccttcttggcggtgccgagcacggacatgtcgacggagtcgagcttgaggccgagttcgtcggacacaacctgggcgccggtcaggatggccatatcctgcagcatggccttacggcgatcgccgaagcccggagccttgacggcgcaggacttgaaggtgccgcggatgttgttcagaatcaaggtcggcagagcctcgccatcaacgtcttcagcgatgatcagcagcggcttgccggtcttcatgaccagctcggcgatgtgcacgacgtcctgctgagagctcaccttgccggaggtcagcaggatgtacggctcttcgagcactgcggtctgatcttcggcgttggtcacgaagtacggagcgatatagcccttgtcgaaacgcatgccttcggtgaagtccagatccaggccgaagcggttgttgtcctcaacggtcacgacgccgtcctggccaaccttgtcaagagcttcggcgatcttctcgccgacttccggatcggcggcggaaatcgttgcggtagcagcgatctgatccttggtctcaacgtccttggcagctgcgataagctccttgacgatggcttcggaagccttctcgataccacgacgcaaagcgatcgggttggagccggcggtgacgttcttcaggccttcgtgcaccagggactgggcgagcacggttgcggtggtggtgccgtcgccagcgacgtcatcggtcttcttggcgacttccttgaccagttcggcgccgatgcgctcgtacgggtcgtccaggtcgatttccttggcgatggagacaccatcgttggtgatggtcggagcgccgtaggtcttgtcgaggaccacgttgcggcccttcggaccgagggtgaccttgacggtatcagcgagcttgtcgaggcccgcgagcattccttgacgagcttcgtcgtcgtatgcaatgatctttgccattgttcctccacatatggctacacggtattattcccaccttcgaagcgaagaacgcaccagccgtcagctgccagttatcactctcgctcctcgagtgctaattggcagattagcactctcaggccgagagtgccaaactccatgtcgccagttgcgctgtaagcaagaagaattgttcgtctaaataagccatcaacgttggaattccaaggaaaacaaaaaagccttgttcttggggaaaagaacaaggcttttttgtttcgctcacggcgtttttcagtcaagcaacaccacaacgattggcgtgacgagtccatcgctttgctgcacattcgaaattcccagcgtctgtgcgacgttttcggcggtcgccttatcggtctcgttctgataccagaccacggtctgcgaaggaacgtttcccgtcggattgctggcagaaacactggtatacccggcttgggtcagcacgtcggccttgctttgcgcataaccggtgatattcgtcgcgttcacgacgcgaacctcagtacccgtgttcacagcctgctgcgcagtggcgttatccgtctgctcggcattctggccggcattctggtcggcgttctgatcattttgctgcgagtcggtcggcgaatcggcattggatgcgtctgtcttattgccggaagcggagtcggattgggacttggacttgctcttgccgctcttgctcttttcggcacttgaagtagtcgaactctcctgcgacgaccacggcatcttcagattgttgatctcacctgaataaatgctccagaacagcaaaccagcaagcagcgccacaatgatgacaatgacgtacggcatggcccgggacgccgcggaacgcgcgccacggtgaacacccataggtcccgccggaggattgtcgtacacatccttctcgtaggaatcgtaggtctccttgtcctgcttagccatattgcaaacctcgtttctcacacacttatctgccaagtgtaccgaccacctcagtcagaacacaatcgagccgcattcccacccctattccgaacgttcgtgaaaccatcccgtgaaaaccaaaccacccctgtcatcaggaccgcaacacgtcgtacagtaaggtgcatgacacaatcgaacatcaagccgttgaaagatctcgtggagcccggatgggcgaatgccctcgccgaggtcgagccacaggtgcaccgcatgggcgatttccttcgaggcgaaatcgcagccggacgccggtatcttcccgccagcgcgaacattctgcgcgccttcaccatcccattcgacagcatcaaggtgcttatcgtgggccaagacccctacccaacccccggtcatccggtgggactgagcttctgcgtggcgcccgatgtccagcccattcctcgtagtctgaccaatatatacaaggagctgacggatgacctcggcgtacccatgcccacgaacggcgatctgacgccttggacgaatcaaggcgttatgctgctcaacagatgcctgaccgtcgaagcgggcaagcccggcagccatcaggacaaggggtgggagatcgttaccgacgcggcgatcaaagcgcttaacaaccgccgcaatcccgatggcagcatcaaacccttggtcgccatcctgtgggggcgcaaggcgcagacgctgggaccgctgctcaccaacgcatatattatcgcctcacctcatccgagtcctatgtccgcgcgatacggattcttcggttcaaaaccgttttcccgcgccaaccaagcgctcatcgccgcaggcgagaagcctgtggactggtccctcccgtcagcttgacccgttacagtagcaactatggctttattccctccgaagaatccggtaccgacaccaacccccgttccaatgccggccgtcaccaaaccgagcacgttgcccccagaggacatcaaccgggcgaaacagctcggcacgtgcatccgcgcacgcttcgcgcagaccctagttggacaggacaacctgcgtgaatcgctgatcaccacgctggtggcaggcggacatattctcatcgaatccgtaccgggtctggccaagaccacggccgcgcagacgctggcgacttccgtgtccggatcgttcaagcgagtgcaatgcacgcctgatctgatgccatccgatctggtgggcacccaggtcttcgatttcgcgacgcagaagttctccacgcagatcggcccgatccacgccaacttcgtgctgctcgacgaaatcaaccgttcaaacgcaaaaacccaatcggccatgcttgaagccatggccgaaggagccaccaccatcggcggccagtgcatcgcactgccgaaaccgttcatggtcatcgctacacagaatccaatcgaggaggaaggcacgttcaaccttcctgaggcgcaaatggaccgtttcatgatgaaagccgtcatgacgtatccgaccgcgcaggaggaacagcgcatgctcaccatgctcacccaccgcggctccgacacttttgattcacgaacgctcactggtgacgtcgtgtccatcagcgatgtcgaattcctgcgcgccgcggcccgtcgcgtgcatgtgtccgacgcaatcatgaaatacgcggtcgatatcactgccacatcccgaggagccggcaccaagccggtgcagggattgtccacactagtgcgtctcggagcctcgccacgcgcgtccatcgcgctgactcgcatcggacaggccaacgcgttgatgcaaggccgcgactatgtgattccagaagacgtcaaagccttcacacatgaagtgcttcgccaccgcatcctgctcacgttcgaggcccttgccgacggcgtcaccagcgatcaggtcgtggactcgatcgttcaggcggttcccgttccatgatcgacgcaattcgttccgaagatccgatccgcagtaagatcgaagccctcggaaccacgttgagcctgccgactgttcgcaaggcgctcggtattcttgagggtgcgcacgcatcagacaagcgtttcggcgccgacgatgtcatggatatccgcatctatgagcctggagacgaggcaaaacggattgattggaagaccagcgcccgtgtgggccgccccatggtggtgcagcgcgaacgcccatccacttcacgcgcctggcttttgctcgatgtcggacaggaaatgaccggtacctgcgtttccggcgaacaggttcatcaggtcgcagccaacgccctatgcatgttcgcggcgctcagcctgcgtcgtggtgacgaagtgtccatagtattcggcgattcaggctcgatcacccgtgtgccattcaatggcggacttacgcaattcgaacagacgttggacaatgcgctgcagcgtgattggaacaaacctcgcaatatcgacgctttgctggagtacgcccgtcgcattcgcgacagggatgcgttggtggtgatcgccaccgatgagcacgcacttaaggaacgtcatgtggagtccattcgcaggatcgcaaggacccatccgatggtgctcatcgatgtcgcaaccattaatccgttcgacaatagccatgcgcgcgacgtattcgacgcgggcagcgaccgccgcattccggcattcctgcgcaccggcaaaacggcgcaggaagttcgcacgcatcgcgaatatctgtccgcgtccatcagacatgagctgaatcgttgcggttccacagtgatccgtgccgattcaagcgaacgtatgttccgggaattcgtacagatggtatccgcatccctatctcgctccacacgcaatcagctcaaagcaccgtcctcactcaccttgggaggcaaagcatgaatcacatcgccttgtctcgcaacgatttcgacacactggacccgattcatatcgaaacggggctgggcatcgttgtcgcggtatgcctcatccttgccgtggcacttgtcgtcttggtggtatggctgtcgaaaccaactctcaagccaacgaagaaaaccaatcgcggacgtcacgacgcatcgacgggcacgtcgatatggcatgaacgcatcaacgatgtggtggaccgtcatgccaacggcgatctcggaagagaggaagcgttcgctctgctcgcatcgatcgccagagatttcgtctccacggccaccggcagcgacgtgcgcaatcagacgctcaccgatattgaagcgacacctcgcacgaccggcaaccagcatgggctcaccctgctcaggcagaccatcgaggcattgtatccgccggaattcgcggatgccgaacgcaatcacacggccagagaggccacggttgaacaggctggagagtgggttgccaatcttgtggaaaggtggcgatgaatggaattgtcatggcactggccgtgggtaggccttgcaggcctgattgcgtcattggccgtcatcgccatcatggtattggcgtccgcaaaacgcaggcataacgactcaggatccgtgcggacgttcagtttggatgacgatctcaacaccgaaaccgcatcgagattatttcggcagtggcgcaccatgtcacgtgccgccgtcgttctgttggtgatggcactggtgctggcgatagcgctggtggcacgccccagcaccgtggatgagggagaggagcgtgcgagcagccgcgatatcgtgctgtgcttggacgtatctggttcgacgttgccatacgaccgcgaagtgatcgatacctaccgcacattggtggacaatttcaagggcgagcgcatcggattgagcattttcaattccacgtcacgtaccgtgtttccgttgaccgacgattacgaattggtgtccgaacagctcgacaagaccagcacgatactgaaaggcgtcgaatcgcaggatgatatcgacaagatgaaagacagcgattaccaagcgatttccgactggctggaaggtacgcagaatcgtaaagaggccacttccctgatcggcgacggcgtggtgagttgcgcagccatgctgccaggtttcgcctacggcagttccaacgccgagaccgcatcccgtcaacgtgccgcttccattgtgctcgccaccgacaatgtcgtttccggagatccgacatacacgcttcaggaggctcttgacctgaccaaacaggcggaaatcaccgtggacggactgttctccggaccgcagcaaagcgaatcggaacagacgaccaaacagttcgaatccgaaatcgaatcgcatggcggcgtgtttctcacgcaatcgaacggcgcttccgtggctgagctggtcaagcaaatcgaatcgcggcgcaaccatgacagcgcggcaagcagcaaggccgcaatatcggacgcaccgggatggtggacgctggcattggcagtggcgatagtgatttggctgctcttggcttggaggttgaggcgatgaccaatctgacgctctcccctgctttgggatggcctttaggcacggcgatctgcgtgatcatgctggtttgcgcagtcgcgcagattgtgcttcatatccgtagacgcagccaaagcgatgaaaccgtctgggcttgcgcaagacgatcgatgatttgtgcgctggtggccatcatggcattgacgccaagcatcgtctcgtccacgaacagccgtgcgattaacaccaccgatgtggtggtggcggtggatgtgaccggttccatggcggtcgcggacgcgcagtatggttccgacgaacagctcagccgcttggatgttgccaagcaggcggtgaaggatattgccgccatgtatccgaattccagtttcgcggcattgcgattcggcgcttcgggaacgttggatgttccgttgacgcctgattcgaaggcgatcgataattgggcggacacgcttgcaccggaatcgacttccatttcggccggttcgaccttggatgtgccgattgaccagttgttgctcacatgcaagtcgattcacgatcagcatcccgatgatgcgatcgtgctgtacctgatttcggatggcgagcagacctcgtcgaaaacacgccgaacgttctcatcgttgcgacgctacctttccgatgcgttcaccgtcgccgtgggcagcgagcagggaggcaatatccccgtgaccggcgatggcgtggaggaaggcgacacgcaatgggttaccgatccggaaaccggcgagcctggcgtgtcccgtatgaatgccgacgaaatgaacgccatcgccgacgagctcagtggaaccgccatccagctcaatgccacgacgaccatgagtggcggggattccaaagagacatccagcaaatggcgtgtcacgcagacatccaagcaacgcacaagaaccgtcgccatggtctggccgttcgccattgccgtagcgctgctgctgacgttcgaggccggggcatggatcacgcaatcaaggaggctgctgtgagcacaaccgttacagcgcgtgcatcgctgcccgttcgcatcgccatcgccgtcatcgcagccatatcggttattgtgggcgtgcttggcatagtgaatctcgcatccgtcagcaactacaaccaggccacggacagtctgaatgcgaatatcaaagccagccaacagcaagacgccgatttcgacaaattgcagacccaacagcagcagaccgacgcgcaattccgtgaagctggcgcggccggcatgttgctgctgccaaacgtacgcacatccatcgagcataatgccgaagtttcggcaaaactgaccgaatccatacgcaagaaaatcggagagatgcagcatgccgacggcaccgaggccgacacagtcatcgaaggtgggcaatccgtcaccgatggaggccaaggcaacggaggaaccttgactgacgagcagcgtcagaaggtggaggagcttctggcccagaacgcacagtccgcccaatccgattccgatgattccggttcggcggccaagcaggattccaaccaaacatcttcgcccgcaaaaccctggtaagggggcttatttcaggaagttatccacaggcatgtcggcgtgtttttgttgatttttcaacgatgacacgccgacatcgtgcttttcgcccgtcctccgaccacaagccttgttcgccggcttgggcaaccgcccgatgtgctccaatatagctatgaacgcatcaatcacctatccgtttattcccggactggggttcaacctcatcaacaccttggcctcaacgccaggcatgccatgccattgccgtgctggcgtgcgaaccacccaactgctcgtcaatgccaagctcacgtccatatcgaaacatcttgacgatcttgacgccacgctcgcatccagttcattgcccgattggacaggaaccgccgccgaatcataccgcgcgcggcttgatgagttacgcaagcaatccctgacgctacgggattcgatcaacgccaccttgcgtctcctatgggcagtaggtgcggcatgagctgggaagtgaccgccaaagtcagcggcggatgcaaatactccacggaggaaaccgaggcatatatgcgcgcggcaaaagccctcagccatcaagccgacgctctgaaccgcgcccatgattcagtccgggcattgagccttcagctttcctcctacccctatgcgtcgtcggccatcgcctcgctgtccggatcaagcccctattgcaatgccacggatcacatcgaactgccatacgaccagctcgtcgaacaatgtgacgcccatgcaagcgcgctgggagccatggcggcaagattgtcggagctatcggcgctgatcattcgcgcgcaatcgttatattcccaggtcgacgacgctggcagaagaacactgaacgaactgctgcaagtggcgatcacatcgttcccgaaggaatcgatactcgccggcgcagccatgtccgccttgggatatgtgatgggatccaccaatgagggcaaatccaatcccatatatctgctggactcgttggattgggcgcaggaaggcatcatgagcgcggccggcgccgcggtcagcggatacggcaaggtcaaaggcctgctgcgtaccgatgaggtcaaccatgcagccggcaccatctccaaggcatcgtcgcgcggttacaacttgatccagggcaacaatcttaccgtcacccaagtccatccgaaaaccgaagtggtgcgtgaatcgcataatgtcggagaggccatggaggatcttcgacgtcttgccgaggaacgtctcggcaagaccgatctcgacagcggacttgactacggcaccatcgccatctccaaataccgtaaatccgacggaaccaactcatggctcgtcaccattccaggcacagacggcaagcacgattctccatttgggtggccgcaaaacgtcgaactcatgagttcggacagcaagcaacgcatggaagcggacagtgcgcgaatggtgcaggaagccatgaaacaggccggcatcaaatccaatgagcccgtcgcattgatcggacattcgcaaggtggcatcgttgccgccaccatcgcctcggacctgaaagacgattatgacatcgaacatgtggttaccgccgggtcgcccgtcgccaatcatccgattccggaaaaaacatgggtgaccagcgtggaaatggacgacgagctcgtggcggccctcgatggcgccgccaaccccagttccgaccattggctgaccgtacgcggcaccgcaagcaaatccagcagcaaccaggaatcaacgttcgcaggcactcccgtcacagacgctccagacaacaaggaaatcacgcattggctcaaatatcaccaagccgcataccagaacgcaacggacatgggatccaccgcagtgaacacccacgaacggcatttcgatgagatcatcgacggcgatctgcaggaagtcatgtatttcgaagggcgcatgagcaaatgagaaaacactgcagccacggcgcaacaagaacggtatcacggcatacatcatgaaagccatccaccgagcggacagatacgcaactttcgtttacggctgaacgtatgctgtagtctatgaagcttactgatatctcccctgcaatcgcattgacccctcttgacggccgctaccatcagcagaccgctccgcttgtcgaatatttgagcgaacctgcgttgaaccgcgagcgcatgcgcgtcgaagtcgaatggatgattctgctggccaacggtttcgagggcaacggcaaccagaccatcgttcccggcgtcaagccgctcaccgatgaggaacaggcgttcctgcgcgccattcctgaggagttcggcgccgagggtatcgcgcaacacgccgcccatgaggcaaagacccatcatgatgtgaaggccgtggaatactacatcgacgaccagctcgacaaggccgccgacgtgcttggccacgacacccagctgaccggcctgaagactttggtacatttcgcatgcacgtccgaagacatcaacaacctgtccatcgcccgctgcgtgaaaaacggcatcgagaatgtgtggctgccgggcgctcaggccatcgtcgaccatttggctcagaaggctgaggaataccgtgacaaggccatgctgtcgttaacgcacggccagcctgctacaccgaccacgcttggcaaggaactcgcagtgtacgtgtaccgtctgaaccgccagctgaacaaggtcagggctcaggaatatctcggcaagatcaatggcgctaccggcacgttcggcgcgcatttggccgcatgcccggatgtcgattgggtggccgtctcccgcgaattcgtcaccaaccgcatgggtctgacgtggaatccgctcaccactcagatcgaatcgcatgattggcaggccgaactgtatggcaccatcagccacaccaaccgcattctgcacaacctgtgcgtggatgtgtggatgtacatctcccgtggcgtgttcgcccaggttccagtcaagggtgctaccggatcctccaccatgccgcacaaggtcaatccgattcgtttcgaaaacgcggaagccaatctggagatctcctgctcgctgctcgacacgctgtccgcaacgctggtcgaatcccgttggcagcgcgatctgaccgattccaccacgcaacgcaacatcggctccgcgttgggctactccgtgctcgcgctcaacaatctgatgggcggtctgaactccatccatccgaacgacatcgccatcgaagccgagctggactccaactgggaggtgcttggcgagccgatccagaccgccatgcgcgcctgcgaacttgccggcctgccgggcatggacaagccgtacgagaaggtcaaggagcttatgcgcggccatgagatctccaaggaagccgtcgagcagttcatcgatcagcaggcgttcgatgacgctaccacggctcgtctgaaggcgctgactccggcaacatataccggcgtcgccagcaaactggtagatttcgaccgctgaaccgaagctgtcaaataagtaccaaaaccatacgccctgagggtgaccgcgtatttcgtagccaccctcagggcgtattatcgaatgcagtggggcgatatgacccacctgaagccaatctcacgtatggagcaagtcaacagtgtctcactcccctgcagtcaataagcccgccccgcatatcgacgatgtgccgccgaagcgcagtcgtgattttgccgatctgacgcacgcattcttcgccttggtgctcggcataggcgtgattctgttctccgtgtacttgcatggcaccgcgtccggcgtggaatccgacgttcattccgccggccgcgtggtcagctggctgatggatgttccctcggcattattgcagcagcttgccatcgtatgcatcaccgtcagcgtgctcatccagctgcttacttccaaagagtggctgcaaagcgtgatttccgtggtttccctcatattcggattctttgcggtgtggggcatatccgcgctgatcagcaactccggcaataccatgctgatcattccactgcaatccaacagcacatccgtaggcactggactgctccccgatttttatgccgccatggcatcgttcctcaccgtctccggccctcggcgtatccgctcatgcaccaaatggggctggaacgtgctgtatgcagtggcagtgctgatggtcgtgctttcatggaattcactggctggcgtcatcgcatcctacgccataggccgtgttatcggcatgctgatccgtttcgccataggcacgcagaacaatggcgcgtggggatcacaaatcgcgcaatcattgcgttccatcggtattgacacatcattgctcacccgccgagtcgccccctacgtcgattcgggagtattgaaggccacgctggatgacgatctgaccgaaaattcccgtatttacgatgttgtcgactatgacggcaagcaatacaccgtttccttactcgacaatcaagtgcatgcggccggatatctcaaccaagtatggcagtggcttcgcctgaccggtgtttccatgcgtcgcgaccgttcctcggttgacgccatgcaccatcattacgccatgattctcggcctgtccaatgccggtttggaaactccgcgcgtgtatggtgtggccgattatggagaatcctccattctggtgttccaccgcaaccgcatgccattggaatgcaaccaaaacaccatgtccgaccatgatatggaagcgttcatggaatatctcaccacagcacaccatcatggcttcacccatcgtcgcatcactccggaaaccctgtcccgcatggaaaacgggcatccggtaatcgcaggttggcataatggcgattatggcagttccgctccgaacttcgcactcgacaaagtacagttgctggttcttcttgccacactcaatggcaatgatcgtgcgatcgcctgcgctcgcaggacttggggagacgagcagctgatcgatttggcacccttcatacagaaggctgccattcccgcttccacgcgcgcattgcctggctgggacaagcatgtgcttaccgatttacgtacgcgtatttcggcgctcgctccgcaggatgtcgcggattccatggaaaaagtcacgctttcccggttcagtcttcgctcgttcattgcgattgcgctgctggtggtcgccgtatatgtggtgttcacccagattcagccggccgaaatgatcaaggccgtcagagacgccaatctcgccatggcgttggtttgcgtcgcgcttggctttgtggcgtggcttggttccgctatcaccttgggtgtgttcatggattccgataaacgcaacacgatcggcttgtattgctctcagatggcgtccggtttcactgcggtgtccatgccggccggcgtcggtccagcattcgtcaacctgcagttccttcgtaaaagcggctatcgcagtacggctgcgaccgcggttatgagcgcggtctgggccgtacagggaggcactaccatcgtgttgttgctgacgattggcctattcaccggccgcaacacattgtccggcatgattccgaccaatacgctgatcatggtgatcgccatcgtcgcgttggttgtgtcggccgccatggcgattcctccagtgcgtcatttggtgaccgagaaataccttccagtggtcaaagcatacgcgcgcaacctggtcaatgtgcttgcacggccaaaggaactggcccttggcattgccggcgcactggtgcttaaccttgcgaccggactgggattctgggcagcattgatggcgtttggataccacacgaatcctgcggaaaccaccttcattttcctgcttgccaacactttgggctccgcggttcccactcctggcggtctgggtgccgtggaggccgtgctgtcggtggcgttcactgccgtgggcatcccctcctccatcgcggtttccgctactcttgtctaccgaatcgccttctactggttgcgtattccggtcggtgcgttggccatgaaatggcttgacatgcataatttgatctgacaaacacccccgtacactttgttttccccctgattttcaaaaaagcgaccaaaacccttgtaaaatgccattttcctcataagagtgcgctaatatcatagagaacgtggatgttcgtaatcagaatgtcccctgacccaagaaggatgctttatggcatacaacaagtctgatctcgtctcgaagatcgctcagaagtccaacctgaccaaggcacaggctgaggcagctgtgaacgctttccaggacgtgttcgtcgaggcgatgcagtccggcgaaggcctgaagctgaccggcctgttctccgctgagcgcgtcaagcgcgccgcccgcaccggacgcaacccgcgcaccggcgagaccatcgagattccggcaacctacggcgttcgcatctccgccggctccctgctgaagaaggctgtcaccaagtaagtcatgtactgatatgttgcttacacgacgaaagccccgaccatgacggtcggggctttcgtcgttcatgacacttgtacaagcgtcattctgcgctacactatgcatatatattagacatcgtgtccatatagatggagagagacatgaccgatcaacgcaaggaagtcatcaatcaactgcatgaattgaacattctgctgctgcataccaagctgaaggccacacgcacacagaccgcgctacgagccgccacacgagtatgcaacgtcgaagcggcacgtcgtggcgtgccaccgctgcaacaacttcccaaaagccatgacacggcaacgcacatgcttgactgcctcagcaccgaggatctttccaccctcagcgaacttctgcagcgcatcatcgacaacaccgacaccaggattctcgatgaagaggttgtcgagcgacgcaaagccatccatgaattccttatgctgaatcacacagatacggaggtgcaggaatgagcgacgagcaggagaccattcccgaagcaaatgcccccaaaccaatccgcatcgacaaacgatccctgttcactcccagtgaagccgtggccgtggaacagcattccacaacaccacatgtgtcacgaacccgttatggaaccgcacgcatcgaaggtcgcctctcctcccccaatgcgagagtacccgcagtcatatcgcaacattgcggcggcatcacagtcaaaggccatacgctcaaatcgttcgcttataccaccgacgctgcgatcatccgtaataccaatgccaacgccattctcgccgtctacccgttcactggagaaccggtgatcacacaggcgttgctcactgtggcacaaatgccacttttcgtaggcgtcggaggaggcaccaccaccggtccgcgtgtgaccgagctggccatggtggctgaaatgcaaggtgcggcaggcgtcgtcatcaacgcgccggcacccgcggaaaccatcgaaaccaccatgtccatggtcgacattcccgttatcgcaacagtcacggaagacgacgaaatcaccgaatgcaagattctcgccggtgcggccatcatcaacgtcgcagccggagcacgcaccgcgcaagtcgtggcaagcatacgtgcgcatcatccggaaataccgatcctggcatcgggaggcggatccgaagatcgcatcctcgccaccatcgaagcgggcgcggatgccatcacatggacgccgccaagcgcgcaacagctgcaatcgcagatgatggcgaaatatcgcggcgaagcctgattcaagccaatcaaaaacgaaagcgaccgcagcgcaatcgcaaaacaattcaggagaacataccgatatgggagtggggtgtgaccgaagcctgtcggccacaccccactcccatcgacgtttcccattgccaccatcgcttactccaaagcgccaatcatggcttggaaatcctcattctccctgcattggaacggatccagcagcaccatatccatcttccgcggcgcatgcaacgatagtctggtccaatcgcaggaatactgcgcgccatgcgatttggccgcactgacgaatctgccgcgcaatgcggcacgagtatccgccggcggcatggtacgcgccttttgcgcctcacgaccgtcaatcagcgaacgcaaggcaccacggcgaagcaacgacgcatacaacgcgccattggccacgtcatgatagtccagatccaactgttccagcttgctcagcggaagatccgcactggaacgggcacgtaacgcttcaaacaggcggtacttgcacacccagtccacgctgtctcccaaagcattcgcattgccggaacggaacgcttccaacgtattgcgccactggcgaagcacatcatgcacatcggtgcgaggcaacgacgaagccacttccggatgctcgcccacaaactgttccacagcctgcagatagcgttcctgcatggctacggcaccaccctgcaacgtcgatccatcggccatggcaaacgaagcattcacgccgctcatatcgcgactgaccgcacggtttgcggcaccagcgtccgcgaacgcgaaccgcgagaatcccgactcacgtccttcacgccccgcctgttcgataacgcacagcaccagatgcgtggtggccagcttcatcatcgtggcccattgagaacggtttgaatcgccgatgatcacatgcagccttcggaaggcgtcgggatcggcatgcggctcatccctcgtgttgaccattggacgcgatcttgtggtcgccgatgaaacagcctcatccagaaaatcggcacgctgcgtgatctggaaacccgattccgtcaccctgcctgcgccagtgaacagctgcctggtaatcaggaacggcagcaattcgtgttcgatgacgtccaacggcacaaaacgacgtaccagatagttttcatggcagccgaaggaatgccctgcggaatccacattgtttttgaacacatgcactgtggcacgtggcccatgcgtggctcgaagcctttgctgggcgtccaacgcaagatcgcgcatcaccagttcgccggccgcatccacggcaagggcgtccatgggatcgcaggcctcggacgtggcatattcaggatgcgatccgacatcaagatacagtcgcgacccgttttcaatatacgtattggtcgatcgcgcggaggcaacgatcggctggaacatcatcattgccgtctggctggcgtcgcatggcacatccgcaccggtcacactgacgccgtattccgtttcaatgccgaaaatacgagcgaaagaatgaacctcacgcaacgttcccgcatcaagcggtgacgaggaatgattgccgctgtctcgcagctgcggcatcactcgccgcctttttgcacgaaactaccgacatattcctcagcattggactcgagcaccgattcgatatcgtcaagcacggcatccaacgcatcagcggttccgtcgacttgtacgccggcggattcgacaatgtcacccacctcttggcctgcggatgcggattgagcctgttcaaattcctgaggcatgacattcctccctgtaacttccggttgcaaacctgcaaaaaaacgctgcgccacaccttatatcaggtgtggcgcagcatgcaacactatgccaaatactggctcagatcattggtgatcagaccattggtggccatcacatcgttctcctggcgccagtgaacgctttcgccattccactgggtcagatggccttgcgcctcccaaatcaccacagcaccagcagacacggcaggtacgtcccactcatgcaagtgcggttcgaaatacgcatcgtacgtaccgtcggccaccttgcacaaatcaagggacgccgggccgacacgtttaatatcggcaggacgtccggcaatcttcgccaccacatcgagcgcacgctgcgattcggacgataccggagacatgccgaaactcaccaccgaaccatcgagggacgacgtggtggaaggaatgattttctcgcgtttgtctcccaacggagtcttgcgaatacgaatcgcgccggatccacgcaccgcaagatacgtcaatcccagcgccggagcgtgcacaatcgaaaggatcggctgtgcggagcactggtcgttgaattcgaacaatgtcacggtgatggcccattccggcatgcttcgcgcgaaattgatcacgccgtcgatgccacccacacaccagtatcgctggccgggatagcactgttcagggcgaagctgccagaagccgtcgaacacgttgacataggtcaggcggttgctgatgaactgctgcaggcgcttgtcggtgtctgaagtgaagtggaagcagtcttcggacacttccagttttctcatgtcgtgcggattcatctggtcgttcaacgcatgcttgcctgcgtcctgcaggatgcgtgcgacttcgagggcgatttgcctcagttccatagatatgccttttcgtttcctctgtacagtcccggcacgtcctctcctcaaaataccgggatgatgttacctgttgtcaatggtcgttcttcgcgaccaattgatggcaatgttacccgcacagattgcatttcaccgtaacatttccaaaatcgacgccgcatcttggacacgctcacaatagcgggaacattgagatttgctatatttcagagggtctgacatatccaatgagaccatcggattctccacggtattatcaccaatcgttcgatggcgcaccgtaagatgcgaccacgatgcggccacaacctgttctggaaaacgacgaatcatttcggcacgcaaccaagcacgggtatcggaaggcgcttccaccgaagcctgcaccaactgcccgtccgtaaacagccgctccgtttgggcacgcaaccgatcgaaaatcgagtcagcgggatcaatcgcagcccactttaaatcgacggccgcaatacgcgcatcatcccaaccggagccaattttacgacgcagcttctccaacaactgccatttcaatagccattcaatgcggccagcttgctcgcgcatcgtcaaacgcgcatcatcatcggcatgcctgatggcagccacatcggcgagcgcctgcccccacatcgccatgatgttacgggtcgaacggtcagaccatgccggttcaccggacgtgtcggttccatagatcacggcagcggcagcatacaccaggccacgcagggtgacctcaatctgccatgccgaggtctcgccgccatattccagcggcaacatggcacctaatgtcaaatcatgagacacctcgtgcatggcgctcaccggatcggcgagcatgattggctccaacgcttcgtctatgttcaatcccgcctcttcggcatgctcaagcagccacagcagcatgctggtggtgccgagtttcagcgcctgcggcacatccatacgattggcgtccccgacaatcacatgcaatcgacggtatgcatccgtgctgtgcgattcgtctcgagtattgatgatcggcctgtcgaatgtggtctgcaaaccgactttcatatgaaaatagtcggcgcgctggctgagctggtatccggcggtttcacttcgttcgccgataccgacgcgacctgatccggtaaaaatctgtctcgctacaaaatgtgccgtcatgagtttcgcaacttggtcaaacggcaccgaacgcagcatcatataattttcgtgggtgccccagcttgcacctttgccgtcgacattattacggtgcagcgcgattgcgataccggtctgttcgctggctttgcgcgcgcactcacgcatgatgagatcgccggcatggtcgtagagcacggcatcgaagggatcatcggtttcgggcgcggaatattcaggatgcgcatgatccacatacacacggccgccattgactgcaatcacattggtgatgttgagctgcggcgcgtccgtcaacagatcaggatgcgcggatgcacgttccagcctggtgccgcgggcgtcgttgaccggatcctcctgccgatagtcccagcgaatatgcttggtttgttcgttcgccgcggcaccgaccacatcgaacgatagcttcaccggattgtaatgctccattccgagagcggaaaccgcgtattccgtttccgtgcccatgattcgacgaacgctcattgatacgacttcccttcgtctgatttcgcgttgcctgccagcattattcgactggtcgtatacgggtgatgcgccctgcttccaaaccattgatacggctccactgttccggattggcgtccaacaccgcatcgcgggtttcaagaaactcctcgtcgacggccttcgccaacagatcgacgccaatcgccgccggctgtccgctttcgatggagattttcacagcacgggttttggcacgatccacaatgtttttcagcaccgcacccgacaccacatccgccagatagatcggatgccattgcccatgctcatcgcacacgtcgcacagataccggtgctcgtccgtcgaatagatatcgctgaccagcaccccaatcaaagccttcgcatccacccctggcaccaacggcaaatcgtcggtcagataatggcggatgatctgcgccgcctgagccgctttcggacgctccacacgaatcttcacatccaaacgaccaggacgcaacaccgccggatcaatcatgtcaatacggttcgaagcgccgatgaccataacattgccaagcgtttccacgccatcaagttcagccaaaaactgcggcacaatagtggtttccacatccgacgacacgccggatccacgagtgcgcagcagcgagtccatctcgtcaatgaacacgatcaccggtttgccatccgccgcacgctcacgcgcgcgcttgaaaatcatgcggatcaggcgttccgactcgcccacgaacttgttgagcagttccggccccttcaccgacaggaacacgccacgaccgccggcagcgccttcggcgagcgcattggccacagccttggcgatcagcgtctttccattgcctggaggcccatacagcagcacgcctttcggcggcttcaaatcataacgttcgaacagttcgcgatgcaggaacggcatttgcacggcatcgcgaatacgttcgatctgctcatccaaaccgccgatatcagcgaacgtgacatccggcacttcctcaagcaccaagtcggcatcatcctgcgcgggaaccaacgcaagcgcgaatctcatggacgaatcgaccgtaacacggtcggacacattgatcgaagttttcgacagcgctcccgaacggcggaccaacgcaacgtttccaccgccatccgcgaccagcaatcgcccatcatcaatgacctgcttcaccgtgcgcactgcgcccacagcatcagtgccggcttgcgaaaccaccaccatattctcgttgagcagcaccgtgcgcccagcctcaagcctggatgcctgcacattcgccgcaaccggcacgatcatgcgacggcttccggaaatcacctcggcgctggcatgctgtaccccctgttcgtccgtgcgagaggaatgcacgcgaaccatggtggcgaaggtcatgggcggtcccgccaactggttcagctgggccttggccttggtgagctcctgggtggcacggctcaacgccttggccaacgcatgattcttggccatcaactggtcgttggcctcacccaacgacgccaacgtctcatcacgttgatccatttcatcagcctcgctttccaccgaatgcgtttcgagccgttccgtcatttcgtcatgtcatggcgcattcgcattcaacatgctcaacccttaagaatacccattgtcctcatgatttccgacaatcaaaaccatgcttgaacaagaatcgccgaacattgcgcccactcccaccctttcccaacctggactgctggtgatggatgtggattccacgctgatcgatgaggaagtcatcgatcagctgggcgccgccgctggaattggcgaacagatcgcgtcgattaccgcacgtgcgatgaatggcgaacttgattttcgcgaggcgttgcaggctcgtgttgcgctgcttaaggatctgccgacttcggtgttcgatgatgtgtatcgtcgcgtgcatttcacacagggggcgcttgatttgattgacgctttgcatgcgcatggttggaaggtcggcgtggtttccggcggtttccatgaagtcgtggaccgtcttgccgccgacgcgcatcttgatttttggattgcgaatcgtttggaagccgctgatggttgtttaaccggccatgtgcttggcgatatcgttacgaaagatgtgaaattgcagtcactgcgtgattgggcttcacgcatgggcatcagcatgggtcagactgttgcggttggcgatggagccaatgatctgccgatgattcatgccgccgggcttggcgtggcgttctgcgccaagcctgcggttcaggcggatgctccgcatcgtgtgaacgaacgtgatttgacccggattcttgattttcttcgttgattcgcattcttcgatgatgcgaatcccgatagatccgagtcgcgatatagcaaaatccgatattgcaggataacgatattgccgtgtgaaatgatgatgttcacacggcaatatcgttatgatccgtttattcgacactacttgcagtaggctccgtcgagatgcgcgccacgcgcccaatcggcggcacgcatggcttttttgccttgggctttgacttccagcaattccaaaggatctgaggaagtacccacccacacgttcttttttccggccacgatccgccctggttctagcgaaacgggtgtgttgggattgctcatatcggcgccctgcgcacgcaacacatgcaacgtggccggttctgcttcggcattggcgtgcagttcgcaccatgcgcccggattgggcgtgcaggctcgaatctgacgatccaccgcgaatacaggaatgtcgaaacgaatatgcgcgtcttcaaccgtgatcttctgagccacctcatatgcgccggcaggctgttccacaggcgcgatctgatcgtcggccatggcctgcagcgaggcggcaagcaaacgggaaccatcctcggcaagacggttcagcagctcacccgccgtttcatgcgctccgatttccacagtggactgcgccagaatcggaccggcatccatggctcgcacgatgcggaacaccgtggctccggtcaccttctcgcccgcccaaatggaacgctgcacgggagccgcgccacgccactgcggaagcagcgagaagtgcaggttgtaccatcccatcggcagcgcgtcgagcacatcctgcttcaggattttgccatatgccaccactgccgcggcctgggcaccggtcgcagcaagttcggaaatgaacgtttcctcgctcggatcggattcaatcaccggcaaaccaaaatcaagagcggcctgcttcacgggattcggtaccagtttgcgtccacgcccggtaggagcatccggtcgggtgagcactgcgaccacttcgaaacgctcggtatcttcagccagcattttcaacgacggcaccgcaacatccggagtaccggcaaacagcactttcagcacgaaaagtcctccttatcaaatcctcatcacatcgttatcatcgtgggaatcattccggccgtatcaacagcatgtaaggcagcggaacgcaacacactatgcctgatgcaccgcgggaatcttcacacccgcatcaatcagcagcgcacgcaacgcacgtgaatccttgaatcgaacgccacgaatgcccgcattgttcgcacctacgatattcatggccttatcgtccacgaacaccgcgccggaagcgtcaatgccgaactgttgcaacgcgaactcgtaaatatccttattcggcttacgcagggagacatatccggaaaccacacgatcgtcgaggctgcgcagaatatcgaaattgtcgagcgcgatcgggaacagatccttctgccagttgctcaatccccacacatgcacgccggccgctttcaaatcgttgatgagcacgcgggcgcccggcaccacgccggtcaacgagtcgacgaaattgtcgagatagtactgcagcatgtcggcccatttgtctccataacgttcacgcatcagggcgacgccgtcatcattcgacatgccgcagtccagttcatcgttgatgtcgtagaagccggaaatatcgttgtcaaggaactgttcaacaagctcgtcgctatagcggggcgtcatcacggccaccggatcccagtagacgagcacgttgccgaaatcgaaaatcacatcggtgatcggcttgcccgcattcaccgcagcttcgccgtcagccatgagcacgtcgtactccatatcaggctctccaggccaacccttcatatgatcctccattcactgctgtgcggcctcatgccgaactgccaacctgtctagtttttcacggcgaggggacgtgcgtcagattcgctccttcggatcaagctgaaaacgcagttctcccggttcacgcgcggccacatggcgggcactggcggaacgcaaacgcaacgccaactcacctcggcgactttgcggcacacgcaccaccgccttgacacgatccgcagtgccttccaattcgcgcgaatcaatggtccgaggctgcggaataggtaccggccccaatacggacggcagcatgccttcggtggtttcgatggcggacaggtcacccccacccaacgcgccgatacgttccagcgtgaccttcaccgcgtcacgacgtccccatacgcatgcggcggcaaacacaggcggcaatgcggtttgttcacgttcccgcaattcggtttgcgccagcaacgttgaattccaaagcatcaacgattgagcgagcgtgggatcggtttcgccgatcaacagggcctgacctcccctgattcgcggcgcgcacagcgaaaccgcgcgcatccacgacgtcaacgtgtctacgcccgcgtcaatgccgaaggcgtacaagctggtccatgcgtcgagaatggccacggcccggtattcgcattccgaggggttcctcccacgtacacggggttctgcgccgggagtggcgatgaccaactgcggcgcaaacccgatatcgggaacaatgccgcgtggctggctcggcgttgaaagcacaatgggcacgccacgaaacagtcggctcagctcctgcgcagttccggcggcacccacacgaaccacgcgcatacgttcgttatggcatgccgggcaagcccattgcacagtggcgacaccgcaccaacgacaacgcaccgacccatcccgtaaccgttccaatggacccgtgcagtacgagcagcgagcctgacggtggcatttcgcgcagctcaatgcttcaccgatgccatcctgcggaatgctcaacagcaccggaccgctttccaacgccttcgacagcactcgcaccgcagtgtgcggcacacgcgctccgatggtcgaatccgcaagtcttgccaattcgtcacggttcagccaacgaatccaaggactcgcttccttggttacggcagggaatgcgtgaatcggcgtactgaaaccgctgacctgggtggcaccgacatgcgccgcatcggtttcccactggctttgcacactgcgcgcattggccatcgcgacgaacacgccattatgcgcttttgcacgtaaccgcaacactccgcgggcgttggcgtaaggcatcatgccatcggcatcctgatagcacacgtcatcgagaatgaggaacaacgcattgccatccaccggcgcatacatcgccgcccgtgtgccgatcacgcaccgcacctgccctccactgatggccagatacgcacgataccgttcagcaggcgccatctgcgcgttcagaatggcgaaatcgccgccgtacgcaccgttggatgattgggttggcgcgaaacagcgcaagccgatcgactgcaacgtttcggccatgtcctcaatctcacgcatggtcggcaacaccagtaccgccggtttgccctgcaataaggccgcggccaccatccaggccacgcactgcctccaatgatgggatcccggcaatgggtcgagcacgaacgcttggaaacgttgcccttccaatgccgtacgaagcaggtcgatattaccgtattgccgctgcaactgctcgtacgattcccgctcgatcttggcaagcgattcgatacgtccgtttttttcaatacccgttcgattgccgatacgttgttcctgttcgacgcgagccacgcgcggaggcaccgccaaacgcaggatattggctcgcgttccgccgaatgcgtccgcgataagtgtggcatcgttgcgcatggattccgacacaagcacacgatcgatgaccacccgttcgatgaaccgcaatgacgattcaggggtttcgctggtatcggtccgtttccaaatgatgccgttgacccgttgcccgccgaagcggacacgcaccattacgccgggctgggcggcttcggaatacttctcctcaacgtaatagtcgaaggtttgccccaaatggatggcctgaatatccagcaccacttgggctatgggatgctccgcagccggcgttttaaccgcgggcgcacgcttgcgccgcttgcgcggggcgagcccgtcaagcgccagctgctcggcatcctcagtactcatgattcaagggtaactcagccttcgatggcagctttcagctcgtcgaccttattggtggtctcccaggtaaaatcagcatcgttgcgtccgaaatgaccgtaagcagcggtcttggaatagatcggacgcttcagatcaagctcgtcgataatggcggccggtcgaaggtcgaacaccttacgcacagcctgctggatctgctcgcgagtcacaccattttcagtgccgtacgtttccacattgatggacaccggatcggccacgccgatggcatacgccacctgcacctcaaccttgtgggccagacctgccgccacaatgttcttggccacccaacgcgccgcataggcagcggaacgatccaccttgctcggatccttgccggagaacgcgccaccgccatgatgagccgcaccgccatacgtgtcgacgatgatcttgcgaccggtcagaccggcatcggcagccggaccgcccaacacaaacgaaccggtcggattgacaagcacgcgatattcatcatgcgccacacgatcggcaagcacatcatcaagcacaggacgaatcacatgttccgtcaactgctccttaagccacgcctgatcgacttgaggatcatgctgcgtggacaccaacaccgtgtcaagacgaacgggagcatcatgctcatcatattcaatggtcacctgggttttgccatcgggacgcagatgaggcacttcgccattcttacgaacctcagtaagacggtaagccaagcgatgagccaaataaatcggcaatggcatcagcacatcggtctcgtcgcacgcatagccgaacatcacgccctgatcgccggcgccctgcgcctcataacgctgctcgcgagatgccttcgactccgcttcgccactcaaacgagccacaccctggttaatctcagagctctgctcggtcaacgaaacggtcacgccgcatgaatccgcatcaagaccaacgcgagaactggtatagccgatattgcgcaccacagaacgcacaatgctctgaatatcggaatagccttcactcgtcacttcgccgaacacgaagaactggccaaccgtggcgcatgtctccacggccacgtgggactgcggatcctgagcaagcatatcgtcaagaatcgcgtcggaaatctgatcgcagaccttgtccggatgcccctccgtcactgactcagcggaaatcaacttcaattcagccatctggctgctcctttcacgaacgccccacacgttcgcccttctgattgctacgaaaaaacgccccgtccttcgcatacgcaatcaatagcttcactatggactattcaaagcgcaccgctcagatatcggggcgaatgaaaacttggaatccggttcttatcgcaagaaccgttacatcagttgccttcggtcagatcgtcttcgccgagggtctcttcaagcagaccatcattgatctcacggaaagcgatggatagcggcttttcctgattctgatactccaccagcggaccgacgttctgcagcaggccctcgttgagctgggtgaaataggaattgatctggcgagcacgcttggctgcgaaaatagcaagagcgtacttggagtccgcatgctccatcaagtcatcgatcggcggttccgcaagaccggtcggggttggctgagtgccgaatgccatattgattatctcccaatcatcagataagccaaaagcttcttttccaaagtcttaagtatagggccgccactggacctgattcaagccctttctctcatgttttcggcaagcgcaagcatcttcggcaatgctcgcgaatataacgcttctgggaattccacatagtgactcttgacaaaaccgtgtcccgcttaaccaccacaatagagaacatggaaatgcgatctgcaaaactgatgaatggacgagtattcgcgggcgcacgcgccctctaccgtgccgctggcgtggacggtaaggatttcggcaagccgatcatcgccattgccaattccttcgatgagttcctgcccggccacgtgcacctgaacaaggttggtcgactgatctccgaggccatcaaggaagctggcggcattccgcgtgagttcaacacgatggccgttgacgacggcatcgccatgggacacaccggcatgctgtactccctgccgagccgtgacatcatcgccgacaccgtggaatatcaggtgaacgcgcactgtgccgacgccctgatctgcatcccgaactgtgacaaggtcgtgccgggcatgctgatggccgctctgcgtctgaacatcccgaccgtcttcgtctccggcggtccgatggaggccggcaccacggtacttcccgacggaaccgtgaagaagaacaccgatctgatcgacgtgatgtatgcctccgccgacgacaatctgaacgaagaggatctgctcgcctatgagaagaccgtctgcccgacctgtggttcctgcgccggcatgttcaccgcgaattcgatgaactgcttgaccgaggccatcggcctggccctgccaggcaatggcaccattctggcttcgcactcctaccgcaaggatttgttcaagcgcgccgccgagcagatcgtcaagatcgccaagcagtattacgacgatgatgacgagactgtgctcccgcgttccatcgccaccaaggaagcgttcgagaacgccatgaccatggatgtggccatgggtggctccaccaatacagtgctgcatatcctcgccatggcgcagtccgccgacgtggacttcacgcttgacgacatcgagcgcatctcccacaccgtgccctgcatctgcaaggcttcgccgtccggcgaatgggagatctccgacgtgcatcgcgccggtggcatcactggcattctcggcgagctcgaccgtgccggcaagctgcaccgcgacgtgcattccatcgattacaagacgcttgaggacaaactcaacgactgggacatcatgcgtgatacctgcaccgaggaagccaagcagatgtatctggcggccccgggccacatcgtgtcccctgatccgtggacgcataccacgctgttcgactccctcgaccgcgaccgtgtgaacggcgcgattcacgacatcgatcatccggccgtcaccgaaggcggtctggccgtgctgcgtggcaacctcgcccctgacggctgcgtggtgaagaccgccggtgtgccgaaggagatttggaccttccgtggaccggcactggtcgtcgaatcccaggaacaggccatcgaggtcatcctcaacgacactctgaagcccggtatggcgctggtcatccgttacgagggcccgaagggcggccctggcatgcaggagatgctgtacccaacgtcgttcgtcaagggcaagggtatcggcaagcaggtcgccatgctgaccgacggccgctattccggcggctcctccggtctggccatcggccatatcgctcccgaggcggcaaacaagggcccgattgccctgatcaagaacggcgacatcattaacattgatatcccgaaccgtacggtgaacgtcgagctttccgacgaagagctggcccagcgccgcaccgaactcgaagccggcgacggctatgtggcgcaccgcgaccgcaaggtctcccaggcgctgaaggcctacgcggcgttcgcccgttccgcagacaagggtgccacgcgcgatccggagctgatcaacaagctttccggtctcgcctgatcctagcgaatattaaataacataatgaggattgtgcagttaatatgctgcgcaatcctcatttttatttcatacttggcttcttttatataaaaatatgcgcccgatatgttcgagcgcatattacaatccttgtaattattatgattacaaatcgaattccgttgcgataaggttccacagttcatctgctgcctcatccacaacattattgacgatgactttgtcgaattccgattccgcggcaagctcgatttttgcggtttccaatcgtttcgcctgctgcgccggagtttcagtgccgcgcccgatcaagcgtcgttccagttcttcaaatgacggcggcgcgatgaacacggtcattacctcgatacccaactcccccgcacgctgcttgacactgcgagcaccttgaatatcgatttccagaatgactggaatatttcgctcaagatgttccacgacaggtttcacgggagtgccgtaatgtgcgagaccaaacacgtcggcggtttccaagaactcaccggcagcttccttgtcgagaaactcctgttcgggcatgaagaaatagttcacgccatccacttcacctggacgaggctgtcgtgtggttgcggataccgacagccagacttccggatgctgctcgcgcacgcgcccgagaacagtgcctttgcctacacctgccggtccgcaaaggacgattaaacggccatgctgggagtcggtcattgcttcctcactctgtattagttgctgaagatatttacaagaaggaattattgttgacaaatcgatgatgatttactcgtcttcttcatcatccaaaatctcatcatcgacttcgttctgggcctcgatgagcgcttgacgaatatcgagcgccacggattccgtagccgcggccaaactggaaatatccggaccatgcgtggcgatgaagcgagacacggtgacgagcacattgcccttggtgcctttgaacaccgtcttgaggtcgcgggtttcagcaccctgccatccgtagcccggagacagaataggaccagtgaacttggctggatcgacaccggaatcattgatccactgaccgatggtggcaccgatgatcaagcctacggaacccataccgtcattgcccttattgaacttctgagccgtgctggcaatgccgtacgccactgttctgcccttgtactcgcctgcctgacgaatggcggtctgcaggctggcgccctcttggttcgaggtcagcgatgcaatgaatacacctcgaccgttgttcagggcatcgttaatgacaccgcccaacgagcgtgcgccataatatggcagcaaagtgatggcgtcggcaagcaacggagacctcggcttgaaatagacatcggcgaatgcggacaccgtagtcggcaagcctccatgcaggcagtcaacgatggtgatgatacccatttgacgggctgcgtacagtacccgctcgagcgctgcgatacctttcgaaccgtagcgctcgaacatggagaactggaatttgacagctgccgctcgcccattggctgcctgcagcatacgcatggagtatagttcggcacccaatgcgtctacgttgtagccccagtcagtaagaagctgcctgtgtggatcgattcccacgcatagcggaccatattgggccatggaattgctcagtcgcagaccgaagtccgaacgctgggcactcatttcttcactgctgaggctgctcatcattactcacggctttccaactcgaatagctgctgggaatgatcctgaatgctcatgatctgataatcattattacgcacggcctcgatggccatcaacacggcggagaattccgtcatggtggtgaactgaggcaaatccgcggcaatagcggctgaacggatggcgtaaccgtcggaacgggagccacgagaattcggcgtgttgagaatcagatcaatggcaccctcttcgatcagctgaacgacgttcttgccgacgctgccctccgcatggtaggtggtgatcggatcgtccggattggaatccatacgcacgctgatcttgtcgacgatcttggactcgatgccgtaacgacgaagcacggatgcggtgccttcggtggcccagatgttgaatccaagctccaccagtcgcgcagcgaacaacggcagctgacgcttgtcggtatcggaagtggctcgcgaagccgtggcattgctgaagaacgacggttcactgccgttcaacgtggccggtgcgaagcgtatcgcggtcgttggtccgctcgccgatgacgcccagacccagctgggcgactgggcaggcagctccggccagatcaactggatgcctgacggccacccgcgtgaaatgatcaccaccgtgcttgatggtttcaagcagctcgctccggaaggttgcgaggtcgtgtactctcgcggtgccaacatcgtggatttggtgcctgatccggaaggcgagttctacccggatggacagcctcgcccgaagatcggcgtttccgccaagattgatcgcgcactgcttggcgaagccgtggaaaacgcacgcaaaagcgacctgatcgtggccgtggtgggcgatgtgatccaggccattggcgaaggctgctccaccgccacgcttgaactgctcggcggacagaatgcactgatcgatgcactgtcgaacgtggctcgcgaaaccggcaagccgttcgtggtggtgctcgtcagttccaagccgcaagtgctgccggcatccgtgatcggcaccaacggcgtgattgtcgacgaaactccagccgaaggcacttcggctctgctgtgggctccaagcccgggcatgaagggcggccaggccatcgccgaaatcattctcggcgaaaccgaaccgagcggacgcctgccgatcaccttcccgcgtcacgcaggacagctgccggtctactacaaccagattcgaggccagcacggcaaccgttacgccgacctcacgcagaatccggcattcgcattcggcgagggtctgagctacaccacgttcgaatacggagatccgatcatcaccaacgttccggaatccggcatattcgccgaaaccgacaccgtgcatgccgaaatcaccctcaccaatacgggcgatcgcaagggcacggaagtagtgcagctctacatcggcgacatcgtgacctcctacagctggactgatcgtgaactcaaagcattccagcgcgtggaactcgaaccaggcaaaagcaagaccgttgccttcgacattccggtttccgattgcaccatcgtcgattcggaagctaaccgaatcgtcgaaccgggcgaattcgaagtgcttatcggccattccagccgtcgcgaacacttgaagcgcaccaccttcaccgtcgcgtaaaagcgaaacgaaataagccgtgtcgcagaacccaataatcgacacgctagtctgatatgagccgcctacgaaatgccgatcgtgggcggctcgcatgaatggaccattgccgtgacatacgcgttgtttatggctgcttccggattcgtactggtgtctgatcagacgcatgcgttgaaccagttgccatcgtcaatgaacgccgactgttccgcggtgatgaacgccatacagcagcttgccggcgcgattgtgcttgccactggcggttatacggctttgttcccgatcgctgtggttgcggtgctactgggcacggtgttcatcatgctgattcgcaaggtgaagtagctgcaggtactgcagtagccgaagcaacgcgcagtgtgccggcgattgtggcacacgtgatctcgacattgcgttccgtgttggcgatcagcgtcgcaagatcagccggcccgggcgcaatgccgaacgttgcgacgatgccggtctcgttcaacgcttcgatggtgtgtggatcgcgggttaccgttccgccaatggcgatagttggttttccttgcgattgcgctagtttcgcaatgccactcggcactttgccgtacggtgtctgactgtcgatggaaccttcgccggtgatgatgacgtcggcccatgcgcatgcttctcgaccatgcgtaagatcgagcacaagttcgattcccggccgtactgttgtattgaacaggccgagcatcccgccgccggtaccgcctgcggcgcctgtaccgggaatgcgctcaatatcgcggccattgtattgcatgatcgcgtgtgcgagattcgcgagtccctgatcgaggagttcgacctgtgctgtgttcgcgcctttttgcggagcgaacacatgcgcagcaccttccggtccggtcaaaggattggtgacatcgcaggcgagaacaatcggaacattttttacaaaatcgggaacttccgaatcgtcaatcctctccaaatcaacaagagaaccgccaccaagcggaatatcatgacctgccgtatcaagaaaacgaaatccaagcgcgcgagccaatcctgtgccaccatccgtagtggcactgccgcccaaaccaagcacaatacgattcgcgccagcgtcaatcgcagcacgaatcagcaagccggtgccgaacgtggaagaagacaacgcattgcggtcggcgggggagatccgttcaagtccgcttgccgaagccaactcgaccacggcggtgtggagaatacaagaagcatgattattgccaagaaagccaaactgagcggtaatcgggcgaccgaccgcatcaaccgtctcaacatcatgcaacgtgccgccggtggcatgaaccaaggcgtgcgtcaatccttcgccgccatcggaaagaggcataagccagcattccgcctgcggattgccacgcttaatgccgcgagccatcgcctgtgcgattgcttcagccgaagcggcctccttgaacgagtccggtgccagcaaaatccgcatacatgcctccttctacgtctgcatccatacagtaatgcagtgccggggcagaggcttagcggtagccctcccacatgggcagggggaacagggtgtcttcgcattccgcccacatggcgttcagatcttggccgggcgtgcgcagccaacgcagctgcacgccatccatcatggcgaatcccgcattaagcagccgacgcgtatcaacgccttcgggcgtgcaccaacggatattgagcgcggtatcggcattatgcagctcacgattggcgaagtactcgtgtgcagggtggttcgggtcgatcgcttcggcactcaacgtggaaaacatgtgcacctgaagcggtctgcgtgcgttcaccgccacgattctacgccacatgtcggcgatcaacggtcgtggctcacgtaccatgtcggtaagaatgtcttccgtttcggaatcgtagacttcgtccagcgctgctgtgagcagtccttccttactgccgacataatgcagtacgccagccttggtgagtcctacgcgatcggcgattttctgcagggaagtgccgtaatagccgagcgtcccaaacagttcgacggccgcattgagaatctccgcccttcggtcgacttcttcgttggccatgatgattccctctcttgcccttcattgatggcgattcatgtgcgctgcaatgcttatgaatcgtcatttctctcaagttgtaaatactgcagttactttacggtcggttaattgatttttcaaagaagattggcgtgttgcggtgttggttttgataaagtacctaccaaccggttagtagagatttcggggttgaggtctcatgcagatcggttaaccgatacgaactcaagaaaacgatgcgaaagaggaacgtatgagcgaaaaaacctatccttccatcaatgatctgacgcttgaagagaaggcatccctgacttccggcggcgacgcttggcatctgcagggtgttgaagccaagggcattcccggctatatgatcaccgatggcccccacggcctgcgcaagtccaactcggccaccaccggcgaagtcgacctgaacaactgcgtgcctgccacctgcttcccgccggcggctggtctgtccagctcctggaatccggaactcatccaccaggttggcgaagccatggccgaagagtgcattcaggagaaggtcgccgtaatcctcggcccgggcgtgaatatcaagcgcaacccgcttggcggccgttgcttcgaatactggtccgaagacccgtacctggcgggtcatgaagccatcggcatcgtcgccggcgtgcaatccaagggcgtgggcacttcgctcaagcacttcgccgccaacaaccaggaaaccgaccgtctgcgcatcagcgccaacatctcccagcgtgcgctgcgcgaaatctacttcccggcattcgagcacatcgtcaaggaggcccagccgtggaccatcatgtgcgcatacaactgcatcaacggcgtgcatgccgcccaggatcactggctgctcaccgacgtgctgcgcgacgaatggggtttcgaaggcatcgttatgagtgactggggtgccgaccatgatcgcgtggcctccctcaacgcgggcctcaacctcgaaatgccgccaagctacaccgacgaccagatcgtctacgcggcacgcgacggtcgcatccagccggcacagctcgaccgcatggcacaaggcatgatcgacctggtcaacaagacccgcgcggccatgagcatcgaaggctatcgtttcgacatcgaagcccacgacgaagtcgcccaccgggccgccatcgaatccatggtgctgctcaagaacgacgacgccatcctgccggtcgcaaacgatgccaaggtcacggtcatcggcgaattcgcacgcactccgcgctaccagggcggcggctcctcgcacatcaccccaaccaagatgaccagcttcctcgacaccctcaccgaacgcggcgtggatgccaagttcgccccaggcttcaccctcgatctcgaaccggccgatccggcactcgaagccgaagccgtcgacgctgccaggggcgccgacgtggtgctcatgttcctggggctccccgaagcagccgaatccgaaggcttcgaccgtgagaccctcgacatgccggccaagcagatcgcactgctcgaagccgtcgcagccgaaaacaagaacgttgtggtcgtgctctccaacggctccgtcgtcaccgtggcgccatgggccaagaacgccaagggcatcctcgaatcctggctgctcggccagtccggcggtccggcgctcgctgacgtgctgttcggcaaggtgagcccgtccggcaagctcgcgcagaccattccgttcgacatcaacgacgatccgagcaccatcaactggccgggcgaagaggggcatgtcgactacggcgaaggcgtgttcgtgggctaccgctattacgacacctacaacaaggccgtcgactacccgttcggattcggcctgagctacgccacgttcgaagtgagcgacgtgaaggctgtcaagaccggtgcctgtaccgcatccgtcagcgcagtggtcaagaacacctcgaacgttgacgccgccgaaaccgtgcaggtgtacgtggctcctggcaaggccgacgtagttcgcccgaaacacgagcttaagggcttcaagaaggtattcctcaaggctggcgaatccgcagaagtctccttcgagctcgacgatcgcgcctttgcctactggtctgagaggttcaatgactggcacgtggagagcggcgaatacaccatcgaggtcggcacgtccagccgtgacatcgccggttccgcggtggtggagctcgacggcgacggcaaggcccagccgctcaccgaatggtccaacttcatggaatggcgtaaggatccgctcggttccaaggtgcttgaaatcctgcgtgccgagggcgaagccggccgcatgccggtggtgcccgacaacgacatgacccgcctgttcctcgattccatgccgatcaacagtatgtcggtgctgatgggcgccgatggcaagcagatcttcgaatacatgcttgagaagtacgctgaactcaccaagtagtttcgtaggattcaaggcttaaggccgagggattcgatccgttaacgctgaaccggtgcggatctgattcctcggccttttttgtcgcggacgatgagatgcgcgacacgctgatcgttgcatgtacaacagttgtatatgcaacggtttagcatgtgtggtgtgacagaagtgacgaatgaacaatacaaggaaccgtcaggttcacgacttgccgaagtctgggaaagtggcctgaccaagcctcccagcgtggccattcgctcgctgcacaacgtggtcaaccggtatttgcgcgtcacccgtcccgaagaggcggaagacgtcagcaacggcaacgttgacatcatcgtgtacttggcaagacatgataacgaggagatcttccctcaagacatcgagcaacgtttcggcgtgacccgatccacatcatgccgagtgttgggactgatggagcagaaggggctgatcgcccgcgagtcggtgaagcgtgacgcacgtctgaaaaagatcgtattgacggacaaatcgaggcatattgccgaagtactgcacgacaatgcgaaaaacatggaacgaatcctgttggaaggtcttgatgacgaccagatccgccaattcatgcacatgcttgacgtcatgcagacgaatctggtgaaaacaggtttgatcggagacgaaagccgatattcaagcttggaaatacaggaacaggattttggcgaatcgcaggtttcgcaaaagccgcaggtttcgcaagaatcgcaagaatcatgcgatggacggaatccgcataatcgcgattctcatgatgaatacgtttcgcgcatactgcgaatgtcgcaggaaatggcgatcgcaaacaacctcaggtaacacacgcaagcaagtaagtacgaaaaagaaaggacaaggagtgacagcggcaaacgcaacgacgtccacaacgtcaaaaccaaagcaacacgtcattcgcacactgggcaaatccctgcgcgaatacaaaaaagccagcctgctctccccggtattcgtagccgtggaaagcgtgctggaaatccttattccgaccgtcatggcatcgctgattgatgagggcatcagcggtggcagcatgccggcgattttgaaattcggcttgattctgctgatttgttcggcggtttcgctgacatccggctttttggccggaaagttctcggccattgcgggcgcaggattcgccaaaaacctgcgtcacgaccagtttgagaaggtgcagggctacagcttcaccaatatcgaccgtttctccaccggttcgatcatcacgcgactgaccactgatgtgaccaacctgcagaacgcatattcaatgatcatccgcatgggtgtgcgcgctccgatcatggtgattgtggcgtggatcttctccttccgcatcagcccatccatttcgctggtgttcctcgcctgcattccggtgctcgccatcggcctgtgcggtctggcagtactggtgcatccggtgttcgagcgcgtgttccacacgtacgacaagctcaacaacgtggtagacgagaacctgcagggcatccgcgtggtcaagtcttacaatcgcgaaaaccacgaaaccgaaaagttcaaccgcatttcgcagcgcattttcaaggacttcaccaaggccgaacgcattatgagcttcaacaatccgctcatgatgctgtgcgtgtacgtgtccatgctgcttatcgcctggatgggtgcccagcagatcgtggcatccggcaacaatgcggcccttggattgaccgccggcgatctgaccgcattggtcacctatgccatgcagattctcatggccatgatgatgctgtccatgattttcgtgatgtgcattatttcgcaggcctccgccgaacgcatctgccaggtgctgaacgaggaaagcacggttacgaatccggaaaatccggttatggaagtgaagaatggtgagattgatttcaaccatgtcaccttccgttattccgccacttccgaaaagccggtgcttgacgatattgatttgaagatccgttccggtatgaccgtcggcatcgtcggcggcaccggttccgcaaagtccagtttggtgcagcttgtgccacgtttgtatgacgtgaccgaaggctcgctgaaggtcggcggcgtggatgtgcgcgattacgatttggaagtattgcgcgatcaggtcgccatggtattgcagaagaacgtgctgttctccggaaccattgccgaaaacctgcgttggggcaatccgaacgccactgatgaagagattcgtcacgcatgccagcttgcgcaggccgacggcttcattcaggaattccccgacaagtacgatacgtacatcgaacagggcggtaccaacgtttccggcggtcagcgccagcgtttgtgcattgcgcgtgcgctgctgaaaaagccgaagatccttattctcgacgattccacgtccgcggtcgacaccaaaaccgatcagctgattcgcgccgcattccatcatgagattcccgacaccacgaagatcatcatcgcccagcgtgtggcctccgtgcaggaatccgacatgattctcgtcatggaccacggccgcatcatggcggccggcacgcatgaacaactgctcgaaaactgcgacgaatatcgctccatctacgaatcgcaaaccaagaatcaggctcaacctgaggaactgcagtgaaaggaggcaacagatgactgaacaaacttccgcattgaaatccaaagacaacaacaacgcggccggcatgcagcaatcgcacggcaaaccgccgatgcagaaagccgcacccggcaccaccaagcgtatcttcggttacattttccaatacaagtggcgtgtggcacttgtggtagtgtgcattctcgtcggtgccgcggcccaggccggatcgtcgctgttcctacagtcgctggtcgatacgtacattctgcccatggtcggtgccaccaatcctgattggatgccgctgctgcgtgcgttgacgcttatggcatgcctgtatgcggccggcattttctgcagctggctgtggcagtgggtcatcgtcaccgtggaacagggcacgttgaagaagatccgcgacgacatgttcgcccaccagcagaccctgcccatccgctacttcgacaccaacgaacacggcgatatcatgagccgctacaccaacgacaccgatacgttgcgtcaggccatcagccaatcgttcccgcaaatgttctcgtccgcggtgtccgcaatcgccgcgctcgtgtcgatgctgtggctgtcggtgcccgtcaccattttcgtgctcgcattcaccatgatcctgtttgtggtggtacgcaaggtcgtttcccgctccggacgttacttcgtcaagcagcagatcgccatcggcgacgtgaacgcattcgtggaggaagcggtcaacggccagaaggtcatcaaggtcttcaaccatgaagacgccacccaaaccaccttcgacaagaagaacgaagaactgttcgaagcttccgccgaagcgaacacgtggggcaacgtgaccatgccaatcgtaggcaacatgggttacctgctgtacattctgctggctattttcggcggatccgcagcgatttccggacttggcaacttcggattgtccggtgctggcccgctcaccctgggtacgctgatctcgctgttgacgttgtctcgttcctttgtgaacccgcttggccaggtgtccatgcagttcaacatggtgatgatggcgcttgcaggcgcatcccgcatcttcgcgcttatggacgagcagccggaggacgacggcggttccgtgaccttggtgaacgtggaactcggcgaagatggacgcaccatgaccgaagttgaccatgaaaccggtcactgggcgtggaagcgcgaggaaggcgatgacggcacccgttcgctcaaggccgcgcaatccttgagcccgcgtgccgccgaagtggccatgaaagcccgtgaaaccgccattacctcaccggacggtcgcctcaccctcctgcagggcgatgtgcgcttcactgacgtgaacttcggctataaccccgacaaaccggtgctgcacgacatcacctggttcgccaagcccggacagaagatcgcattggtgggcgcaaccggtgctggcaaaaccaccgtcaccaatctgatcaaccgtttctacgacattcaggacggcatgatcctgtatgacggcatttccgtcaagggcatccgcaagccggatctgcgtcgttcgctgggtgtggtgctgcaggacgtgaacctgttcaccggtacggtgatggacaacatccgctacggtcgcctcgacgccaccgatgaggaatgcatcgccgccgcgaagctcacgaacgccgacggcttcatccgcatgctgcccaacggctaccagaccgtgctcgaaggcgacggctccggcctgtcccagggccagcgccagttgatttccatcgcacgtgctgccgtggccgatccgccggccatgatcctcgacgaggccacctcgtccatcgacacccgtaccgaagaggtggtgcaggccggcatggacaacctcatgaaggggcgtaccgtgttcgtgatcgcccaccgcctctccacggtgcgcaactccgacgtgatcatggtgctcgaccatggccgcatcatcgaacgcggctcgcatgacgagctcatcgcgcagaagggcgagtactatcagctctacacaggtgccgtagaactcgaataatctaaatagtctcctgaattggagcgatgcgagcacacgctagcgttctacactagccgcgcttcgatccctgtcggctgataccgcccttatggccggtggctttgaacggcacggatcctctggaaaatcccttgctttgaaattgcgattttgaagcaagggatttcttattgtctttgccatgcacggtattcggctgcggccagcccgccttccgtgaaggcggttccgtcatacgttcatgagactgctgcatgagcagcgattataattggcttgcgtaatcgttgcataaatctcgcttggtttgtcgttatgtcaataataggttatcctttcatgggtaaacgatttactaaattggagagcgagacatggcgacgattaaagagattgcgcaacgtaccgggttttctcaggctacggtgtctcgacttctgaacggtgatcccaccctatcggtgcgtgaagagactcgtcgcaagatcattcaggcgagcgaggacctcggctatagcgtgcagaccaagcgcatcgtcatccctcatgaggttgcattgcttgacaatgaaaagtccgacgaggcgttgcgggactcctatttcaccgatttgcgttcagcgctcgaacgcaatgcggaacagcaacgcatggaaatgacggtgttccacaatctcgacgatatgatcgctcgcagttccaaattcgacgggttcatggcgataggcgccgaccagatcagcgaggaagacttggagcggctgcatagggccatgccgtatggcgtgttcattgacgtgaatccggcgccgaatctgttcgattccgtgcagcctgatttgcagcagaccatgcatgatgcggtcgcggcctgtgctgccaagggcatgaagcgcgttggattcatcggaggcaagggctgcctgatgaacttttatgaggtcgatgaggagaatcgcgccacatatttccgtcgtgaggcaaggcgtttcggtattcaatccgacggattggtgtattccgacggcttgttcaccgtgagcaacggccgtgcgttgggggagcaattcgtgcgcgaccataatggcgtgctgcctgatgccgtgatcgtagctgccgatgtgattgcggttggcgtgctgcaggcgttcaatgcggttggcgtgctggtgccgcgcgatatcagcgtgatcagcattaacaatcaaacgatttcgcagttgacctcgccgccgttgagcacattctccatcgatcagaacgagcttgcgcgtgtggcgacgctgatgttgggtgatgccatttccggcaaacgcacgattcgtcagcatgcgtacctgtcgacgtcgctggtggtgcgcgatagttttgtgccggcaaaatagcggttatttctttacttctgtatagtaatcgggctatttccagattggcttggtttcgtttcgatgtggaagcttttgcatatcgtaaatatcgattttggtaaaagctgccacaagataatgcgacagtttgcctattttgttgtgtaaatggcgaaaaataacgtttttggctatctttcgaacagaagctcacaaaatatgacacgccgataggcgatatgttcagtgataaattttactaactttaggtaaggggatatactgatagttaggtcaaggaaggacctgtatctgacttctaaggagaagcaaagatgggaaatggcaacaacggttccaaaggcgggaacctcttgtctcgcgtggcgtactcgttcggtaacgtcggccagtccgcgttctacaacgcactgagcacctatttcatcgtctacgtgacgagctcgctgttctctggcgtcgataagagcgtcgccaccaagctgattggcatcatcaccggcctggtcgtggtgattcgtatcgcagaaatcttcattgacccgctgctgggcaacatcatcgacaacaccaacaccaagtggggtcgcttcaagccgtggcagctcatcggtggtaccgtttccgccatcctgctggtgctcgtctacactggtctgttcggtctggtgaacgtgaatactaccctgttcatcgtgctgttcgtcatcaccttcattgtgctcgacgtgttctactcgctgcgtgacatttcctactggggtatgatcccggcattgagctccgactcccacgagcgctccacctacaccgcactcggctccttcggcggctccatcggctacaacggtctgaccatcgtggtcatcccgatcgtcacctacttcagctgggtgttcaccggcaagtacgtcgaaagccagtccggctggacctgcttcgccatcatcgtggccatcctcggcatcctcaccgtgtgctccgtggcgttcggcaccaaggaaagcaccaccacgctgcgtgccaaggccgaagacaacggcggcccgctgcaggccttcaaggctctggcccagaacgatcagctgctgtgggttgccttgagctacctgctgtacgccatcgccaacgtggccaccaccggcgtgctcatgtacctgttcaagtacatcctcgacaacaccgccgcatactccatcgtgggcgtcatcccggtcatcaccggcttggttatggctccgctgtacccgatcctgaacaagcgcattccgcgccgctacctgtacttgggtggcatggtgctcatgatcgtcggctacctgctgttcgccgtcggctccagcaatctggcaatggtcatcgtcggtctggtcttcttctacctgccgcagactttcattcagatgaccgccatcctgtcgctgaccgactccatcgaatatggtcagctcaagaacggcaagcgtaacgaggccgtcaccctgtccgtccgcccgatgctcgacaagatcgcaggcgcatgctccaacggtatcgtcggcttcatcgccgtagccgcaggcatgatcggtgacgcaaccgccgcggatatgaccgccgcgaacatcggcatgttcaaggtctgcgcattctacgtgccgctgggcatcatcgtgctgagcctgctcgtgttcctcttcaaggtgaagatcaccgagaagatgcacgacgagattgtcgaagagctcgaagccaagcttgcttccggtgaaatctccgaatgatcgaacatagtatgttctaaaaatacatattgaaaatacgattacaatgccgatactgatgggctgtcagtatcggcatttctgttgtatgtaatcctacataagagctattgtgaatcgccatgaaacctattgtgaaatcgtccataatcatgcaaaacaagcgaaaatagttcgcgctgcatgctatagtgacaactgaaatgcgagcgatgatccgttatcagcggggagcttccggaagaacggtcgcgtgagcgacttattagacccggcgggaaggcccgaatagccgaacatacaagcggtcgcacgtatatttgaaagtgcggcaaacgaggtggtaccgcggtggcggcgtccagcagacgttacggccatcgtcctcgtaggagatagatagcaagaacctacgaggagatacggtgagcgaaaacagcgtgtatccgaaggcagctgcgggtgagcagagcgccaatgtagcgccgaaccccagtttcccgaagctggaagaatccgtccttgattattgggagaaggacgacactttccagaagtccattgaacgccgtccttccggcgatcacagccagaacgaattcgtgttcttcgacggtccgccgttcgccaacggcctgccgcattacggccacctgctgaccggttacgccaaggatgtgattccgcgttaccagaccatgaagggccgcaaggtcaatcgtgtgttcggctgggatacgcacggtctgccggccgagcttgaagcccagaaggaactgggcatcgattcggtcgatcaggtcaaggaaatgggcatcgacaagttcaacgacgcctgccgtgcctccgtgctcaagtacaccaacgagtggaaggactacgtgcaccgtcaggcacgttgggtcgatttcgagcatggctacaagacgctgaacattccatacatggaatccgtgatgtgggcgttcaagcagctgtacgacaagggcctcgcatatcagggctaccgcgtgctgccgtactgtccgaaggatcagacgccgctttccgcgcacgagctgcgcatggacgccgacgtgtatcaggatcgtcaggacaccaccgtgtccgtggccgtgaagctgcgcgacgaggaagacgcctatgcggtgttctggaccaccacgccgtggaccgttcccaccaacttcgccattgtggtcggcgcagacatcgactatgtggaagtgcgtccgaccgaaggcaagttcgcgggcaagaagttctacctgggcaagccactgctcggctcctacgccaaggaactcggcgacaactatgagatcgtgcgcgaactcaagggtgccgagatggaaggctggcgctactacccggtgttcccgtacttcgcaggcgacgagaacgccgtcgaaggcaaggttccgggtccggaaggctatcagatcttcaccgccgactatgtcgataccgttgaaggtaccggtctcgtgcaccaggctccgtacggcgaagacgatatgaacacgctcaacgccaagggcatcaagagcgttgacgtgctcgacgcgggctgcaagttcaccgcgctgtgcccggactatgagggcatgtacgtgttcgatgcgaacaagccgattctgcgtaacctgcgtgccggtgacggcccgctggagcgtattccggaagagcagcgtgcgatccttttccaggagaagagctacgtacactcctacccgcactgctggcgttgcgccacgccgctcatctacaagccggtgagctcgtggttcgtgtccgtcaccaagatcaaggatcgtctgctcgaactgaaccaggaaatcaactggattccgggcaatgtgaaggacggccagttcggcaagtggctggccaacgcccgtgactggtcgatctcccgcaaccgtttctggggttcgccgattccggtgtgggtttccgatgatccgaagtatccacgcgttgacgtgtacggttcgttggacgagctgaaggctgattttggcgattatccgcgcgaccatgagggcaatgtcaacatgcaccgcccgtacatcgacgagctgacccgagtcaacccggacgatccgaccggcaagagccacatgcaccgcatcaccgacgtgatggactgctggttcgaatccggttccatgagcttcgcccagtaccattacccgttcgaaaacaaggaaacgttcgaacagcatttcccgtgcgattacatcgtggaatacatcggccagacccgtggctggttctacgtgctgcacatcatggcgaccgcactgttcgacaagccggcgttcaagaacgtgatctgccatggcatcgtgctcggttccgatggtcagaagatgtcgaagcacttgcgcaactacccggatgtgaacggtgtgttcaacgatttcggatccgacgccatgcgttggttcctcatgagctcgccgatcctgcgcggcggtaacctgatcgtgaccgccgatggcattcgcgacaccgtgcgtcaggtcatgctgccagtgtggagctcgtactacttcttcaccctgtatgcgaacgccgccaataatggtgccggtttcgatgctcgtgcgttgcgtgccgatgaggtcgccgcactgccggaaatggaccgctacctgctggcacgtacccgccgtctgatcgaaaagacgcaaagctcgctggatgacttcctgatctccgacgcttgcgaagcagtgtctgatttcatcgacatgctcaccaactggtatatccgcaacaatcgtgaccgtttctggaatgaggatgcgaacgcgttcaacacgctgtacaccgtgcttgaagcattcatgcgcgtgatcgcaccgctcgctccgatggaagcggaagccgtgtggcgtggtctgaccggtggcgaatccgtgcatctggccgactggccgttccttgccgacgaacagaccggcgaagcgaccgaactgggccgtgtgctcgttgacgatccggctctggttgacgcgatggagaaggtgcgcgaggtcgtgtccggcaccctgtcgatgcgtaagacgaagcagatccgcgtgcgccagccactgcataagctgaccgtggtggtggaaaacactgatgccgtggccgcatacgacgagattctgaaatccgaactgaacgtgaagaacgttgaactgtgcacgcttgaggatgccgaagcccaaggcttgaagattatcaacgagctgcgcgtgaacgctcgcgtggcaggcaagcgcctgcgcaaggacgtacagttcgccatcaaggcctccaagtccggcgcatggcatgtgaacgccaacggtgctccggtatgcgagacgccgaacggcgagatcgtgcttgaggaaggcgaatacgagctgatcaacagcgtggaggagaagaacgccgaagaggccgccaactccgtttccgccgcgctgccgaccggtggcttcgtgatcctcgacaccgagctgaacgatgatctgatcgccgaaggctacgcccgcgacgtgatccgcgccgtgcaggacgcccgtaaggccgccggtctgcagatctccgaccgcatcgcactgaagctcgttgtgcccgccgaagacgtgtccaaggttgaacagttcaaggagctcgtctcctccgaaaccctcgccacctctttcgaagtgacggccggcgatgagctgaacgttgaggttgccaaagcctgagtgggctgacggctgctgatgactgatcgttgattcaggttgatgaacggcccgtcgtctaagccgtatctggatgacatccagctactactagacgggcgaacggtcgccaaccgtagcaggtctcgaatccaaaagagttcgggacctgttttagtagtgctgaacaatcaaccatgagatgttcaaacatgagactacagtaactacgtggctttcgagccttacagacttgatttgcattccgcaagtacgtgtcttgcgtcgacatgcggttacgcgagtgatcgcatcgtatgcgcagccgtacaagcgggatcagatcgtttcgcgaatggttctcagtaccatccatgtgagtcaagcacacatttgagaagcagtcgcacaccgggaatcgcgctcgcgtggttcccgtttttctaaaataacatacttgtctatattaagggaaaagctgaaaagcttgacactatctatagtagtgtgatattctgttcgcgtacataacgaaagtgcccgtcaggctggcgggcttgacgggcacttttcgagcagaaaggagacggaatcgataaattgtccgatacctgtagactgcgttatttctagtccgtagaaacagcgccagtatagcaggttaacttgatcttgtactgaagtcttggtgtgaggcctgctactgcattgagggttgtctattttgagggaaaagcatcctaaacactggctttctctgtatttcagagacttctctacatctcctgtcatgtgaatgccacgaatgcgcatatggcaggggtattattcgaactaattagggtgcacgggtgcgccctacagtacgcatggaaaggatttagctatgcgcaatatatctatcgatgacatcaatgctgcgatcctcaatggtggggcgggaagcttattggtccgagtggaattagaacccgcttcggggttggacggcattattgctccggcaaagtatgctggcgctaataacgccacttatgtttatgagaagcggtatctcggagaggaaaaacctcagaaagtcgttctcattgactcaaaaggatcgtttgccaacagggttgaggaaacaattaccgaagcaagaaggactggtgaggggctcttggcgtccatgccacatatcgttgtcaagtatgatgacgaatctggtagcaagacttattgcgacagccaacttcctcatcgtggtttcgatggtcacattcgcgtaggtgtccatgatggaaaatccacatcggaggcgaaggagtacattgatgctcgcaattcgactttggaaaatcttttgcctctgtttgagctgtctccagtcacggtgctgtttggcgggtgggattccactaggagcaagaatcagttgcgaatcccatcggtattgactggtgaaatgtatggcgtgcttgcggatcaaagcgatgatgatcccgccattcatcgtgccggagcgcgaattgatccggttggtgccagcgtgagcgtggctaagaaggctgatcgagaaaaaatagtcggagatagcatcgatcttagtgaaaacacaaaaaacaaatttattggcagcggtaagggttccattattggtctaggagccattccgccgagtgcagataaaggggctcttgatggcgtttcggtacgtggcatcgtttcaagtcgtgtactgagctttacgatgcttcgcaccttccactttggtaagggcgttgaaggcgacgccgccattcgtgctttgattgctgctgcgctgcttcgcgctatggctggatatgatgagaatccagtagtcagggctaattgcgcgttgactgagaccggcaagccatcggttgtacttaacaagcgttacggcgaaaaggaagaattcgagcctctcactgcagaatctactgagaaactgctggaagaggcttatatgcaggctcgggaaaaggccggcattgtctggaatggccaagagtttttggtacagggaaatcctgcggtttttgacaatgcttctgccgaggaatagatcaaggacgtctcatggcttttgctattacagcgaactttctgctggggacgtatcagggaagcgattctggcggtagaccggaaccttacccttctccagacagactctataaggcatgcgttgctgccgcatacaacacgtttgatttcgaaaggcaaacggatgatcgtgttctgacggacgagcagattaaaaatgctttggcatggctggaggataatcctccgcatagtattctgttgccccgcgttattccaccaactagcgatgctatttcataccgagacaagggatatttagaaaaagggaaagtaaagaagagcccggataaagcctctaaagcgatgtcgtattgccagaatgcggtggaatccctgttattgacatggcagtgggacgagaatcctaaccaagaggtcatcaacactcttaacctgctttgtggcgaggtcccttacctgggcgaggcatgttctgttgtggaactaaaggtcatagctggtgggggtataccggaggtccaacgcgacaagacatggacgctggagaaaggcccgatgctgtccggaatttccagacataatcgtgtgtttgccgtgccgggaacaggaaggctggaagagctgaaacgtgcctatatggccgcgaatcccgagggaaaaggcaaaggaaagaatgctgccaagtcgaagataagggcaaaggaggccgagcagaactttcttaatgactatgttccaaaggagactgagggcttggccggctaccggcctccttttgtccattcggagcgagcccttgaagccccgtggacaagagtgattgtcatgagcgtgactgttgatgaaggtcatcagggtgaaaagtcggagtggaaaccttccgaatcggagtacgtcggttgggcagttgcgttgcatcgtttcttggtgaagcaatggggtgttgatcccgctccatctctggttggcaaatatgttagtgggataaagcgtccggcgaacaatgttgctattcagattctcgattcagaattgaaatcgagctatggaattcaattgcgtgacgatgttgcgagaaaacttccgggattccttatcatgcttcccaaagacatgccgcaacatgacatgcagaaactgtacgatgtctgtaagcgttcgaaggggaaaactctgtacttttctcaagctgttccaaagctgcgattaggggagtctgccttgatcgatgcggaacatctatggaaaccagtaagcgtcgatttcgtgcgctactggatgcctcgtcctcttgccattgcggagactcgaccgataccggatcccaagaaaaagcgtcattggcgagctgccgaatcaatgtatttggcactgggccatgtatggcgtgataagtatgttcccaatgatattcagggtacgcgggaatcgcggtattgggagacggtggatgcagttgctgatcagtcttctaatatcagaatattcgattgccgacgggtgagtcgcgtgaacatgattgattatgcgcatcataccaatagttccaatgtgttacgtgccatgagtgctttaatcgccatttctgatggtgaagggtcgcttgattgtgccgctttagctgttgggcagagtcgacatttgggaggtggattcctcgtgcctcttgattttcccaaaaacatgattgtgcctgacggacactttgaaaagggggttccttcatggttgaagtgactcaggctttagcttttatggaacagcagtatgctcagtttgttgccttggctcatgatggtcgcactccataccgctggcagttccgtttgatgcggtatgtcgcgcaagaaggacgctggcctgatcgtatttcagtgccaacggcatctggcaaaaccagcgttattgatatccatgcattccttaatgcgatggtcggattggctgaaggcgaaagccgaaaagaacatgagatcttgtcttgccttccgttgcggcgcatccctcggcgcttggcattaacggtgaatcgtcgctctcttgtcgatgaccaatttgatgaggctgacgagctttgcggcaaaatccacacgagtgactccatgattcactataaggaaggcctcaagctcagagctggtgtgcatgatggtttgcctcatactgataagccttccgttatgaatgttgtcgaattgcgtggaggtatagcttctcagagagactggcggtattatccgcagacctgtgctgtcatctgcgctacacctgacatgtttggcagtcgtttgctgtttcgtggttatggtaccagccgtactatgcgctccatggaagccggattgcttgcctatgatactgtgctggtggccgatgaagcgcatctaagccggcagctgcttgaaacagcgcaacaggtggatcgcattgaaagtatggctgactatcctctcagtgaatacgtttctccactgcaggtagtggaaaccacggcgactccagctagcgaggatgcaaaacggaccagcgtggaaatcgagcaagaggatttgacggttgagacatcgcttgctgatcgactgtgcaagccgaagccggttgttctggattgcaccagcgctacggaaaaggaagagatccaaaagatcgttgatacctgcgttggaatgatccagaatcaagaatctggtgaatatggcgagactggcaatggcgtagtcgggtgtattgtcaatacggttaaaaaagccaagcaagtggcgaaagaactgtcggctcagctgaagaaagctggtatcagacgcccagtagcgagctacataggtccaatgcgcgcctacgataagaaaaaaatccttacggcaatgcgcgatgctatgtcactagatgcttcgcccgaatctccatgttgcatcattggcacgcagacgttggaagtaggcgtggacgttgatttcacgacccttattacggaattagctccggcatctgcgttggtgcagcgcgctggccgtgtcaatcgtcgtgggctgaacccccaaggcgatatgtatgtctttggcgtcgaggggaaacggctaactgctaaaacagcggctccatacgatgagcgggatcttgataaagctttggcttggttggagaaacttcctcggactgattcggaattaccgaacatgagtgcgtggtcagttcggcaatcgattctgcaagggaattatgttcctgcagagaagcctcgtcgtctgctgttccaacgtttggagccgtgggatgctgagaacctttcatccacggatgaacagttgtctgctgatttgcggttgccggggctccaacaggggagtgcggatctcaatctgtggttgcgtgatgatctggcggacgattccccggacatcggtgttgtggtcagggatctgccgcaggacacgaatgttgccatcgcattgcttgaggaaactgaacctgagaatgaggaattgttcccgttgcgtaatcaggaccaagcggcaaagctgaaggcgagtcttgaaggtggtgctataagggctttcctgtatcgagcttcaaacgaggaaggacaacgcgtcttgcctctaggtgctgcggatgcgaatcgacctgattcatatgatgggcgcattaaaaccggtgatgtcatcgtcttggacgcttccgtgaaaatgttcactgagctttcttcggagggggaagtggtaatgctcgaccttgatgggaagagcatggctaaagatgtatacaatgcatgcgccctcgggaaaatggtacgttactataaggaagctgacggtcacgatggaatcaagactgcttttacgcaggcctatgcgttggtgaataacgtaggcgattttactgctgagcagcaagagcagatgaatcgcgatttgcaattgatttgtacaccagcatcggaaatgtcttcagattcttttgccgatgcaaatactcttgtgctcaaccgtatcatgtatgaagaagatgaaactgggtgcaaaacctggtgggtggttgtcagtttgcatgccagtgattcgggatcggaatccgatcaggagatattgagcgccaaagctaaagaatatgaattattgcttggtggtcctcatcgacaagaggaaggccaccaagatcatgttgcggcacgagctgaggccttggcacgtatggtaggttttgatgatgacatggtcgagaatcttcgtattgctggcgaataccatgacgaaggcaaaatcgatgcacgcttccagactttgctttatcagggacgaaagccgcaggggcagcgaaagtttcgtgccaaaagtcgatttagctctcgtgcgtgggaacagcagttcaggaaccaatgtcagctgagagggtggcgtcatgagcagcgatccgtggctgaatttgtgttggcatgtgaaaccgaaacggaacttcgtcaattgccggaatatcgcagacagctgatcgaacgactcattggaacttcgcatggtcatggacggtcgaccttcgaacacgggacggactatctgttgccggagagcggaggagcatctagagcgcaagcgccggcgctgaacaatatcgctgatgatttgtttgaatctggagggtgggaagcccttattgatcgcaccaatcaacgatatggtttctggggagtctcctatatggaagcactcttaagagcggctgacatcacctgttcgaaggagggattgtaatggctattcggataccagcggatattactgacgccttttcccacctcatgatggtcggacttgcttcaattctggaagatgatgatagtggccgacattgcatgatccggtgggtcgattttcgtcatgcggaactgacgataagtgatgatttggatatggaagcagtatccgtcatagtcagtaatcatgcagaacgatggtcttccatgaaggcattgcaatctcgcggagactatacggtttccggtgcgagagatgcagggaagagctcttccatgcatgccactatgtcaccaagattgagtgctttgggtgtgccgggtggctgggagaaactgtctcaagatcgcgaagcggcgattgacgacttgcgaacttggggcgattaccggtatttcggggcattgggccaaccttcgtactggtcaggtgaacggagtaaaaagttatggtctgacgcaggtgcctcgcgttgggaaatggttacacgcaaccaaggccaggaattcgttcaaggtcgattgcttccattggctcaaaaggtagctgagcgttccgttcaagctgtacaagatgggttgatggggaaggatattgttgacgaagcgggcaaaaatagtgcgacgagtcgcactgcgactggactgcatgcgccgtcaaaaaccgataacgctcgcgcttggtgtgcattgatgggcgtgtctgctttccctacgtgggtttgcaccagtgctgggaacgatgatcgtgatccgagtacggctctgtttcagttgaaaggacctatccgtttcgctgtgcttcccataacagacaagccttggacggttgcgaaatatcgatcggtagttcgtagtagcgcgctcgccgaattcggcatacaacagaagaccacgacgaccgacatgacaacaattagctctgctgctgattggttgcgcgaaaaaggcgtgtgtgcctgcgtactgttcaaccagtttgtttccgacaacgctagcgcgccggaacgttggcttgagccgggagaaataattcctctgtaaatgcgaagaatcggagaaaaacatggacgatgaccccatcccgattagcttggttgccaactacatgttctgcccacgcagagcatggttggaagctgtcggagaaaaagtcgaatcggcacagattgcgcaaggcacgtatgatcatcgaaaagttgatcgttacggtggcgctccggacgccgattcatttcaagcggtaaatatcaggcatgagggatggggcgtttccgggcgccttgatgcagcgtgcatgacggatgatggaatcatcatccgcgaatataaggccaccccggtaaaacgtgcgatgcaagtcactgaagcaatgcgaacacagttagctttgcaggcggcttgtttggaagatatggggttctccgttgcgggcactgaaattttcttcaccacgcaccatcgtcgtgtggaagttgagcttgaccaagaggattatgaccaagcgcacaaagcggtagaggaaaccagagcgttgattaatgctggtcatgctcccgagcctctagaagatagcgccagatgcatgcgttgctctcatgctgggatatgtcttcctgaggaacgtcagctatgcgaagtcacgcatagaatcatggtgtcgtctccagacaaccaagtaacgcatttggcaaccccgggagccaaagcatttacacgatcaggtcgaatgatagtacagaagaatggtgaagaactcgcatccgtgccattggacaccattcaaggtctgcagatatacggaaacactgatctgtctagcggcctcattcgtgagctgatgtggcgcgatattccaatcgtatggtgtagcggaacgggaaggatgtatgggtgggcgacatcatcctatggtccgaacggtgaacatcgagtggatcagcacgttgcctctcatgaaggcagactcggactcgcgagagaatttatcatcgctaaaatacataatcagtccgtactgctcagacgttcagaatcagacaatctggtgctacctcagctgcgacaaatcgaaaaacaggtagctaacgcgaacaggtggcaggacgttttgggattagaaggcgaagctgcatcgctctatttttcgcagtttggacatctcgttaagactgaaaaaagagtcgattggccttgggtcgcaaggatgcgtcgtcccgctcccgatgagcttaactcattgctagacttcacttacactctgctgctttcagactgcgtgagagcattgatttcctgcgggcttgatccgcatgcgggctttctgcatagcagtaaacgaaacaagccagcactggcgttggatcttatggaggagtttcgcgctcccattgcggattccgtggtgcaaacagtcattaataatggcgaaatcagtgtagacggattttcacatgtgcttgaatcagtacgtatgactgataagacgcgtaagactgtcatccaggcatacgagaggcgtatggagacggagattacgcatccgatatttaaatacaaggcatcatggagacggattatcgagattcaggctcgaatgattctggggtaccttgacggaacgcaacctgaatacagggggatacgaattcggtagaagcggcaacggtggaagcggtttcatatcgggaggcggatgatgagtgacgaaaaacgaagttatcttgtggcgtacgacatcaatgatgatagacgtcgtgatcacgtggcaaaaatattacggtgctatggcgagaggttgcagtatagcgtgttctttctgcggattcggcctgcaaaaatgctggttgtccagaatctaatagaagttgaaatcgatggttcaacggattcagttgttgtctgttttctcggaaaagaagagcaggcaagagagggaatgtcattcttgggacgacgggaatacagtgatttaaccattccgacggttatctgatttcactttaacctctctgattgtctttcacctatgtgattgtggcttgataattcaaaaggttttttatgaattttggaatacgagaggtgaatcattgctgcgacacgcgatgacctctcgcatgaggaaatataagggtttatgtctctttttctggtgataaactgactggagggagaggtatctgttccgctctcgcaaagtttttaattcgcttagtcattagagcggattagaatgagaccattcctgagctaatcagctcaggacttcattgaggagagaagtttaggcatggaacgcagatcatggatgaattcctgagctaatcagctcaggacttcattgaggatggttgatgcggagactttgccgcatttcaggtaggattcctgagctaatcagctcaggacttcattgaggaaggatcaccgtgacgatcagcaacaactccacctgattcctgagctaatcagctcaggacttcattgaggacggcacggaagacaggacggggcacgtcaggcgatcggattcctgagctaatcagctcaggacttcattgaggatcgtcctcatgcggatccatgagctggtggacgtgttattcctgagctaatcagctcaggacttcattgaggagataggcaatgtttccatcaaaattatatcatgcggcgattcctgagctaatcagctcaggacttcattgaggatccatgctcataccggtggccggcagcgtgtcgcgggattcctgagctaatcagctcaggacttcattgaggaccgaccagccgggaagccgtccagcagacgaatactgattcctgagctaatcagctcaggacttcattgaggacagccgcagctggccgcagccgtcaagggcgcgaccattcctgagctaatcagctcaggacttcattgagggctggtctgcacgaaggaactgtgcgacgagatcgtaattcctgagctaatcagctcaggacttcattgagggaggtggcctgagcggtaaccttcaacacttcggcggattcctgagctaatcagctcaggacttcattgagggggaaagctatccggtcgtttaatcgccgatcagagattcctgagctaatcagctcaggacttcattgaggactcgacggtgacaaggtcggcagcgtcgtcaacggatattcctgagctaatcagctcaggacttcattgaggagcgcgcggcggcaatccggagactgaagccaggttcattcctgagctaatcagctcaggacttcattgaggattgtcggagtacgtgatggtgaactggtggttggcgattcctgagctaatcagctcaggacttcattgagagtctattggctctgattgtcgttgtgcgccctggcttgtgaagccgctttctgaattaggaatagctgctatcagggagggcaagagaactatgtcaaatttgacgtagattgtggcattttctgtggccaagttcatccttgatgaaaggatttctacttgtaatgtagtattggtgcgtatgatgctgagaattgacgagcgcgatttgaggtcgaagctcaatgagcacaggagccttattggatatggttccaagggcgacggcatcgccaacattgttgcgggcctattctatattccaacagcatggacgtttgcggaattgccgatgcgggcacgatgcttatttgctgtgctgggtgttgtgataatcgcgttgggtgtcgcgagtatcgtatgcaagggactcacttccgaaaaactatataaggaaatcgaatcgatgaacagaagagctagctctctcattgcggtcaaggatggcatggacgcgctgtccaaccggtatctgacgtattacgacgagcagtggaattgttggtttcttccgaaccatcgttcatttgattcgtatgaggaagacaaaagaaagctttcgtcatatctttcgtcggaattcaagattccgtctgacgatttccaaatgagattcgttggaactgcgaccagtacaaagttgtctaccgcgcataatgaggagcgcacttacgattaccgattgtatcttgcgtcggtgatccggattcctgatgcttgggatgctgaaggtgagttcgcgattggatccaagaagtgcaagtggatgacggtcggtgaaatgctgaacgacaggaaaatctacgccatcaaccatgacgtaatccaaatgctcaaggatctcatctgacacatgttgagaagttcacttcgcgtataagtcttcccctttctgtccgtagaaagccattttaactcaagtagataagttatgtaagagacatgcgagaacgagaagatttcctgagtgtccaatagacgtccggattttccgccacaacgtcgcgtatacgtccggcattatcggcactcgtgcatccagctgtgtctgcggttgcctcccatggagggtgactggactgtgattttgatgtatgcctagatgctgctttgcaggctgtctgcacaattcgaaattgaagcaagagtttcgggttgcgcagccgcaattgacggacggtgcgtctttcgggtgcaaaatgccttgatcgaaggcccgtgtcaaacggagctctcacgttattgctgtcaagaattggggaaataggcatcaggtttgaggattgcctgttgttaaggccgaaaacgactcaaggaaatctcggtggtagagattgttaagtaggaatggtcaaaattgttaaatagaggttagtgaaggttgatatatgcgatcttgcagagttggtgtgatgtgctaggggtgagcaccctcgttgacgcccggtttggcgacatccagggtactcttttctctgggagatgttttcgctagaggatgttgctttggtttagccaggcacgtaggtcacgaatttcctgatcgcagatgccgtggaccattcccggatattcgaaatacgtgagattgccggtttgcgcaagtttgttgtgcgcgcactgttggtcggctaaaggaattgtgcggtcttcgctgccgtagcagagtgcgaatcgcgtgcgtccggtcgcgggcaaaggctcagcggtttcgcctttgaatgatgggctcatcagaatcgccctgtcgaacgcatcgggatgttccgcaaccatgcgatacgacaggtatccgccctgcgaaaacccgatcagtaccttgcggaaatgcgcgtatgcgggcgaatccagcaatcgtacgacggcgtcgcctacggcactgcactcacgtcgacgctcttctacggaacatccatctggataccagtagtagcttccgatgtaaggacgttcgtacgtgccttggaacgacagataattcggatgctgggcaggagcaatggagttgtccgttgaagatgcgtctcgcttcggaacatcataaatcgcatcaataatgcggatcatctcattttcatcattgctgaatccatgaaatcccaagaacagcagatcatcgccgactatttcgcaggcggccgtctcaatgctggtactcacgttcaaacgcatatcaacctcccatcgcatgtcgatagtatgcagatttccaacggcaccataacggtggacagcgaagtggggaagggcacgacgttcaccgttatgctgccgttggttgaggaaaacactgaatatgtggcgaagtttacagcaatccatccgcatgcaacgcgccatacatgcggtccaggcattcgaccagcagcggatacggcattgctatgttcacgcgcacgcatccggcaccggtctcgccgcatgaacgcccgtcggtcaacgccacttgcgccttctcaaggaagtatgaggccggatcgtcgatgccaagcggcgagaaatcaagccatgcgatatatgtgccctgcggtttgatatagccgacgccggcgaacctttcacgtatctgctcgtcgaacaacgccaaattcctgcgcacataggcaaacgcatcctggaaccacaggtcgccttcgttatatgcggtggtggtggcgattgcgccgatggtggcggtctgatgttcgctccactccgccttgaccgcccacatgtcacgatccgcaggattggtaagcagcacctgcgcgcacttcgtgcccggaatattgaacgatttcgacgcgctggtagcggtcatcgactgtaatgcggcctgctcgctgatggtggggaacggaatgtgcttgccctcaaacacgaacggcgcatgaatctcatcattgaaaatacgcacgtcatactgtgccgcaagatcgctcagacgcagctcctcctccaaggtgagcactttgccgatcgggttgtgcgggttgcagagcacgaacgcatggcatccggccgcaaacgcgcgttcgatggcgtcgaagtcgaacacccattgcgcctctccggtttcggcgtcgccgctttgcagcatttcgatttcgatcacgtcaacgtcgtacagtttcggaacgctcaaaaacggcatgtaggcaggcgtcggcacgatcacgctgttgcccgcaccgaccagttcacgcaggaaaagctcataagcttcgagtacgtcgggaaccacgcgaataatgctcggatcgacatcccatccgtaatgcgagcgttgccatcctgcgcatgctgctgccacgcgctgtttccagggttcgggaatgtagccgagtttgcaatggtcgcaggcgttgtcgatggctttctgaatgcagggagccaagccgtagtccatttcggcaatgaacgcgccaatgcagccggggtagcgtgtccacttgtcggagccgactgcggcaagatcggctgcggtggtgtggtcgatggcgtcggcgtcaaagccggaaccggtacgatgcttcatttccatgatttcttccatggttccagcatgacgtaccgatgcttgcacgaacagtgtgttcttgtactgaaagcaaagactgttatgaagttttcttatatcagatgcttttgctattcaattattaatctgattatgacgatatagcaaaatactggaaacaattgtttgctgcagtattccgcgattgcgaataagcacggatatcaaacgatgaatcaaatgttttccaaatactggtgtgacgccctttcgatctcgtctttgacgcgggccactgccggtcggtcgtccacttttcttgtgacgaaacagactgtgcggaatgcgttgttgtcggcgattggcagtgcggccaaatcgggttggattccagcggttgtggctaagcgagatatgatcgagacgcccattccaacttccaccagattctgcgtggcccaaaaatcgtcggtcgaatgtgtgatttccggtgtgaagccggcggcacgcgccaacgacaccagattcgcctggcaggtttcgcagccggcgatccactgttcgctgcgtgccgaaaccaattggaccggcaggtgcgagctttcgtactggcgcgcgatcgcattgttcgcgccgatcagcagcaccagcggatcgacgccgaaaggagcgacttccaaatcgtccggtccggccaaagcggggagtgaattgtattggaagatgatcgcgcaatcggcaagtccctgttccagcgcctccatggcctcaggcggctccatctgcatgaggctcacgcgaatgtcggacgttttgctgatatgcacgagcacgcgtgccacgaacgacgaacataccgatgggggagcgaccaaacgaatatgcgtcgatccgttgcgctggtactcttccacatctttgacggcttgggtgacgcgattgtcgataagctgcccgtgacgtgccagaatacggccgatcggagtcaattccacgccatgcgacgtgcgctgcacgagctttgcgtcaagttcacgttcgatcttgcggatctgctggctgatggccggttgcgaccatccggtttcacgcgcgaccgcggagaacgagcccaaacgctccacgttccacaaggtcaccagaatctgcgggttcagtgttttcgtgctgaatcccgtggcattcgtggtgatgctgatgtcggtgttcgtgttggcgttttcacgcgtgttgctatcggctggagtgttcatatgagggtagtgctcagctttttaggaatgcggggatggcctcggccgccgcatagcctgcgcggtacatgcgttccaatccttcgaacgacttgctcaacgtgttcaggccgtacaggctttccggtgcgaggatgagcacgcggccgtcctgctcgtattccttggccagcgccacttcgtcgttgtacgtctggtagcggttgagcagtttttccgcggcttgtggatgcgtgcgcctcaaaatcctggcggggccgatgtccctcttctgttcgcgtacggtgtctttcggacgggtgagtatcaccacgatgcggtcgtggccgtcatcgatggccttctgcaccggaatcggatcggcgatgccgccatcgtaatagggaatgccatcgatcgcatacggttcgcaagctaccggcaccgctgatgacgccttcaggatgtcgaaattgtcgtagcccacgtcggatttgccgaaatacttcgtggagccgtcttcggcgttgcacgcaaccacggtgaaaccggtcgggttggcttcgaaagccgcgtagtcaaccggattttcaccatcatgattgctgagcgtgctatacacgtaatcgaggttggcgaaattatggttcttgacatagctgtcgaagctcgcgtattccttgcggaacgcgtactgcgtgtagaacgtgtggttgcgcccatgctgcttcgcgatgaacgaaaccatgttggcgctgccggcggaaacaccatagcagtggtcgacgctgatgccgtcctcaagcatgcggtccatcacgcccgcaccgtaaatcgcacggaaaccgccgccgacgtcgatcattgccgtcctgtgagccatatgcgtcccgtcctttcgccgttcgtcccttttgcgggtttcaatcgactttacgcggtctaattgacgtatttttgcgtgttcggtcatttcttatcgaaggacgacgtaagatatctgcgaataatcaacaaaaatggagtggagaagatatcaatgaacgaagctgcactgcctcagtcgacggtccacatcgcccaagctgatccggacgggattctgctggtgattcacgcgggtgccggcaatcgtggcaaaaaggatacgccggagcgtcgtgcccaggtggagcaggatttgaacagggctcttgaagctggctatgcgttgctggagcagggggctccggcggaggatgccgtgtgcgcggctatccgtgttatggaggatgctccggagttcaacgctggtcgtggtgctgcgctgacgagtgaaggcatcgtatccatggattcctgcctgatgactggtgtcgatggcgaggttggttccgcgtgcggtctgaccacgtctaagaatccgatcaacgtagcgcgtgccatcaaggaaaagaccaagcatgtcatgtttgccaagcctggtaatgatttgcttaaggagtggggaatcgaactgtgcgacagtgattatttcatcactccggcacgtcaggaatccttgcgcgaggcgcaatccaacggcgatgagtgggagaagcatggcaccatcggcgctgtcgcccgtgactcgtccggcaacatcgctgccggcacctccaccggtggcattaccaaccagatgccgggacgtgtcggcgattcgcctctgccgggctgtggtacctatgccaacaacgattccgtcgcgatctcctgcaccggcatcggtgaggcgttcgtcaaggaagtcgctgcgcatcaggtttccgatcgtgttctgtacgccaaggaggagccggtcgaggctgcgaaggcggcgctggatggtgtcgcccgtcatcatggcgatggcggtatgatcgtcgttccggctcatggtgaaggcgcaatggtgttcaatagcgagatgatgaactgcggttggaagtctccgaagggtagctacgtgcagagttgatgctgtagtggcaaaccggcaaacaagccacaaaagtacagtggggttcgaatccatgaaggattcgaaccccactgtacttgagctccctatatggccggcgaatcgttcgtccgccggccagaaacatcacttagtgatggtgttgtaggtaggcagattggtgtaatcgaacgacacgttcttcacgttcgtcgcggacgcggcggcgacgttgtcgttccacagcggaatcaccggaagatccttggccagcacttcctgcgccttggtgaagtcctcggtccgcttctttacgtcggtctgggcaagtgcggcattcaggagctcgtcgaattccgcactcttgtaatcaccatcgttcgaaccatgaccgtcagcggagctggaggcatatagcggattgagataatcttcagcggacgggtaatccagcatccagccggcacggaacgcggttttgatggtgcggttggtcacctggttacgcacgtcgctgaacgtggcgtacggctcgccagcggcgtcgatgtcgagtgtgttcttgatctggttgcacacggcatcgacccattccttatggccgccatcggcgttataggcgattcggaagttgccggaccacggcttgatggcattggctttcttccagagttccttggccttggaagcgttgtatttcaggttgctgccattctgttccagtttcttcacatattcggggacgagcggtgaagtgaaatcggtggtcggggtcttcgtgttgttgtaaaccttcttgacgatctggtcgcggtcgatggccatggaaatggcctgacgacgcaactggccttcttcgtcgttgccgaaatgctcaagacgttccggaatgacgaaggactggaacgaggatcctgcctgactgtaggcgatcacgctggaatcctgacggaaggtcttcaccgcagactgtggaatctgatccatcacgtcgaggttgccagacagcacgtcggagtaagcggaatcctcattcgtgtagacgcggtattcgatgcctttgttggacaccttgcggctgcccttataatccttgtttggtacgacgatgatgttcttgtcgtgggaccaggacttgaacttgtacggaccattgccaatcggagcctggccgaacttcttgatgtccttaaatgccacgcttggcagcgggaacatggattggtgcgcgagcttggtcgggaatacggaatcaggcttgttcagctcgacgaccagcgtgtagtcgtccggggtggaaagaccggaaagcgtggccttcggatcgacgttcggatcctgcagttcgtcatagcccttgatggtggagaatcggcttgcggtcttctgcgcgttcttcacgttggcggcgaaactccaggtgtcggcgaaggaatgggcggttaccgcctcgccgttggtgaacttccagcctttcttcaacttgattgtgtacttggtggcatcctcgttcggggtgatactctcggcgacttcgagatgttgcttgccctttgcgtcgaagctcaccagaccttcgaacaggtatcgaataactctgccgccgcccatttcgttggtgtcgcttggaattagaccgttctgcggttcgctgttgttcactgaaatcagcgaggtgctatcggagccgttggaggctgtgtcatcgttggaagacgatccgcatgcggcgatcgacgtcagcatggcacccgccgcggccatggccagcagacgccgaaatgtgttgttcttcatttcattctcctttaatgtcgacttttccgccgattatgtcgacgaaaaaacaataggacataatatgggagttttataaaattttcgtgtcatgtctcaatttgaaaacgaaccgctggcaggcgttggatatggacgttatcttcagctttctaggaatgcggggatggcctcggccgccgcatagcccgcgcggtacatgcgttccaaaccttcgaacgacttgctcaacgtgttcaggccgtacaggctttccggcgcgaggatgagcacgcggccgtcctgctcgtattccttggccagcgccacttcgtcgttgtacgtctgataacggttgagcagtttttgcgggtttcaatcgactttacgcggtctatcggaacattcgcgctcagcgatcaagcagcgattgcgctaattgcgcgatttgtgtggaagtgtcggaattggccagctcgataccaccgtccgcgtcttccggagagagtttgcccaacgattcgagcactacgccaagatggcgcacggtaccttcgttgccgtcgatgattgccgctgtgtcgggcagcagttcgcggaaatagtcgcggtaaaacacgaaatgcgtgcagccaagcactaccgaatcgatcgtcgacaaatcatactggtcgaaatactggtgcagcgtgtgcatcacaacatcgtgatcgtcgagttggccgtgctcaacgatctccaccaaaccggggcagggttccggaaagatcgtatggtctgttttgaaacgatccatcagcacggcgaacttgcgttcccgcaacgtcaggggagtagctgcgacgatgacacgctgacgattgccatggcctcgatcgcacgccaccttcagcgctggttccatgccaatgatcggaatgtcgtatttgtcgcgcaactcgttggctgcggcggaagtggcggtattgcaagcgatgacaaccgctttcactccctgctccacgaaacgtttcacaatggcgtcggacagcttgcgtacctgttcaggtgatttggttccgtaaggagcgttcgcggaatcgccaaaatacagcacgcgttcgttcggcatatcgcggcggatttcgcgcgccacggaaatcccgcccaaaccggaatcgaaaacgccgattggtgccgttgaagtcatacgtcctcccttgttccgcacgcaaacatactgcaacataatgcacacgtgttgcgtccaacttcttcaatagcctaccgcgtgtagagtgaatcggtatgagcattccaagcattgtttacaaagcacacgccaccggcaacgatttcgtggtgtatctggacgccgaaggcacgtacgagcctaccgccgatgaagtgcgattcctgtgcgaccgtcatttcggtatcggtggcgatggcttgatccgccttactcatccgcaggcggtgtccgatttgaacgacaagcagattgccgtttgtgctgccgacaatgcggattggttcatggactaccgcaacgcggatggttcgttggctgagatgtgcggcaacggcacgcgtgcgatcactctgttcgcgcaacggcagggtattgccggtcagccgggcggtgaaccgttccgtctcggcacccgtgccggtgtgaaggttctgacttcacttggcgatgtgccgactcttggcaaggacgtgttccaggttgagatgggttcatggaagcgtggcgatcttgatggatacgaagtgacgattcccggcacggccggttccgcacgcggcacgttcgtggacatgggcaatccgcatgtggtggccgtcatcgaagacgcgttctccagcctgccgacggtggaacagcttgatttggtgaccaagccggtggtcgcgccccgaatcgaaagcgaccagaatgttgagttcgtgcgcatcgacgagcaaagcgaaggcgacaacgagggcaacgccaccatgcgcgtcaacgaacgcggctgcggcgaaaccctgtcgtgcggaaccggcctgtgcgccaccgccatcacgttgcgtgccaaaaccggcatcgaccattggacgatcaccgtgcgtggcggcaccctgcgcgtcgacgtgaccgataacgacgtgaaactcaccggatcggccaccatcgtcggcaaaatcgaactgctgtaaggttttgcgcataacactgaaatttgcggatacgcaaaagaaagaagccggctgtttccagtcggcttctcttgtaggcgagtgaatccctactgctgattggacgttacttgacgtcaactgaacagcagggggccgtcttcgacgagaatgatcacaatcaatgtcacgatccataaggcatcgaccatcagatcgtaattaagacggtagtaggtgcgtacgccctcgcgcttggccggaatctcctgaaccaccgccgtggcatgagacaacgccatgaactgcacggtggtggagaacatcaggcacagacaccacgggcatagcgcgttgatcacaaacaacgactgcgaggtcagccaatacgaataagccagcgcggccaatccacccagccatgtgcacaacgcaaaccagcggggcacggcgaccttcgtcaaaccgatcaccgcgatcgttacgaacactgattccgcggcgatgccgaagaacgcattcgggaaactcaaaccggcgaacttcacaacctcagcctgccacgattccgcaaccgcggaacacgacatcacggcattcacatcacagctgagcttctgaccgggattgcgcgccaatttcagtgtctcggcggaaagcacgaacgatacgaccagcgctaccgccgaggcgatcagcatgatcagatacgtccatgtcgcggtatgccgccaaccgcgcggcttcgtataatcatcgtcgagagtggcttcggcaacctgttcgccggaaaaatcgctcatcgtgcatccttgaatcaaaatacaaacgttgtcatcgcctagtttacgcggtattgtgccgagtcgcgccaaaaacagcttacgatggatacatgattcgcgtaggcactgcggcaccgcccgctgaaggttgggacattcactgccataccgttttttccgacggtacggaaacgccgcgtgcgttgttgcaggaagcgagagcattgcgattgcatggtgttgcgattgccgatcatgacacgacctccggttggcaggatgcgttggctgcttcgcgggaggtcagattgccgttgttacgcggtacggaaatcactgccgtcgatgagagcgtatccgtgcacatgctcgcattccaatatgatccgctgaacgccgatatcagcgagatgttcgcgtccacccgcgaggcgcgactgcgtagaaccaagcgcatggtcgaactgatggcgcaggattttccgattacgtgggatgatgtgctcgcgcaggtgcgtgaaggcaaacgcaccacgataggccggccgcatatcgccgacgcattggtggctgccggcgtgtatgaaacacgatccgacgctttcgccgatgcggtgagcgcaacgtcgaaatattacattcccacgccatcaccgaccacgcacgacgtggtggccgcggtcaagggtgcgggcggggtggtggttatcgcccacgccggagacccccggcgcaatcggacattactgaccgaccggcaaatcgaatctctcatcaccgaaggcttggacggtttggaagtgtggcatcgcggcaatccatcagaacagcgtgaacgtctgctcaccattgcgcgccggcacgacctgctggtgactggcggatccgattggcatggtaaaggcaagccgaacgcgctgggggagaacctcaccagcgacgaaacagttcaggaaatcatcaatcgaggcgtccgcttgagcaaagaatcgtcgaaggcgaaaataaaaaaccaaaacgcaatcatcgacgcgtaattgagatatgaaaccagaaacgagttgatcgcccaaaatggaaaagccaggcgcgaacgtctagcttttcttgttacgtcgaaaacgtgtgtttcagttcgaagctgaaatctggtgatgcgaacgggtcagaggttgccgaaaccgacggcgtgcttggtttcggaaccgatgatggcgtagccgagcgagcctgccggcaccacgatgcgacgacccttgtcgtccgtcagattgatggtcttgccgttctccacggcgtcggcgatggccgcgttgacctcatcggcgctctgttcggtgctgaaggtgacggtgcgggccacattctgaatgccgagttcaatatccatggatgctccttcgtgataatgcgcaatgcatgcgcacgtgtatgtacgggttatgtgcgcctattctacgcgtagcttctcatcggtggcgtcttccgcctcccactgattgatctgcgcctgcgctttctgcatggtcgcctcatctcgctccaacagtggaatgagtactgtcgcggcctcgctgtgcgatgcgggaatcgattcctcgttcgtatcgtcgttgtcgtcggccgtttccagcctgctgattaccatggtggaacttgacggcatggattcgtgccgttcttttgcggaatgttccggaatgaaagtgctgaccgaggtcgcctcatgttcattcgtattgccggacggtgcttgtgatggctgggctccggccggtacgaacgcttccgtcgcgtcgttgacgatttccttcgtcttgcggaccggctgggagccggtcacgtcgaaatcgccggtcgcgtcgaaatctccagtggaatcatccatatccacagcgtcaacatgacgttcgccggtcgtgtcggaatcattctgctgtgcggccgcgttacggcgacgctccgattcgttcagcaacgtgcctacggtgattgtgctcggcgggcgctgggggcgatccttggactcctgcttcgtttcagtttgcacgcgattcttcgctgtggcgacacccaactggtgggccaggcgttccacctgcgccttgaattgcataatcttggcgttgtctgccttgttcaaagcggaaataaaatcgccgacctgctccatctgcagccacagattggcccgcagcataatcagatcatccaaacgattgcccaacatgcgaccgtatgcggaaagcaaggcattgcggtggttctcgtcaagcttggcgaaaatccaagccaaatcgcgggcaggatcgttgacctgcatatcctgccaattcgtgaccgcggtgatggacgaaccggaaaaaagcacatcgccgtcacgcaacccgccatgcaccgggcaagtggagaacgaccataggccgtcggtttcaagaatattcgcccaactagtggtgatctcctgcggaacatgaccagcctgacgcaggcgcttgatccaagcggtcagctgagcgcgaatctggccggtgacaaacgtcggatagcccgcttcctgcaggaagtcgggacgaaggcgatgaatcgcgcccaaagcggtgcctacgctggaacaatcatccaaagtcagcagctccaacggccgcgcctgacccacatggtgggtggccaccagcacggacgtatctccagtggcggaatgcttcaaatcgccgtttgaaaaagctactatgctatcgacggcaaaacccaatccgcctaattcgcgggcttgcgagagcgtctgcgcagcgcgcacgcgaccggcaagacgcttacggccttcaggcgtgttggatgcgaacacgtcatacagcttgcccgctgcatcctgaaccacggcatggtcgacgccgtacccctcgtcggtcgggttggtctgttcgctggcacgcgcgcccgcaatggcggcgttcggcatcgccgcactcgtcagggcagctatcataaatttgcttcgttcggtcacaattccaaccttaatacacaataggggcgaagcgttgccgacttgccagtaaaactgcaggtgaaccgcgggcaaatcgtcacatggcgacggcaatctgccacaatggaacgtatgagtgcaacagcggaagagattcttgacggattggatgaggcgcaaagggcggccgcaacggccgtggacggtccagtgcgcatcatcgcgggcgcgggcgcgggcaagacgcgaaccgttgcccgcagaatcgcctatgcgtgcgccaccaaagcgtggaatccacgaagcacgatcgcagtcacattctccgtcaaagcggcggcggaaatgcgtagccgcctatcgaaactcgatgtcgcagccgacgtcaaagcagccaccttccactccgcggccctccatcagctacgccaagtgtggccggacgtatgcgaggggccgatgccgttcatttccagaaatccacgtgaactggtggagcgctcgctgcgccgcgtcaccaccttccaagtggatgacgacaccatacgtaacttgcaagcggaaatcaactggtgcaaaatctcactgatcgcaccggaagattacgcgcgggtttgcgcggcaacgcatcgacagccgccatcaggcctcgaaccaagccaattcgtagacgtatacaaagcgtatgaggcagaaaaaaccaaccgcaacgaaatcgatttcgacgatattctgctgatcgtttgtcatctgatggaaagcgacgaggaagtggcctcagctatccgctccaacatcagatggcttaccgtcgacgagtaccaggacgtttcgccattgcagcaccgtctgctcacccgatggctcggctcaaaccgcaatatttgcgtggtgggcgatccggcgcagaccatctactcgttcgcgggcgcaagtagctacagtctgctcaacttcgattcggaattcggtccgctcaccgctgacatcaatctgaacaacgactaccgttccacgccgcagatcgtcaactatgccaatcgtgtgcttgcggcatcgccgcagcgggccgattatctgaagctcagctctgaaaggaacaaaggacggagggtcgtggaaaccatatatggcagcgattgggaggaagcgcaaggtgtggcggcgcgcatccgcaaactggtggatgcgggggagtcgccggccgattgcgcgattctcaccagagtcaacgcgcagcagaaaatcctgtgcaaggcattggccgaacagcatttgagatatcgcgtgcgcagggatagcggatggcagaattccgcactttccgacgacacgcagaccagactggccatgttggaggcattgggcgtcggcgcggatctgagcggcgtgaccatttccactatccacgcgtccaaaggtttggaattcaagcacgtgttccttatcggctgctcggaaggactcataccgtatgggttgccgcaggatgacgacgtgcttgaggaggaacgccggctcatgtatgtggccgtgacgcgcgccgaagacacgcttgacgtctcatatgcgcgtacccgtgaaggcaatgagggtgaaagggcacgacgggtgtcgcgctttttccgctgatactgctaacggaatagcgcgattactcggcgtcggtatcgttgttgctgccggattctgcggaatcgtcagaatcgctgccattggtatcggattcgccgcccttgtgctcttcctcgtcaagcagcttgctgagttcggcatcccaatcgatggtcatgccatcggcgtcgccaaggggctgcgacgccatatcggtggcattggaagcggcgaacgtcgtattttccgtgttttccgacgatccgttgttctgcgactgtgaggtgttgtcatcgtcatcattcggcagttgcggcagtagatcgggatgtgaccatttcgcgtctcgtgcctgcgcgccttccgtagcgcagatgttatcccacaatgcggccgcttcacgcatgcgcttcgggcgtaattgcaagccgatcaggctttcgaaggtgcgttccgcaggacctccgatggcgcgctcgcggcggagcatctcacgaagctgttcgatatgcggaatatgagccatgccggcgcgccacactacggtgtctacccaaccctctaccaaggcgagcagattctccagcgatttcatggcctgctgttgttcaggcgtgtcagggaacgccaccttggtgatgttcaccgcgtcggccatggaatccgggtcgacggactgcgcatcgcggatctgctcctccatggcgtccaaatcgatgctggtgccacgggcatacttgcccaacagcgcctcgaagcgtggcatcagccacggcacggaagcgtacagacgcgaatgggcgagctcttgcagtgcaagatagctcattacttcgttcacgtcgatttccaaggatttcgcatattcgacgacattctgcacgatcaggcctccagccggattcttcagcaacgaaatgctttggtcgaaactgccgcgcacctcatgcgacaaatcgccggcggcacgtcccagctgcatggcgaacgacgtattgccgacgaaacgcatgagttttgccggatctttcatatcatcgggaatcggaatctgcaccggaccggcgaaaatgccggaaatttccgtatggaattcggaatcgccgaaacgctgtgacaaaatcgaagccagagcgtcgctcatcgactcggcaatcggggatgcaaactgcgcccaggaatcgatgcatccttccacccagcctgcgcgggtaagcacctgcgtttcgccttgcgcggggttgaattcgcaagcggtgtcaagccacagattcgcctcgctgatggctcgccgggccatctcgccgtactccgcgctcacactggtttccgatccttcgccattggcctgctgcaatgccaatgatttcgccagtttgacgttgattggaccttcctcggtgatgtgctggatgtctccgaaagtgttgagcccgcccgcagtgaacgcctgcatcatcgacctgacctcggccggcttgggaagcttgctcacatcctgactcatcaactggtcgcgcaactcttccggcatgttggaaaactggttccatgccatctcgccttgaattggtccgaaacaatcgataaaccattggcggatcgcgttctcgtccatgccggccctgccttttcctaagcgttttttcaagtttggttggttccatactatgttatgggaggtatgcccaagatgaaggaaacacgacgaattcacggcaaaaacacacgtagcggagctccgggacgtgtcaaacgatggctgataggcgcggaaggttggctgtccgcgcgttcatggcgttatcttgcaggaccgttggtggcggtactgtgcgtattggtgttgattatgcccagcgcgtatgtggtgcaggtgcccggcccgacacagaatgtgctcggggaggtttccggcaagcaggtcatcgccgtttccggtgcgaaaacgtataaggattcaggccaactgctgttggtcacggtcaatgcttcaggcgtgccagggtacccggtgtcgaacgcgcaggcattggtggcgtgggccgattcgaaatccacggtgatgcctcaggaagcggtggttcctgttgggcagaccgcagaggaatacaagcagtccagcgacaaggagatgacgtcatcgcaggattccgccaccgcagcggcgaaaaagttcctggaagagcatggttatgacgtgtccggcatgaaggtgtccatgcatgtggacgacatcggcgggccgtcggcgggcatgatgtacacgcttggtctgatcgacaaggtgaccggtgaaaaactttctgggggtaagatcatcgcgggaacgggcactatgaacgacaaaggtgaagtcggtgaaatcggaggcatccgtttgaagatgctcggagcgaaacgcgacggagcaacttggttccttgccccggaatccaattgttccagcgttgtggatcatattccggaaggtttgaacgtggtgaaggtgtccactttgcaggaggcgtacgatgcgctggttgccgtccgagacggcaagggtgcatccctgccgcaatgctccgcgggagagtgacgcattccgagatataagaaaaaacaatctcgcaaagtgagcaattccacggttcgtaacgtatatgttcgagcagtgttggtatattgacgaacgtgaatcaaacggcatctgataacgctgaagaattcggtttccacgccggcgacctggtacaggaatggctgtgggacgatgatgtggacgactcgatccgcgccaagatcgaggagctgaccggtgaagagctggtcgacgaggactatgattccgccgttgatggcgtgattatctggtggcgcgacggcgatgacgaagacgaactgtctgacaccatcgtcgatgcgtatgcggtcctcggcgacgatggtccattgtgggtgctcaccccgaagccggggcgcccgggcgcggcaagttcaagcaccgtgcagtccgccgcgaagaccgccggcatgaatgcagccacgccgctgaccgtcagcggtgactggaacggcatccgtctgcgcgcattcggcaaaggccgctgatcgtattcgttttacccgcctcgacacgcatggccaaggtcgggcgctcatataaaggcttggaatcacacgattccgagccttttttgcttgcggaagcagtcgaagaagatgtttccatgaaattgtctatattgacaaaagtcatgactttgctgacacgcacacgagatagttgggaatatcagaagagtcggaacggcttattttctgcggaaacaaaaggtgggcgatgagggactcgaacccccgacatccaccgtgtaaaggtggcgctctaaccaactgagctaatcgcccgcaaaactctactgtacagtattcgttgcctgcgacagcttcaacgtgtgtcgcgctgcccaataggggttccttccatagtaaatgcgtgaaaaatggtgtgatttgagtgtcgattcgctgaattttccacaagaaagccaaaagcgtcgaatcaatcacgtagagtaaggacgttgagtagtgcagtaggaggtcgatagccaatggcgcaggaacctgaatccgagaggaacgcatcggggatcgctcgtacttcaaagcgcaagtgggggtatgattccgaacaggtggacgcttttcttgagcgtgcgcacatgctgtacgaaggtgagggagcgcaactcacccagcatgatattcagaatgtttctttcgatttggtcaaaggcggctatgtgatcgcccaagtggacgcggcccttgctcgtttggagcgcgccgtggtggacaagcagaccacatgggagatttcgcagcacggtcgtgtggcgtggaaagcgcagaccgaaagtctgttccgccagcttgacgcccattccaaacgtgagcacggcgaacgtttcaagccaggagaaggcaaggaaccgagctatgaccgcaagcaagtggatcgcatcgtcgatcagtgcctgacgaaggccgctggcgagctcggcgttgaggaagtgtcggaagacgatgccaagaaacttgtcgatctgaactcccagaccgtggcgaatgtgatcttcacccagcgcaagggcaagcgtggctatgacgagcgtcaggtggattattacctgaacgaatgcgtgcagctgctgaccagactcgaatcctatgctcgtgtggccgacttcgtgggcgagccctccgaaagcgcgatgaccgcagccaatccgcccgcaaccagtctggcatcccaagagacgcaggtggtctcgccgttattcgccgttccagccgtttccgcagaacctattgcgcagcccgctcaggttcaaaacagcactgactccttcgacgctttgaataaggcggaacgtgagattttcaccacgcctgcaacgtccccggtgagcattccggccactcaaaccgctgcgccgacgtatgctcccgtggttccgcctgtgttccagccaaccatcagcaccccgtcggctccggtaactccggcagctcctgtaacgccggaacctcaggccgctccggttgctccagcggctccggaacagtcgttggcacacctgttcaaagcgtccaatgcggttgacgaggagccatcttccgcaggaacggaaaccgaagcgttcaatccgctttctgatgatggcgcgccgagctatgacgctccggccgcgcctgcggctcctgtgattccagacacttcggtcgcacatcagccggaagaatctcacggcatcaccatcgctcccgattcttcgttggctgccttggcgcagatggcccagaacatcgacgctcccgatccggtcgaagacacgttcaccccgcgcatgccaagcctgtcgacgccgaaccttccgcaggtcaataccgactcgattaatctcggaaccttgccgaccgtcccaccctccttcacgctggaaccagcaacctccgcagatcactcgacaacggcaactcccgttgaaccggcgaaaccggcagaggaagagaagaagaacgaaaccaagccggcaaccaatccgatgttcgaagcatccaacagcaatctggatgtcgatattcccgacctgtcgttcccctcttttgaataggcaatcgcactgaacaggctgacgtgaccgtcagcctgttttcgcgttcacacgaataatccaaaacaaatacggagcacacgcataacccatgcaaacctcaaccgtagtcattctgggatccaccggatccatcggcacccaaggacttgacgtcatctcccgccatctcgaccgtttcaacgtggtcggacttgcggcaggcggctcccacgtggaacttctggcccaacaggcggtccaatttcacgtttcgaaagtcgccatcttcaacacaaacgcggtccatgcgctccaagatgcgctaaaccaagccggcgcaagccatgtggaaatcatggccgggccggaagcggtaatcgccatggccggatccggtgccgacgtggtgttgaacggcattaccggatccatcggccttgaaccttcgattgcggcactgcaggcaggatcgcagctggcgctcgccaacaaggaatccgttgtggccggcggtcatctgctgttcgacgcacaggttcgtgcgcagcagatcaatccggttgattccgaacattccgccatctggcaatcgttgcgttcgggcacgcacggtgaagtgtcgaaactcgtggtcaccgcttccggaggtccgttccgcggttggaaacgcgagcagatgaccgacatcacgcctgaacaggcgttgaaccaccctacttggaatatgggtccggtggtgaccatcaactcgtccacgttgatgaacaaggggcttgaagtcatcgaagcgagccgtctgttcgacgtgcctccgagccgtatcgacgtgaccgtgcacccgcaatccatcgtgcattccatggtggaattccgcgatggcgccaccatcgcacaggcttcaccgcctgatatgcgtctgccgatcgcgcttggcctatcggctcccgaacgacttggcaacatcgcagcggcctgtgattggacgaaagccgccatgtggacgttcgaaccgcttgacgatgaggcattccccgcagtgagcttggctcgacattgcttggaagcttccgaaaagcatacggccgtgctgaatgctgccaacgaacaggccgttcacgccttcctcgaacatcgcttgccatatctcggcatcgtcgataccgtcaaggaagtgttggacgaaatggatgcggaactgcgcggcaatccgctattcgcttccgtggaggaaatgagccaactcgagctggaagcccgtcgtcgagccgacgacctgataaacaagtaacggaaaacgaaacaaaacaaacagacgaaacgtaagtgacgcaaggctccctaagtcgggagccttgttattgcaaggatttgacgtatgccagaaatcgaaaagccgttccgtaaaaccggtgaggcagccattagcgaaagcccgctgcatccgcgccgcaaatcgcaccgtattatggtcggtcccgttccagtcggcgggggagcgccaatctcggtgcaatccatgaccaatacgctgacagccaatgttcccgcgacattgcagcagatcgcggaactgaccgcagccggctgcgatatcgtgcgcgtggccgtaccaagccaggatgatgccgacgcattgccggaaatcgtaaggaaatcaccgattccggtcatcgccgatattcatttccaaagcaaatacgtgttccaggccattgacgcgggctgcgctgcggtgcgtgtgaaccccggcaacatccgcaaattcgacgaggttggcccttccatttgcaaagccgccacggacgcgggcatttcgttgcgcatcggcgtgaacgcgggctcgctcgataaggaactgtatgcgaaatatggcggtccgacgccggaggcactggttgcgtccgccatgaaggaagcgcgcatgttcgaagacgtcggcttccatgatttcaagatttccgtcaagcatcatgatgtgatcaccatggtggaaacgtatcgtctgctcgcttccaagggtgattggccgttgcatcttggcgtcaccgaagctggaccggcatggcagggcaccatcaaaagctgtttggcattcggtgcgctgctggctgaaggcattggagacacgattcgcgtttcgctgtcggcaccgcccgtcgaagaagtgaaagtcgggtgcaagctgctggaatacatgggattgcgtccgcgcaagttcgacattatctcctgcccgagctgcggtcgttcccaagttgatgtgattcagttggccaatgcggtgaccgaaggtttaaaggatgtgaccgcgccgattcgcgtggctgttatgggctgcatcgtcaacggtccgggcgaggcccgtgaagccgatttgggtgtggcatccggcaacggcaagggacagattttcatcaagggcaaagtcattcaaaccgtgccggaagaccagattgtggaaacgctgctggtcaaagcgcaggagatcgccgcgcagatggaagcggacggacaggtgtccgtcaacgccacaggaccggtggtggtgccggtggcgcaaggtaattgttgatttcgctgaccgcgggcggtcgattgcagattgtgatcggccgcccgctggttttgctggttgtcgattgccatttcagctggagtcggtacaatgaacggcgtgtcagatcaggaacgtcagtcagtcatgtccagcgcggagagccaatccagtcagtggacgaggggcagacggctgatggtcagtctgcctatcttcatcatcctgctgggcattctggtgtcggtatccaatttgacggcatcgtcatggaagtacgagccaaccggtcaaaccatcgaaacgttatcatccgacacggcagtgaccttcgataatccttccggcaaaacccttgccaaacgaggcgattacgaagtgacgcaacgatatgtcaccattgaggcgaaacagccgtcaaccggtgaaatacaacaggtcaaagtgttgattcgagagccgaaagacgcgggaaacaatcggcccggcgtggtgttcatgcatggtgccggatatggtacctgtgacaactcatttggagacatggccaccgatctctcatccgcaggcttcgtgacggccgtgctcgacaagccggtatggtccaccaacgatgcgacccgtgattacccgggctccgcggccatttacgatcaggtcatcaccatgttgcgtgatctcgacaacgttgacgcttcgaatgtcggcatttacgcgacttccgaaagcacttggatttcctcatatctgcttgatcaagaccccgacgtggcattccaggtgttgctgagcccaatggtgtattcgccacgacattcgttgggattccttgccgcacaggatttcgcgctggtcggagcgcatgatggataccagtccattgtgcgccgcgcgttcaacatcgatgcggaattgttcggcctggccaatctcgacctcgacacgttgaatccccaagcctattccattcccacgcttgtggcatacggcaccaaagacgtgatgaccgcgcaggtggaaggtacggagaaaatcatcgacatggcgcataaggcgggcaattgggacgtgaccgtgcgcacataccccatcgccaaccatgtgctccgactcggcgacgaatccaacagcggcactccgttcgccgacgcctacgtggatgatgtaatcagttgggctgtcggcatcacgcggggactgcagcagaccagcgagcgtgtggccggtaccaacttgtatcagtcgattgcggtgccgttggaattgcaggcgaacagcgggctgaccatttatctcgtggtgctgcatgccagcatggtgctgttgctgctggtgatcggcgtgctgtggctgattgtgctcgtacgtaagatttgggcgcatgcgcatcgacgccgatatgtgttggggctgagacctgtgttcaaaaatgcgttgattacgcttgccgttgccaccatggccacttttgtgctgtttggtgcaggattgggcgaagtggttatgggcgtggtcaagctagcgtggggtggcgctcccgccgaggatccgggcatgatgtattggagttggccggttattcaaatggtgtgtgttgttgtggtgtgggcgtggtcccgcgtgttcgtgcgtcttatcgaggaggcgacgaatcgtggtcttgcacaatggccaccgcgtaagggggctataggcgcgattgtgagtggccgccagccggtgctcgcgtcgacgaggttcggccgtgtgatgttttggatcacggcggtcaccatgctgtatgtgctgttggtgttcgcgttctggggattgtttatttactgatatcgcgggagagtgcggctggcgcgagaacgtgcggaaagtatagatagttcagttaagaaaacgagtcgaggcgaaggaggtgtgtgaatgccgttgtatcaggacgagggcgtggtcttgcgtaccgtcaaacttggcgaagctgatcgtatcgtcactttgctgacacgtgaccatggcaaaatccgcgccgtcgccaaaggtgtgcgtcgaaccaaatcgcgtttcggaggtcgtttggagcctttcatgcgcgtctcgttgcttattgcggaagggcgttcgcttgatgtgatttcccaagccgagtcggtgtcggcgtatgcgagaggcatctgcaccgatttcaaggcgtataccgcagcgaatgtgatttgcgaaaccgctgacaagctggtggtgacggagcaggagcgttccgtggcacagtatcggctggtgctgggagcgttgaatgccctttccaagcatgcgcatgaggctgctgcgattggcgattcctacgtgatgcgtgctcttgcgatcgctggctggacgccgcgtttgcgtgcctgcgtggtgtgcggggagccgatttctgctgatcgtccatggttcttttcgatttctgcgggtggcctgatgtgtttgaccgatcatattcgtgaatcgtttgatgtttcgtggaatgcgatctgccagttgcaggcgcttgtagacggcgattggggagagctggacggcacggcgttgcttccggaaacccgacaaatggtggaaaaatggggtgaatactatttggaacgtccgattcgttccatgcgcttgctagattagcgggtatggcttttgagaacgtggattacaagtcccttgacattccggcggcaccattttctgacccgtcgattattcctgattttccgaagaacaaggttccgcgccatatcggcgtgatcatggacggtaatggtcgttgggcgcagcagcgtgggctgattcgcaccgacgggcatcaggctgccgaaccggtggtgttcgacaccatcgcaggtgccatcgaagccggtgtgcgttacctgtcgctgtatacgttctccacggagaactggaagcgttccccgcaggaagtgcgcttcctgatgggcttctcgcgtgacatcatccaccgtcgtgtggagcagatgaacgcgtggggcgtgcgcgtgcgctggtccggccgacgtccgaaactatggaaatccgttatcgacgaattggaaaaagcacaggaacgtaccaaaaacaacacgaccatcgacgtggtgttctgcctgaattacggcggacgtgccgaaatcgcggatgcttgcgcggcaatcgcaaaggaagtgcgtgacggcaagatctccggcgatcgcgtaacggaaaaaatgatttccgaacacctgtacaatcctgatattcctgattgcgatttggtgattcgtacttccggcgaacagcgcacgtcgaacttcctgccgtgggaagcggcatatgccgaacttgatttcgtgccggaactgttccccgattgcggtcgagacgtgctatggcgttcgatcgaccactacattcaccgcgaccgtcgtttcggcggcgtcaaaaagtagtttttgctgagttgattaggttaactgcggggagaacataatgttctccccgttttgtttgctacaacgtgctgattcgggtggtgaaggtggggacgaaacgggaggagtcgacttggaaggctacgtggatgcggggtgcgttggagttgatcagtccggcgggatcgccgatggttcggcctcgggtgccgtggaaatcgccggtttcgagttcgactttcattggtaggtcgatacaggtcaccagcgacggatccacggcaacggcggcggccagcggatcatgcaatggcatgccctgtgaaaacagtcgcgcgtcggccttgagatttgcggcaatggaaaaatcagccatgtcggcgaggaatacgcgcacatcggaagcagatgggcttgcagccacactcgaggttcgagctgaagctgcatttgaactaccagctgaaccatcaagtgaatcagcgacttgggatgcggtcgagctggtaagtgtgtcagcattcgccgcttcgcgccaagcacgggtcgcatcggaacccatcaggcattgatgcgttacgtccaagccgaccatggtgatgtcggcatcggaatggaacacgcgatctgcggcttccggatcctgaatgatgttcgtttccgcagtcagatcccaacagttgccttcctgcgtcaacgtgccgcccatcatcaccagtttgagtttgccggcaatatccggtgcggccgtgatcgcagcatcaatatcggtcagcggaccggtcgcaaccacagtgacgtcgaaaccataagcgcgaacctgatcaataatgaactgcacgccttcggaaaccgagtcggcggaagaatcgtcagcatgaataaaagaagccgaatccgtagtaagcgacaattcaaacgaatcaaccgcaggattcgcatgaacatcatccaacgcatatccgccaacggaaatcagactacgataatcacgagaaaaaacagtatcagaaccggaattatccgaaaaaatatctgaaaaagcagtatccgaagacgaactatcgcaagccgggccgaatcctcccaatccgtccgtgccgtgaaactgcgcacaacctgcatccggaatgaaacaccgagcccatgaaggatgcgacgatccacgtatcaccggaatgtgccgaagccccaaccgttccagcacatacgaagtattgcgaaccgcagtgtcgacggaaacattgccgtacgtgccgatcacgccaagcacgtcaacagtgtcgaacgtcgcaaggtatgccaacgccagtgcatcgtcgataccggtgtccacatcaagaatcagtcgtgtcatatttttatttaatcaaactcgtgcaatgaagccaaatgcaacgcataatggtgcggcatcccacaaaccatgttcaacccgaactgagcaagcagtgttgggcatgaaataaaaatgcaggatgccgtattccaatatttcgattattcgcacataaacgagttacaaacctactcgttcaaacccgattatttcaggaactcgtcggtggcgagatccttggcctgcggagcgtcgtgcaccaccttgtcatgcgaatcggtgtaggcgtcttcctgagcgaggaagtcgaaatactgctgggcgccttcaacgtcgttcgtaccgaacgtgaacgaaccatccttgatcttggcgggatcgccccaatactggccgtccacaatggttttcatgcttttcttgacgaaatcaagcttgagattcgcgtcgggagcttccttcacaaggatcttcgccgcatcgtcaggattcgaatatgcgtactcgtagcccttcttggtggcttgtacgaacttcttcaccagttcgggattgttggaaatcgtcttgtcgctggtgatcacgccaatagtgtcggcattgccgggaacgccgtaatccggttcggtaaagcagttgagcttcggaccgtacatgtcggcctgcacaccctcccaagtggcatagaaaccaccgaaatcagccttgttgctggacagcgtttggaacgtggacgtgccgacggtcaccttgtcgaattcgcccttacctccgtccgactgaatcatgcgacggatcaccgcatcggattcgttggatccgaacgtggcgaaagtcttgccgtcgaaatccttcggggatttgatttcagtgttggaagcgagcgaacaccagatggcgcttggcttctgctgtacctgcagcacctgcttgatggttgcgcccttaacagcgtacgtgcttacgttggtgaggttcgacaatgcgaagtcggccacgccgttgttcacggcctgttcggcaccggcctgtgccacggccacgatatcaacgtcaagacctgcctctttgaaataacccttgtttttcgccacatatacgccgatatgattggtgtcgggcgcccaggacagcatgaaggtcactttggtcagatcgctgctgccagatgctgtgcttgttacggaatcgttgctttgtccgcatgcggtaacgctgaacaacatggcgattgcgctgaagagtgcgattattgtgcttgcgatgtgagtacgtgcggtggcgtcatgcctgctgaagatgctcataaagcgatttcccttgaatctgtattctctatcgttttctagggatatgctgcgagcggagttcgggcagaaaacgatacgaagggcctcaggcccccgctcgtccaatgcccccgacattccttacggtgcctagtgaaaggcgtggaatattgccggtttgccacacattggcttaacagcggattttattatacgtaggcagcgtgaccgacatgcaatgcggagtggcgaatgctgcgaatgctgcgtttgcagaaggccgatgatgtttggcgtgtttgacttactggtctgcatcgggatcggcgtcggcatcagctgggccgagcaggacgcgttcgctgaggttcaccaggcacatcagaacgccggtgatggcgatgatgaccagcgtggccgagaagatcagcggtgtgcggaacgagttgtatgctgcctgtagccaaatgccaagacccttgcgtgcacccaaatattctgcggtggcggcagtggcgaaaatgtatgcggcggaaacgcggatgccgccataaatctgacgagcggccacacgcagcttcacatgccacagtgtccacgatttcgtggcgccacaagtcagcgcaacatccgaataaaactgggggactgcttcaagaccgcgaatcgtctgcactgcaatcgggaataagccgaataccgttacaatcacgatttttccggaaatttcaaaaccgaaccagatcaaaaataggggagcgatggaaatcaacggcatggtctgcgcagctgaaagcaacgggagcaatgcggcgttcgcaatgcatgagcagtacagcagtatgccgatgagaatgccgaacagtacggcgaacaggaatccgacggtaccttcaagcaaagtgacttgcgtggcaggccataacgtcgaccatgtttcgacggtggcctgtgcgatttcgcttggcgcggcgatcatggtgctgggcacattgccgatgcggacccacgcctcccataccgccagcaacagcactactgcaataaccgtgggaatacggcgtttgcaaacgtgagcaaaggcggacaaagcttcgagaagttttgcgacaatgccgtcttttgaattcgtgttcgcagccatgcctgaacccatgtgcgaactcgtgtttgagggtatggatcctgttgccgaatccctgcgttgaacgtgcgaaaccgccatcgttcaccttgctttctgcgccatagtgggcgcgcacgtgaccggtggcgagaaatcagtaaggtgaggagcctgcccgcgttccggtcagaaaagttcattaccggggtgttagtataaagcactccctaaaccacgttccaaaccaaaacgaaaggcgggtttcgtatctcattcgacacgaaacccgccttactctttaccccttgctactgccctggatcagcttcactccagtccgatggacttcatggtgtggagcttcaaggacttgacctcaagcgtgccggattcggcaacaagtttgatggctcgtgggccttcggaagcgtagctgaaggagctcatggcctgacggccgtcgttcacatacacttccacgcagccgcgatccacgaacacgcgcagcttgagctcgccggaagccagttcctcggcggaaagcggcgcggtacggtagccacgatcaccctgggctgcggcctgacggtcgatcaccacacgaccgatctgatcgtcgaacgccacatacgtgtaagcgccatcttcggtcgcatgaatcttcagaccagcacgttccgcagtggaggcgttgagatcgatggtcatttcgatttccacggcttcggcatcgtcagcaatggtctgctcgccattgacgtccagcgagatcgcaccgaaatcggtggtgttttcgcgcaagccctccatttcgacaaccggagcggtgtgcagatcgccgtcggcgcccagggtgatctcacgcggaagggtcaggttgccgcaccagccgtcatcctgcatcggaatcggctcaacgaacgggctcatccagccgtatacgatctggcgctcgccatcgttgaaggactgcggagcgtaatagttgtggccgcaatcccacagacggaactcggtttccggctggaacgcctcgcccggggtccacgtgccgatcatgtagccggcgttggaaacgttgcggttcatgaaaccggaggcctttgcgcccatggcggagaagccgatgacccacttctcattgccctcggcgtccttgatcgggaagaagtccgggcattcaagcatgaagacgttcggatccgggtgttcgaacagcacacgctcgtaggtccaacgaaccatgtcatcggaggagaacagccacatctggccgcgcttttctgcggaggagacaccgaaggtcatgtaccacttgtctccggtcttccacaccttcgggtcacggtagtggtggtcgaccttatcgagcgggcaatcgatgatcatgccgcgcttggtggcgctggtcagctcgtcgttgtctggttcggcgatcatctgcacctgccagtcgccgccggtgttgtcgatgccgttggcccagcggtggccggtgtagtagaacttgagctcgccgtcatcgccgatcactgcggaaccggagaacacgccgtccttttcctcttcgagagtcggggcgaacatgatcggctcacgcttccagttgagcatgtcgttggaggagacgtgaccccagtgcatcggaccccactgggtgccgtacgggtgcagctggtagaacacgtgccaacggcccttgtagaagcacaggccgttcggatcgttgatccagccgccgttggatgcgatgtggaacttcggataccaacggttgttgcgttcggcggccatggctgcaacgcctgcttccgcctgtgccagggcttcgctgtggttcttgatttcgtgaaggacgggtgcgtccggggtgaagccagtcatcgttgaatagcctttcttgtgattgttgaattgctgcttattgagttttgagtaaaagttgtaagaatgctgcccgaagcggaaaaaggggaaacgcttcgagcagcacgattcagttatgttcttggctggacttgcgattgcgttcaggcattcgcttctgcagcggcctgggccttgagctgcttgtcggtgtagaacggatcaccgccgacttcctggtcgtccttcttgatcacgaagaagccgtagatcagggctgccagcacgatgccggagatggtgaagaaggtcgggcgatcgcccatggcgtcatgcagggcgcccatcggggtggagaagatcacctggccgatctgggaagcgatctggaagcccaccatgtacagggttgccgacagcttggtgtcgaagtgcagagtgaagtagcggaatgccggcaggcagaacagcggaacctcgatggagtggaacagcttgacgatggagacgctgaccggatcgtggaacacgccgcacaggccgatgcgcaggaacatcacggttgcaccgagcagcagggagttgcgcacgccgatcttcttcatgatgatcggaacaacacccatcatggcggactcgaggaacacctggaaggagttcagggtgccgtaggtggcgttgccgatttcagtggtggagaagagggaagcgtagtagttcgggaacatctgctgatcgaacacggtatagaaggtgttggtgaacagcatgaaaacgatgagcacccacagggtcggcatcttcagaacggaaatcatttccttgaaggacgggttggtcggagccgcgttcggatcagcttccttcttgagctcttccttctgctcggccggaacccagaaagcgtagatgcacagcatgccgaggccgcagatggagccgacccagaagttcagcagcgggttgatattgaacaggaagcctgcacacagcgccacgatggcgtagccgaatgagccccaagctcgggactggccgtattcgaagccgaacttgcgggagtagcgttcggtgagtgcctcgaacagggagcagccggccatgaaacctgcggacagcacgatggagccgatgagcacgccgatgaaacgggtggtgccgccggctgtcagcatcggggcatacacgaactgcacgaacgggccgacgagcgctgcgatggcggagacgaagatcacgagcttacgcttgatgcccagttggtcctggatggcgccgtaggcgaacatgatgaccagggttgccagggagttgatggagtagatctggccctgctcggcggaggtcatgcccagaccgtgggccgggtcggtaagccagcgggagaagaaggaccaccagatgccccacgagcagaagaacatgaagatgccgaaggagctctgcaggtaggaaggattcttccatgcagatcgagttgtacttgccatgttgttgtttctctgtttctctttgtttgtgccgctgccgcgcggcacctcggttgtgtgccgatgttgtgttatgccgtcattcacccagctgccgtgccaagtggatgaacatggttaaataatagtgcgtaaaacgattgacgtcaatcgattgacgtaagtaattccaacgcttttcggaagtgttggaattaagccgaaatgggggatgaaaaaagaaggcctctcggcgtgtcgtaacggacacgtcaacaggcctttcatgtggtcttagatcgcgaaacttagctgcgaaccgatcccttttctatcagcgcgcaatggatcttcgcaggaatcggcgaatccaacggcggcatgggagcggtggtattcggccaagacgaactgtcgacgggcttgcgttcgatcatcgaaataagcttgcatgcggcccaataacccatctcatagtggggcagttccaccgtggtcagctgcggttccagcgtttcggcgaacacgcggtggttgtcgacgccgacgatggaaacgtccttgccgacggtcagtccgcggcgtgccgcacattcgtacacataccatgcacgcgcatcattgaagcaaaagaaaccgtcgggattgcgttcgtcaaacagtttgtcgacggcacgcaacgcaggaccattattgagcacattgcataccagcgaaggatcataggcgaaaccggaatcctgcaatgccgcctgatacccggcaaaacggccatcctgcgcaatcatgttttccgagcatccgatgtaggcgatacgcttgcaatcggcctgaatcagccgtttcgtggcatcataggcgatttggaattcgtccggctcgatgctgggaatctggttgtcggcatcggtggcatccaccatcaccaccggataatcgccgagcgaggctggcacgctcgcaatgcgattcgacatcttcgaatagaagaaaccgtccacgccataccgtttcagcgtggcgatttcgttctcttcgctcgccctgccatcggtgctgaccgtgatgatcatgtacccgtaggtgcttgccgcgtcttgcgcgcccagaatgatgccgcctgcgtacggcgtggtggcaacttcctcgctgatgaagccgagaattcgcgtgcggcaagtgcgcaggctgcgcgccagaggattgaccgtgtagccgagttcgtctgccttctcgcgtacgagcgcggccaaaggggctttcacacgtccttcatccctgccgttaagcaccagggaaacagtggaaatggacacccctgtcgcttcggcaatttccttcatcgtagtcatattcgctacactatacccaaatcaataagaaaagcgcgccattccttataaatagcgcgcttttcgatttttctgacgatctaacagtttattgcctgatttattccgacaggatttcgtccacaagtgcctgcttggcgtggatctgaccttcgaaacccgggcgaatgtcgagacggatcaccacgtcggtgcgatagccctggccagccagcttcatggtggcgtcgcgaatcaccttgagcacgtcgtcgatgtcgccttcgatgttggtgaacatggcgttggtttcactcggcaatccggattgacggatcacgtcgaccgcctgcgccacgtacgtggacttttcagggcttgcgccggcgggggagatggcgactgcggcaagcgtgttgatatacggtttgccggtttccgggttgatcggcacttcctgcttttccgcattgcgatcaagggtcatgttcgttcctttcgttgcgttcctatcggcctgatacgacttggattggctggtgcggatttggctgtcagcgccatttccaagcgtgatccatcggtccggatccgtgaccgaggtcaagctgcgcctccaaggcgcccgtcagatacagttttgcactatcgacggcttccggcaatgtctcgccaagcgccagatgcgatgcgatcgccgaagacagcgtgcatccggtgccatgcgtgttcggattattgatacgacgcgcgcggaaccaagtgactttgccgctcggttcaacgagcacatcgctggcatcctgcgtgccatgaccgcctttgacgagcaccgcgcagccgaaatggccggcgagcatatggcctgccgtcaccatgtcgttctcactggagatgctttcgccattctcgtagtcgatcgcgtcggcaccctgttcgacggccagctcgcacagcgcctgggtctccggcatattcggcgtgatgacggtggccagcgggaacagcttggaagtcagtgccgcaatcgcgtcgccttcgataagcttcgcaccggacgttgccaccatcaccggatcaagcacaatattcgtggcatcatgcgcaatcagacggtcggcgatcacgttgatgagctccacgctcgacaccatgccgatcttcaccgcgaccggcggaatatcttcaaatactgcgtcgatttgcgcggcgagcatttccggaggagtgttcgtgaccatggtcacgcctgtggtgttctgcgcggtcagcgccgcgatggcggtcataccgaacacgccattggcaagcatggttttcaaatccgcctgaatgccggcaccaccggaggaatccgatcccgcgatgctcaataccggtgccaaagtgctggtcatgaatgactccttacttgcttttgcttgcttatgatgcgaagttctgaaatattcgtgatccgtgattgctatttgcgcagtacgtgcccatgctttgcatcaccgcgcactgccttccatcgcgaaaccatattgcgggtcgcctcttccggatcgcttgcgccggcaatggccgacaccacaaaccagccggccgccttcgaatgtgcgagcatctccatatcgtcggcggtcactccaccgccgaccacaaccggaaaatcactcgcatcgcagatcgcattgatctgcgcctcgtcgagcgtatgcccggaaccatcgttgccaccaacggaagcttccggcttggtggtggacacgtgcaacgggccggccccgatgtagtcgatgcagccggcaggcagctcgttgatcagcttcaccaggctttccgtttcggcagacaagcccacaatggcatcttccccaagcaacgcgcgggcttcctgcggttccaagtcggtttgcccaatatgcacgccgtcaactttgatgcccttgtgacgtgcctgccaaactacatccacgcgatcgtcgatcacaaacgccacggaatcggatttgccgttgttctcgataacctgcgcgatatcgcgtgccatgctggtgatgtctttcgcgtcggtgttcttggctcgcagctggatgaacgttgcacccccgcgcaacgcatcctcaatcacaccggtaatagtacggctcttgcaatcctgcgggccgaccacaaagtaggcgctcatatcgaatgtatcgcgcatcgatgcatatgaataattgttcatataatcaacccttctcggtaagtgattcagaaaacctacaatgtgaaccggcaatcgtccatattttccatatacgcaattgccgaaccccgcatgatatgccgaataccatgcagggttcggcaaagcctagtcgatgatgatttcggaagcggcgacttcctcggcggtgacgttccaaagcgcgtcaagcagcgccacttggaaagatccgggaccggacgatttcgcttcggcgatttcggaagccctgttatacagcaatgatgccgaaatcgcggcgacaagcggttcggccacggccagatacgttgcggtaacgccgccgagcgaacagccggcgccggtgatcttcgtcatcatcgcgctgccgccgggcaaacggaacacgcgctcgccgtcagtcaccagatcgactgctccggaaacggccaccgcgccggctccaacaggggagtatttcgcaagatgacgagccactcgtttggccgcgtcaacggcggaatcgacttcgtcgacggcttccacgcctgccgggcgagtgccgggaacggtggaatcatgctgtgccaaaccccacatcgcatcgagcgcgatgatttcgctcgcattgccgcgcacaatggtcggcgggtatgtgcggaacgattcgagaatggcggtacgggttttgccgatgcccgcggcgaccggatcaagtacccacgtcttgccgttcttgtgcagtttgtaggcgatttccggtagcgcgtccttgaagaacggcaggagtgtgcccacattgatgtagttcgatccggcgatttccgcggtgtcgatcacgtcgtcaggcaggaagctcatggctgcggtgccgccggcggccagctgcgcgttgaccacaagattcatcgttacgaaattggtgaacgactgtgccaaaggtgtggtttcgcgtacgtcgtttactgcctgcgcaatctgttcacgcaatgcagctgcatatgagtcatcgcccattgtctgctccctacgttggtcctaaccaacaggttcaaagggtcaggcatttgcctatctcagcttccgctttcgccggaagcccccctgcatgtacataacatatctaacctatacaaaggtgctgacagtggcacgttttgcataaacgaacaatcgacacgttccagttggatgccggtccacttgttatctgcgcgttgcgccgtcgggccagtcgattccaggatcgggcgaatgcaatacgttctcgtaaatgtcgttgcgcacgtaaatttcgcaggcgccttccgaccatgtgcttttccaaggtgtcttggtttcggcgattttgattttcgtgtaatggtttctgtcgtaaccaaggtcggagaagaaaaatggctgatacagagtgtcgtagaattcgggttcgccccacgatttccatgtttcgatgtctttctttcccgcataggggtcaacgcaccattcccacgacgaatagcttcgtcccttgtatgcattggcaagaagcgtatggtcgaagtaaggggctgaatcgataagggtgctgccgtaccaagaagtgtagtcgatgcagtcggtgccgccgcaatatccgcctttgtcgatgattttgttgatttctggattggaagcggtgtcgttcttgctgacgcgtgtccagcctgccatccaacggtattgctccaaatggttggttttgataaaagacgctaccgcccgggaagacgaatagtcgtaccgaatatcgcaaatactggcgcttgccgtccaatacacgctgacaagcatgaagataagaccgaggattttgaagaaacggagataccgttccgttttcttcggtccaagaagagtcataacacggttgttgagattacggatccactgaggccaatcgttggaattgattttttcgatatcgcaatcgatggcgagaatggcgatgaagaatcccaagatgattcccgcatgatgcatggaaagatgcgcggtgaacgcaacgcttatacccaagtatgtggtgagcagcaatgatgcggttttccggcgtaggcaaatctgaataagaaaacaccacatcaggcatgacattacgctcggcataaacagctcgcttggcgtgagagcgatgaactgcatattgccatccgacagggttgaagtgaacaacgtctcggaaggcattaccagccaggtgttgaatacggaaacccatgcgggtgatgttgttgcagtgccatgtatgtcaaagtcaccgtggtatgtgccgggtgcggggagtacgttgaggagcagtatgatggcgaataccagtagcagaacaagtcccgcgaaacgctgcttgttttttataagcgagcgttcgccgcagagaaattgaatcgtccaattcaaggcaagcatgccggcgattgccaatccgtaagagctcgtggcgcatagcagcatcatgctgagtatgactggccatggcttggtgttgcggttgttccaattgatggctatgagcagcattgcggcgatcataagcgcatatggtctggaagttacgccatactggtagcaaagaaaataggaaaatggcagtattacctttagtaattctggtagtttcgttttgaattccaaaagccagatcatcagcgcggcgcacataagattgagggatttcaatcctatttcgtaaggcatgccaagtttggcgggaatggcaagcagcatccaccaaagaggtgggtgtccttcgtaatgggtgcgtacggtaagcagttccttccatgagcaatcacgtgcgatcagccaggcttgcgcctcatcaaaccatggttcgtgaaaacacgacacggtgacggtcactgtcacgtaggcgatgaagacaatgcagtgcagccgttgttcggcgaaccaggtgaagagtctttttcgaaggttcgtcgcgcggttcgccgaaatgtcgggctggatgatggttggtgtttctgctgtgttgctcatgataggtgtaaagatggtgtatgggtacggcgaggttagaaggaggagcgggcgccgcagagtttttcgaattcctcgaggacctgcaccttggcaagagcgtcttcgaaggtgatgacgcccttgttgacgagtctcgccagatcttggtcaagcgtatgcatgccttccttttcgccggattgcagcacggtacgaatctgatgcgccttgcctccgcgaatcaacgcggccacggccggagtgttgatcatcacttcggtggcaggagcgcggccatgcccgctggcacgtgaaatcagggtttgcacgaccaccgcgcgcagagtggaggccacctgcacgcgaatctgctgctgctgattttccgggtacacgtcgatcagacggtccacggtcgaaccggcgtcctgcgtgtgcagggtggcgaacaccaagtggccggtttccacggcggtcaacgcggtggaaatggtttcgaggtctcgaagctcgcccacttcgataatgtcgggatcttcacgaagcgcgcgtttaagcgcttccgcgaaacttttggtgtcggtgcccacttcacgctggctcatcacgcaacgcttgtgttgatgcacgaattcgatcgggtcttcaatggtgatgatatggtcggcgcgttcggcattcgctctgtcgacaatcgcggcgagcgtggtggatttgccggagccggtcggaccgcatacgagcacgagtccacgcggcagtaacgccagatcggcgatatgcgggtcgagaccaagctcctgcgcggttttgatttccgtgggaatggttcgtaatgccgcgcacacgcccaaacggtcgcggtatacgttgacgcggaatcgcagcagatcgccgatggagaatgaaatatcaagttccaaatcgtctttgaaccgttccatctccagctcgttggtcatcactttgatggcttcatacgtgcggtccttgttccacacgctcagccctttggcggggcgcagcttgccatccacgcgcagcattggcggatcgttgaccaccagatgaagatcggacgcgttcaattccaccagctggcatatggcagccacgaattccggatccgcatcgggatgttcggcatgcaatgtttctttgacctggtgcgctttgattctgcgttgtccgggaacagcgtcctcgtcggaatcattggtttcgggcactatgaaatccacgattagcctgttgttcatattgggttgcggtctggcagcgggcgtaggctgcgcaatatggttgatggcggaaggctgcatggtctgcgcgttctcctcgtacgccgcatagtcgtccggctgttgcgcgaacggcgtgccgcctggaatgaatgatggcggatcgccgtcgatttgctggatcggtccatgatactcgaatgcaggggtgacttccgtcacgtcatcgtcgaattgcagattctgctgatccacggcttcgttttccggggtttccggaaaagcggtgtcgtaggagagttcctgttgttctgcaatgagcggtgtttccgcaggccgtgtcggagcgggctgcggttccgctacagattgtgatgcaacggcttgcggggcagctgactgttgcatagactgccgctgtgcgctctgttgaggctcggccgccggctgttgctcgaccgcggccttagacatggggtcgggaacggtaccggaaccatgccgcaacgcgggcatggcgtcaagcgacgcgaaaatactgcgcaaactgtcatcgtcagcctgaatcgcattgtcgggcgaccaatggcgtcccctacgcggatcctcgttgaatgaaggagcggtactgggaatggtcacacctttcaaaccagacaaatcggtgttcgcatcccaagtcggctgcgcatcgggatccgtcgcggtgttcatttcggttttcagctcgggttgctgttcaatatcggtcatcattgtcctttacatatgttgaaaacgcggtcacacgattacacaactacacggtcacgcgaagcacttcatccacggaagtaatgccttgcagaaccttctgccagccatcctcacgaagcgacgtcatgcctttcgacttggccgcctgctcgatttccagcgacgtggcgccacgcgcgatcaaatcctccatctgcgtgtccacgcccattacctgctgaatggccacacgcccgtgatatccggtgttggaacattcacggcaacccatcgcacggtacacggtcggcaacggagagccgggcgtatatggcacacccatcatcttcaactccacgggagtggccgtatcggctttccggcatttcttgcacaggcgcctcgccagacgctgcgccatcaccgcagccagcgacgagctcaccaaaaacggttccacgcccatttccgtcaaacgcgtcaccgcactcggagcatcattggtgtgcaacgtggacagcaccaaatggcccgtcagcgaagcctcgatcgcaatggtcgccgtctcctcgtctcgaatctcaccgatcagcaccacatcaggatcggcacgaagaatcgaacgcaacgcggcggcaaaggtcatacccgccttattgttcacctgcacctgattgatgccctccatgcggaattccacagggtcttcaaccgtgatgatgttgatttccgggcgggccacatcgcccaacgtcgcatacaacgtggtcgacttacccgaaccggtcggaccagtcaccaacaccatgccgtacgggcggttgtacgctttggaaaacacatcgaaattgcgttcgctgaaatttagatcctccactttgagattgcccgaaggcgtgctcaaaatacgcatgacgattttctcgccccacaccgtaggcaatgccgccacgcgaagatcaaccttctgaccgttgtgacgtacggtaatacggccatcctgcggcttgcggcgctcgccgatatccatttcggccatgaccttaatgcggctgatcacaccttgggtcatggcgcgtggcgctttttggaagatatgcaacacgccgtcgatgcggtagcgtacgagcagaccgtcttcctgcggttcgatatggatatcggagcagtggtcgtcgatggcctggttgatgagcagacttacgaagcgtgccacgggggaggcgtcttcgctgtcgtcttgttcaaggtcgacttcttttttcgcggtcgcggcgatctcgtgcgatagttcggtcaactccgcattggcgcgcaggaaccggttgatgcagtcgcgtacctgcgatggcatggcgaccatggcgatgacgggcatgccggttgttgcggaaacatcgtctaccgcggcgaagtttttcggattcgccatggctacggcgatgcgcccgttgacgatggaaagcggcagaagctggttgcgtcggcacagatcgtcgggaaccatgctgatgacttctttgtcgatctggtattcattgaggtccacgaacggcaggctcatgccttgcgccaacgccatggcatattggcgttcggtctgttcgtccatgccttcggtggacgttggcatggcgggaaaatctccggtggcgtcgcttgtcattgccgcatggcgtggtgtgctcggcgtgaacacctgatggatctcgccggttgtcggcgcgatcggatccatactttgcgggaaagcgttcggcgtgtcgctgtttttgtttcgcctgaggaaggggaaacggcctcccgaaccggcgtcgctcataatgacctcctgcaccgcatgcgcgcttatgcgcctgtcatacggcataacatgaaaccccaagcaaacggcagcatttgtggggaggctgatgttcagttgttcgaagtcatgtgagctacaacgattgcagtattgtgtactgctaaatcagcattgtagccgcaaaaacaggtaaaagctaatcggggcaaagttttttgagaaatatgttgctgtgaaaacgttggcagaatatcgtgatacagtaactcatgtttatggcaccgcgtttggttgcgtgccgaattcctgccgcttccaatgatggggtggcatcttgtgaaggagctgctcatggagtacagcttgcgcacagcgggagacgcccccgattcaggggttgcggcgagtcgcgtcaatcgattgccaaaacgtggcgagtccggcttcacgttggtggaagtgctggtggcgatcgtggtgttgagcattacgggacttgccgccgcacagttcgccattacggccattcgcacgtcatatgcgcagcagcagcggtccaccgccgtgtcgctgggcgacgacggcatggaaagaatgcgtgcgcagatcgccaatgtagacgccaaccaatatctcgatgaactcatcaaaggcatgggggaaacgtccgtcaccgccgcgcaaaagaatctttccgacgttggcgccatcgcgtcgcaattggcggatctgagctataccagttcgcctgatccagacaagagcaagtatattcagccggttcgtgccactgcgggcaaggacgccaagcataccgaatacacggtgaacacggtggtggagcgctgtttccgtgccagcggcgagatctcgtgcaagaccgcatctcagctgggcatttcccgtagttccgcaacgagctatacggccaatacctcaacaagcgctacggccgacattctggatccgggcaaaacggtatcgggcgcgttcacgttcggtgcgcacacgtatatgcccatgatccgcgtggtggtgggtgtcacctgggacgacaacatgcatcagggcaaaacctgcctgtacaccacgtcggaactgctggatattggtgtcgacaacaagctcatcatctagtgaggggttgcaatgagcggaacaacaagcggaaaactgcgtattcgcgccgtcgcgcaacgtatggcgcgcggtgaaagcggcgtcaccttggtggagatgatggtgtcgctgttcatcttcgccatcgtctccaccatgttcaccacggcgatcgtgcaatacctgcattccaccagcgcggatgcgatacgaagcaggtcttccacggaaatagccacgtcggtgcaaagcctcgaccggtatgtgcgctacgcggagggtgttgagtatgacgccacgaaccatacgatcaccatggtcactccgggggattctggtgcgaagcagtgcgtggtgatcacgtaccaggacgccacgtggaagaacggtacggtaagcgattacggtagcgtgaaggtaaaaacgaagccgtatgatgcgtccgtcacgtcatggagcacgcgcgcggtgttggggtcggtaatgaacaacgagtcgggaggcacgtctgatgattcgatgttcgcctcgcgattattcacggtggatggcaccaatcgggtggtgcgttattcgccggtgacggggtcgtatgtgagcggcaagccggtcacgtcgaatacgtccacgtcgttcaccgcacgcaatgtgaaatcgggtggaactgcaatcgatttcactccgtgtgtctgagtgttccgataggtcttgcggcagacggctggttccttacggagccagccgtttttgtcgccccgtcagcaccctgcgacacgcccgaaaagggtggttattccagttttttcaaaaaaacgtgactgcaaagatttgctgagcgattgtactgaaaaacaagctatttgtggtgttgtattttttgttgcacgattttggttttgtgttgtaccttttgtgtccgcttgaaaaagtgtgatttgcttgatggttgtgaagggggttgtggggtaaactaaagcgcttttgtgcggatgaaggatgaggggaaaatgaatcgaaaatgaaacgctcgtaaaacgattgacgccggaataatggttctgcaaacgatgtcaatgcggataaagttaggactgttggttatgtgagccagcagcccccataaggggacgatcgatagaagaacgccgcgaagctccatcgtgggatgcgagcggcgacctttcccgaaggaaagaaggattcaattatgaagagcgtgcgcaacgcactcaaccgccgcgccaagggcgaaaagggcttcaccctcgtcgagctgctcgtggtggtcatcatcatcggcatcctcgccgccatctccgtgccgatctacctgaaccagcgcaagtcggcctggaactcccagaccgagtccgacgtcaagaacgccagccttgtggttgaaactgcgtccactgccaacaatggcaagcttccgtctgagattaatggtgcaacggccacgtgcagtaagagccagaatacgggctgcacgcttggaggcaatacgattaccgtaactgagggtgttaccctgaagattaccggtaaagcagataactcctacactatcgagggcgagaacgagaactctggtacagcgattttcctgtatgactcggccaacggtgtcgtctctaagactggtactaaataataaaaggcatagcgaataattcgcgtgggactaaaggtatcggagcgtatgaggtatcgctccgataccttgttccgtatccatattcgttccattgttcgtcaatcattccatgggggagtaatggccagggaacaggcgcaagtggcatttcaaaacggcaccaagaagtggcgttacaagggtgtttccgctgacggccgcaccaagcagaagggcgttatcgaagcgcagacgcgagatcaggccatcgatcgcgtgaataaactcggtctgattccaacggaacttgttgacgtgaacgcaggcaccggtctcaataccaatattgaaatcaaagcattcgaaaaatatccaagcaaaaaagacttcgcggttatgtcacgtcagcttgccaccatggtggcggcaggcgtctccctgattcgcgcactgaatatcgttactgaacaaatcggaaatgtgaaactgcgcaatgcggtacgtgactgcatgcagcaggttgaggcgggatcatcgttttccgaagcaatggacaataatcccgaccatctgtttccgcccattatgatcaacatggtgcgggccggcgaaaccggcggcttccttgacaaatccctgattaccgtggccgacagctttgaagcggacgtgcgtttgcaaggtcagatcaaaggcgcactggcttacccggtggtggtgctcggcattgctgtgctgctggtgggcgtgatgctgctgaccatcgtgcccatgttcgacagcatgtatgcgtcgatgggcgcggaactgccatgggtcacgcagatcatggttgatatgggcaagaccgcaccggttggcattcccgtgatcattgtgtgcgcggtggcgttcgtcatgttttggaagcgcaatcgcaacaaagacatcattcgtacctggtgggatccgttcacgttgaaggcgcccgtgttcggcaaactgaccaccaatgtggcattggcgcgattctgcaacaatttcacatccatgctcgcttcgggcgtgcccattctgcaggcgcttgacattgtcggatccacatccggcaattatgtaatcgacgaagcgtccaaacgagtgtctcgactcgtggaacgcggctataggctggcggacagtatgggtaccgaaaaagtgttcccgaacatgatggtgcagatggtggcgatcggtgaggattccggcgccatcgaccagatgctcgccagcgcgggcaaagcgtatgacgaagaagcgcaatccatcgccaaacagctcacttcgctgctggaaccgttgatgattctggtgctcggtagcgtggtcggcttcatggtggtggcattgtacatgccgatgttctccatgttcgacgccatcaacgggcaagcgtaagcgaaaacgggaaggttgaacatgaagaacggattgtgggccggactcaaccgcaggtatcgtgccagattacgccaacgcatgggggagcggggcgcggccatgatgctcgcggtactgttcgtaatggtggtgctcaccacgtcggcactggtaatgaccatactgctttcgcaagcattgccgtacaggaataataaggagaacgcgcaagtcgggtatgccgccgaatctggactcgaagtggcattgagtttcctgcgcgaagcggaagcaagcaaggactataagaaactgctaccgtcgaccgcatcaaacactggcaatgccagcttggatgagaccttcactacagcatcggacgggtcggtgctgctcaacaatgcggaagtcagcaacgacgtgtcggcaacgggcgtgagctcgttcactccagacgatatctcgtaccgagtgcaaatcggatattatgacgacgatccaagctcatcgccggccaaacgactcacatccgaaagcgagctgaagaacgcgaaatatgcgtgggtgcgttcctacgggtatatcaacaggtatccgaatgggcgaagcgcgggtacggaaaccagcgcgcgccgagccatgagcgccatctaccaattcgagacagcgagcggtgatgacagctacgtgatctccaccaagggtggacgtctcggtatgggcttctacgcggcagcgccaaacaacgagcgccgtaccaaccagccgacctggaaggaaatcgcctcatatgatgtcgatgagaacggtgatccgaccggcatggtgaactatgtcaacaagcctggctccaagaatgcggccgacgctatgagcaataccatcactatgaatccggcaaaccaaacttgcatgcttgccaccaccaagcctgtagacaaggtcgaaacgcttgacgccatgcttgacccgaacggcaagccggtggaaggatcggcgttggtgattcttatgcaagcgcataagaaagactccagcagcgacgacctgtattacacggaacagtgcaaagccaacggcgcctacaaagacctgaacacatgggtgtattggaaggatgattccattcgccctgcatccaatctgacattgtgcgttaccggagctgacattacgcatgttggcggaggcactgcaggagccgccacattgcagaaatgcggcgagtcgtacggccccaactaccaaagcgactattacaccgatcctgacaagaaagcgcagcaagacgaaaagaacgatccgtcaagcctgctcaacaaataccagaagtgggcgttctataacggtttcatcaatgcgggctactacaacgagctagatagcgtgcgcgatgaggcgaacaagtatgatgcgtctctaccggaatcgcaaggctatgccgttggcggtgtgcaaatgcagaagaagacgcgcttccaagtgctggaagtttccaacaaggcgaatgtgggcgccactattcaatatctgagcggcggtcactgggcgtccaacgtcgatgatgctgtcgatttgactccgcatttcctgatggtgtcgaagtgggattattcgctcaccgacgtgaaatcctggttcgacgtgaacggtgatttcgaagacgccaccgcatcgttcggacaggcgggagaagccggctatgccacgaagcagatcgtcaatgaaacgtccggattctgcatttcgtcatcgcaagacggattcgacgcatacacgtcaacctgccgagtgggtggcggtgatttcaacccatactgctaccacaacaccatcaatggcaatccggcgcaatcatcttccgatctgcatcagatcgactactgcggggtgtccgattccaccaagcgtaaaaccgatcaggccgaatatgttgaagacacgtcgagtgacggcagtggcgtgaacacgcagatttggacgatggtgaacgggtcgaagcgttgctatgggttcggcggttcgggcaaattccaacttatggaatgctcggctgcgccaacattcacccgatacaacgaaaaagcgtctgacgagcacagtaaaggtacgttccaactcaacggtcaatgcctgacggaagtgtatccgggagacaaaatcgacggcaatccctcatactccggacgtatcgacgggcatgccgacgtgattatggccaaatgcggatcgtcacgagactttttgaaccgagaaatcaaatcgcaggtgtggaatgcctcggttaacctcggaacaggcggctcaggcggcggcgtgatttatggcggtggtagttctaccacattggagccatcctccaccaaaggctacgtgacatccaaagaactgaacccgtccactatcgcatggtgagcgctgcgcgagatggatgtgaacatgagcattgtgaacgatacgtcaactgtggtgctgctactcgtggcatcgctggtaatcggctgcattttcggatcgtttctgaacgtggtgatttggcgcgtgcccaaccacatcagcttggtaaatccgaaacgcagtttctgcccgaactgcgaagccccgatcgcatggtatgacaatattcccatcatttcttggctggtgctcggcgcgaaatgccggcattgcaaagagccgatcgccgtacgctacccgattgtggaagcgttgggcggactgtcgttcctcgccgtcaccttgggggcgctattcggcgcgtattcgccatggatattgccggaactctacgtattcgcagcggtttcgatcgtgatcgcatacattgatctcgaccatcatctgatcctcaatgttgtgctattgccaacgctgattgcaacactggcactgctggctttggcatcactcggtacgaatgagtggaacaggctcggtcgcgctgtgatatgtgcgatagtgctcggcgcgttctacctattgctttccatcatatggaaaggtggcatgggcgatggcgatatcaaacttgcgttcatacttggcttgattacgggctggctcggatggtcgcaattcatcatcggggcgttcgcagccttctttattggaggattcttaagtcttgtgctgattatcggcaaaaaagtcgatatgcatggaggcataccgttcggaccgtccatgctgctcggcatatggcttggcatattcgtcggggctccgatcgccacactgtacttgcaagtgacgggactcgcctgaaccaatccccagccaacctgcaacacgttatatataaggagagagcatgagatcaataacggcgctgtcgatcgcgaacgacgccatccgtgcggcggtcatagcagacccgtattcggatctgcccaccatcaagcatttccaggcgatcccgttgccgaacggagccgtagtggatggcgaagtggtcgaccatgatgtggtggccggactgctgaacacactggtgaagcgattcaaattcccccgcgaggacacggctctcgtctactccagccgacgcatggtgtttcgcgaggcggactttccctacatgtcgctgaacgatctgaaatccaccttgcctttccaagccaaaggcatgattccgctgcctattgaggaatccgagctcgacttcgtgccattgaacgtcatcgacagcgaacaaggcaaacagttgcacggcatactcgtggcgacattgcgtaacggactggaaaaaaccgcgcgcacagccgaagacgcgggatttgtgatcacatcgatcgatgcgggcccgttcgcgcttgccagactgttcgccgacaccaaccagcagcagaccgaagcggtggtcaacatcagcggcaacggcaccgacgtgatcgtgctcgaaaacgggcagcccgcctacatgcgcgtcgtgccatccggcgcggatgacgtgactgacgccatcgccaacgcgctcagtatctcattcgaagacgccgaacgcatcaaaaaccagatcggcctgcaaaacgtgaccggcgacgaacgactcgaaaaagccgaggaagtcatccgcgaaaccacggcgcagctgatcgtcggcatccgcaatacgctcaacctgtacgacgtggaccatgcgggcggcaccatcagcggcgtggtgcttaccggaaccggcgcacggctgatcggactgccgccggtattggccagttccatcaacaaagtggtgcggatcggcgaccccttcatccgtttccggctttccaaagaagtggaacggcagaacatcatggcgcacgcgatcgatttgggcgcagtgcttggactggtaatcggaaagaagccgaggtgaacggacgatgagcagaaaaaacaacggaagcatgaagcagatcggcagctcccaccgcggtcgacgcggcaaaatcaaggataatccgaatcctgaaaccagtgatggcgagaaaacctcgattttgtcgatgaatatttccgacatcggcaaagcgctgcgtgcgagcagttcgaaaacctccaaaaaggctgatctacccgccgaatggaatgtgcgcgccaacctgctgccacgttccatcgtgacgctcaaccgtgatcgtgccatcaaatacttgctgtcatacgtgcttatcgtggtggcggttgcggccattgccatcagcgcgggcatggcggtgcgcgtgagctgggccgaccatcgcgtggaggaggcacaggcgaaaaccctgtcgttgcagaaggaaaaggcggaattcaaagacgtggaagacacgttgaactcgctgtccgattcgcaaaggtcacgtatcgccgcgctctacgacgaaatggattggatgaaggtggtggattcgctcaatggcgcgctgccagccggaggccagtacacgaacctgtcgttgagcagcttccagattggcgggtctgacgcttcttcgcatagcgctacatcttcagtatggtctgggaatggtgtgatttccgttgattttaccgttctttctccagatttcatatctgcaaaagattttatcggtaattttgctgcaattcctacctataaaacaggctatgtgagttccattaccgaaaacagcgatgaaaacggcaccacctatacatacacgggaacggtgtcgttgaagatggataccaataccacgtcacgaagcgacaacgcggccggtgctgacgaagccaaccgagcattgcagcagcagctacgcgacagcctgaacaaagccgcggcaggggagtcgactgatactaccgacagcgcgaccgcaactgacgaaacatccaatgaatgatcgggagcaatcatgaacaagcataaaatcgcatggatcgcattggccgcaggtattgtcttcgtcatcatgctgacatggctggtcggcgtttccccgcaaatcagccatatcaaatcatccgacgcgcaaactgcgcaaatcgatgagaacaataaggaaacacgcgacgaaatcgaaacattacgcatcgccagcgaaacgatcggcctgcagaaagaccgtttgcgccagttgcagcggcagattccagacggctataaccagcaggaattcatcaattcgttggatgcgtccgctgcgggaaccggcgtcgccatcaaatcggtgaatttcgatgatgcggtcgacgccgacattccagctgaaatgcaaggtaccattcaagccggtcagctggtgcaggtgtcggtaagtatcaccgccacgggaagctatgatgccatgcgtaatttcgtggcatccgtgcagaacatcaaccgtatcgccgtgccggaaaatgtgacctacacacttgacagaaacggtgacgaaacgaaaaatgccgtggtgatcgattgcaagatctggtcgctattgctcgacaacgacacggttgaagacgagaacgccacgaaacagtaacgcgggtggcgttctgtcaccgcgtaaaggtaggctttgcgcttgtaaagaccccaaaccgttcaaaccagaaggtgcattgtggctgtatccaaactcgatgaagtcgtatccctcgccaagcgtcgtggctttgtttttcccgccggtgaaatctatggtggaacccgttccgcgtgggattacggtccgctcggcgttgcgctgaaagacaatatcaagcgcgaatggtggcgttccatggtcgtcacccgtggcgacgtggtgggcgttgacacgtccattattcttccgccggccgtgtgggtggcttccggtcacgtgtccgtgttcaacgatccgctgatcgaatgcctcaactgccacaagcgccaccgcgccgacaagcttgaggaatcctatgccgaaaagcatggcgacaagctgccggaaaacggcctgaaagacattgtgtgcccggattgcggcacccgtggcaactggaccgaaccgcgcgacttcaacatgatgctgcgcacccacctcggaccggtcgaagacgagaactcgctgcactacctgcgtccggaaaccgcacagggcattttcgtggacttcaagaacgtgatgacttcttcgcgttccaagccgccgttcggcatcgccaacatgggcaagtccttccgtaacgagatcactccgggcaacttcatcttccgcacccgcgagttcgagcagatggaaatggaattcttcgtggctccgggcaccgatgaggaatggcaccagtactggatcgacgcgcgtacccagtggtacatcgaccttggtgtgaagccggagaacctgcgccattatgagcatccgaaggagaagctggcccactattcgaagcgtaccgtcgacatcgaatacaagttcggcttccagggttccgattggggcgagcttgaaggcgtcgccaaccgtaccgacttcgatctttccgcgcatgccaagcattccggcgaggatctgagctacttcaaccaggccaccggcgaaaaatacgtgccgtacgtcatcgaaccggccgccggcctgacccgttccctcatggccttccttgttgacgcctacgacgttgacgaggccccgaataccaagggcggcgtcgacaagcgcaccgtgcttcgccttgatccgcgcctggctccggtcaaggccgctgtgctgccgttgagcaagaagccggaattgcagaccgtggcacacgatctggccgccgatttgcgtcagcatgactggatgatcgactatgacgaggccggtgcgatcggtcgtcgctatcgccgtgaagacgaaatcggcaccccgctgtgcatcaccgtcgacttcgacacgcttgacgatcaggccgtcaccattcgtgaacgtgataccatgcagcaggagcgcgtcgcactcgacaaggtggctgattatgtggccgcacgtattggcgagaagcatgtacgttacccgcaggtgccggttgagatgggcggcgaggcttggcctgagtccgtcaagatcgccgaagccggtggcttgtattaaagctggatactggttatcatagcgttcttatgccagatagcattgtgactgcttacgaggaatccgacgtgctcgacccgcgtaccgacgcggtgaggccgtcggttcctccggttatgaagcctgttgatttagggccggtacacgttgaaaccccggtggtgctttcgcctatggcgggcgttaccaactggccgttccgcgtgatttgcgaaagctacggaccggacggtctatacgtggccgaaatgatcaccgcgcgcgcgttggtcgcacgcaatcccaaagcgttgcggttgtgccatttcgcgccgagcgagaaaatccgttcgctgcaactgtacggtgtgaacccggcgatcgtggaacaggccgcgaaaatcgtcatcgacgaaaacatggccgaccatgtcgatctgaacttcggatgccccgtgccgaaagtgacccgacgcggcggcggatcggctttgccgtggaagacggatctgtttcgcgagatcatccagcgtgtggtcaaggtctgcgatgctgccaacgtgccggtgacggctaaaatccgcgtcggcatcgaccatgagcatgaaacgttcttggaagcgggccatatcgcgcaggaggaaggctgcaaggcggtgaccttgcacgcgcgtaccaccgccgaatattacggcgggcattccgactggagccggattggcgagctggtcgaagcgcttgacattccagtgttcggcaacggcgatatttggggtgcgaacgatgcgcttgccatggttgccgaaaccggttgcgccggcgttgcgattggccgcggctgccaaggcaggccatggctgttcgccgatatcaagaatgcgttcgctggcagcgacaagcgtgttgaccccacgttaggagatgtgtgccgtgtggttgaacgccatgcggaactgttgaccgaattctatgatggcgatgagcagatggccgtgcatgatctgcgtaagcatatcgcgtggtatctcaagggattccccgttggaggctccacccgtcgcgcgttcatggaatgtgaaaatcttgaggatgtcagagccgaaataggcaagctggatcccaacatctgttttcccgagcgagtggtcgacaagccaagggggcgcgtgcgcttcgcaaagaaagtgcatctgccttacggatggttggaatcacgggaaacaacgcatgatgaacgtcaggcgttgtttggggatgatcctatggacgccagctattgaatatatgacatgctgatgtggttaaatcgtcgtgggggcaccgaaagagggtaaatcgcaggcgaaatgaacacgttagcaataaaaaagtgaaaaaacgccgttacacacggcgaaaagtgcgcgtactgcagcgtgtctgcgataaagttgtgcgtaaacgcgagtgacaggagactatggtgagcgagattgcccagactgacaatttcaacgacaaaacgaatatcaaggttgtcggtgttggtggagctggcggtaatgccgtcaatcgcatgattgccgagggtcttcaaagtgttgaattcattgcgatcaatactgacgcgaaggacctgatgcgttccgacgccgatgtcaagatctccttgaacgatgccaccagccgcgggcttggcgcaggtgccgacccggagaagggtgccaaggccgctcaggatcatcagtccgatatcgaggaatcgctcaagggcgccgatatggtgttcgtgacctgcggtgagggtggtggcaccggtaccggtgcaagcccgatcgtggctcgcgccgcgcatcagcagggtgccctgaccattgcggtggttacccgcccgttcagctttgaaggtccccagcgtgcggcttccgcagcacttggcattgagaatctgcgcaaggaagtcgatgcgctgatcgtgattccgaacgatcgactgcttgagctttccgatcgcaccatcggcatcgtcgatgcgttcaagaccgccgacaccgccttgctggccggcgtgcagggcatcaccgacctgatttcttcgaactcgtacattcacgtcgacttcaacgatgtcaacgctattctgcgtggcgcgggcaccgcactgttcggcatcggttccgcacgaggcgaggatcgcgccactcaggcagctgaaatcgccatcagctcgccgctgctggaagaaagcatcgagggtgcccacggcgcgctgatcaatatcgccggcccgtccgatctgaagttgcaggaagcggccgccgccacccagctggtgggcaaggccatccatccggaagcacagatcatctggggtctttccctcgacgacgcttacggcgacgaagtgcgtgtcactgttatcgccgcaggctttgatgccaactccaagaaggcggctcaggctgaagcccagaagcaggcagagcctgcggaaagcacggtgccgctgtcggcgttgtccgcagccccgagggcagcggcggttccgcagcagccccagcctcagcttattcagactccggaagccccgaaggtgcagccgctgtccacttatattccgtccactccggaacccgtcgttccgtcattcgaccagaccaccgagcatgaagtggtgtcttcgaacgacgccggcgatttggatattccggatttcctgcgctaaaagcaacgcgaagacgcgaaaggatcgttcatggcaggttttatgaaaagcgcgatgtcctatttgggcatgaccgacgttgccgaaggtgacgaggatttcaacgaggaggctgagagcagcgaaacctcgttcgattccgaccattccgtgaccccgatggcttcgactcctgccgcgacgtccgcaccgcgcgagcagaccaaagccaacccgttccaaggcggaagggtgagtcgtatcaccacgattcacccgaaatcctatgaggacgctcagctggtcggacgtgccattcgcgacggcgttccggtggtgctgaacctgaccggtgtggccgaggccgtggcgtatcgcattgtggacttttccgcgggtgtggtttttggcgtgcgtggctccatcgaacgtgtcactccgcgcgtgttcctgctgagcccagctcaggtgaacatcaaggttgaggaaccgcaggcgaataactcgtcgcacgatttgttcgccgactgatatagacgaaagccgttgcgaaagcagactgcatgaagcctccgtcacccgtgatgggggctttgttatgttctgttgctaaggtggtgctccatgattttgtctttgatcggtagcatcgtccactttttggtgaatgcctacattctggtgctgttcattcgcatgattctcgattgggttgctgtgttggcatcggcatggcgtccacgggggttggtgtcgtcgttgatcgacgcggtttaccagttgacggagcccccactgcgctggctacgccaatatatccgccctattccaatgggtcccatctacttcgatgtggcattcatcgttctttatttcattctcattgctattgatttcctcatttaatgtatgtcaaatgccgatttttcgcaaaaaatcggtggtcccgtgctagagtcgaacaatgaaagcaacaacagcaaggcatcaagcccaaagcgaggtgtaagatttatggctctgttgacgccgaaagatatcagagagcataccttccagaccgtgaggttcaaggaggggtatgacgtcgatgaagtcgacgattttctcgatcaggtaaccgagacggtggaggcccttggcaagcaggcggttgccagcggccaggctactcagtccctcggcccggatgttgcggggctcaactccaagatttccgagctcagcgcccaggttcagtccctgcagcaggagaacgcgacattgaagtccgcctccgagcaggcagctggcgctggtgatcaggcagctcaggccgcacaggtcgcagcagccaagctcaccgaggctgaggaaagcaaccgtgctctgtcggctcagaacgaacagctcaagggtcaggtggatcgcctgtccgcacaggtcgaccagctcaccgcacaggcggctgaagctgcaggccaggcggatctgggcgaacagctgacctccatgcagcatgagcgcgacgcattccgtgcacagaccgaagacctgtcccgtcagctggcttccgcacagcagcaggttgtggtggcccagcagcaggcggctgagatccagcagctcaatgcaaggcttgaagaggctcaggagcaggtcgcccaagctcagcagctcacgcagcagcatgcggcacagtcccagcagcaggatgagcgtgcccagcagcaggccgcgcagattcagcagcttgcacagcagctgcaggaatcgcagcagcgtgaagcccagctgcgcgagcaggtcgccaaggtcgaaccgagtaccgaaaccggaagcctgcagaagattgcaggagccgcagccagcgccaacacggagccggagcgtgccaccgccatgctgaccctggctatgcagctgcacgaccagtacgtcgacaagggcaaagccaaggctaaggaaatcaccgacgagtcccagcgtaggtacgatgagctcatcggcaatgccaacgattactccaaccgcactcgcaccgaagccgacaactactccgaaggcacccgttccgaagccgatcagtattcggctgacactcgtgccaaggctgatggctacttgaaccagaagactcaggaaggcgatgcctatctgaccaagcgtgctcaggaaggcgatgactatctggcgcagcgcactcaggaaggtaatgcttacttggatcagaagactcaggaaggtaacgcctatcttgctcagaagacgcaggagggtgatacctacttggatcagaagactcaggaaggcgacgcctatcttgctcagaagacgcaggagggtgatacctacttggatcagaagactcaggaaggcgacgcctaccttgctcagaagacccaggatggtgatacctacttctccacgaagcacaacgaagccgacgaatacgagtccgaagtgcagaagcgcgccttcgactacgattcgaagacccgtaccgcagccgacgactacgcccagcaggtccgcgacaatctcgaagcgcagaccaaggtcatcgaaggcaacattcagggcctcaagcagttcgaaaccgaataccgtgcacgtcttaccgaattcctcggccagctcgtgtcccaggtgtccgacacgaacaactatgatcaggactcccaggacgactgagattaggctgtgtctgacatcatgacaaatgatcaaagacggctgcgcacccgcgtggccgtctttgcgtgtatcgccgttgtggcactggtactcgaccagatcagcaaggcatgggcgcagtcggcgcttgccgacgggcagacggtacgtgtgattccgggcatcctctcattcacgctggtgcataatccgggtgcgtccttgggcatgggatccaacatgacctggttgatttcgttgcttgccatcgtggcgtgcgtggcgttggccgtactggcaatccgtaccatttccatgaaatggacggtggtgttcgctcttgctttcgcaggagcattgggcaatctcatcgatcgtgtgatgtatgccgaaggtttccttaatggcaaggtcgtcgatttcctcaattacggatggtcggtcggcaatgttgcggatattttcctgatggtggcgggcgtcgccgccgtcgtactgctgtttgtcggagagcccttcagccagaaggatcttgacgaacaggccgcagaacagacgaaacagacgaccggagaccagaacgcatgagccgtcttgttcccgcacccgacgcgcttgtcggcaaacgattcgatgtggccgtggccaagatgcttggtatctcccgagccaaggccgcggaactcatcgaaagtggacaggcgcgcgtgcttggtcgtgacatttccaaatcatcgactctgcaatcaggcgaaaccgtcgaattcgatattgtcgaggaacggaccgagcctgaaccgatcgcacgagatatggcagtggtctacgaagacgatgacgtcatagtggtcgacaagccagtgggtgtggctgctcacgcttccgtcggttggaccggtccgacggtgctcggcagtctgcttgacaggggagtgcacatcacctcctacggcgccgcgggacgtcagggtatcgtatcccgcctcgacgtgggcacatccggattgatgctcgtgtgcaaatctgacctcgcctacgtggaaatgcgcaggcagttcgccgaacatgaagtcgtcaaaacctatcatgcgctcgtgcaaggcaatctcaaggaaaacaaggccacgatcgaagcgccgatcggacgtgccaaagtctccgattttcgtttttgcgttacgcccgccggcaaagaagccatcacccattgggatgtgatggaacgtttcggtgaggcgacgctggtttccgtgaatctggaaaccggtcgaacccatcagatccgcgtgcatttctcgtccatcgggcatccgcttgcgggagacgccatgtacggtgccaatccgcagttgggtgaggcattgggattggaacggcagtggctgcacgccaagcaacttgaattccgccatccgcgaacccatgtgtggaccacggtgaaatcgcattatccagctgatttgcagcatgcgctcgacgtgatgcgcggcaggcacgacacacaagacaagcctgaagtgtgatcgcacgtcaccaatcaccggtagattggaacgtatggctacttccggaaatttcgtgcaactgcataatcacacgcattattcactgcttgacggggcgtcaaagattccggatctggtcaagcgcgccaaagaactcaacatgccggccgtcggcatcaccgatcacggcaacatgcatggcgcatacgaaatgtggagcactgcggtcaaggaaggcgtcaaaccgattatcggcattgaagcgtatgtgacgccggaaaccgcacgccaagatcaaacccgcgtcagctgggataccaactggaatcccgatatcgatccgcaacatcgcaggcgcaaccccaacgacgtatccggcggtggcctgatcacccaccttacgatgtgggcggaaaccgatgagggccttgtcaatctgatgaaggcgtccactgacgcgaatctcgagggacgtgtcatgcgacacccccgaatggataaggaaatccttgccaaatattcgaaaggcattatcgcatcttccggatgcccgtcaggcatcatccaaacgcgactgctgctcggccaattcgacgaggcattacgtgcggcaggcgaattgcaggatattttcggacgtgacaatttctatatcgaattcatggaccacggtctgaaaatcgaaaaacaggtgaccgacggtctgctggacattgcgaaaaaactgaacgcgccgctgctcgccaccaacgattcccattacgtgcgcgccgaagacgccggctctcaggatgccatgctgtgcatcaattcgggatccacgcttgacgagccgggacgattcaaatttgacggcaccggctactatctgaaatccgccgaagaaatgcgtgagctgttcaaagacattcccgaagcatgcgacaatacgttggaaatcgccgaacgctgcaatgtcatgttcgacgatcatgaagatggcgcgttcatgccccaattcgactgcccggaaggttgggatgagacgtcgctgttcctgaaaaaagtcgaggaaggcttggaacggcgttatgacgggcatccgccgatcgaagtgctcaagcaggccgattacgaatgcggtgtgatctgtcagatgcagttctgcggatacttccttgtggtggccgactacatcaactgggccaaatcgcatggtgtgatggtcgggcctggccgtggctccgcggcaggcgccatggtggcgtatgccatgggcatcaccgaactcgatccaatcaagcacggcttgatcttcgaacgattccttaacccggaacgtgtgtcgctgcctgatatcgacgtcgatttcgatccggacggccgcggtcgcgtgcttgactatgtcggagacaagtacgggcgagacaaggtcgcgcaatgcgtgatctacggcaccatcaaaaccaaacaggcgctgaaggattccgcacgaatcatgggctacgaattctccatgggcgagcgcatcaccaaggcgttgccgccggcgcagacgggtggcaaggatattccgctgcatgatattttcgagccgagttcgaagcgttatgcggaggcccgcgaattccgtgagctttatgattccgatccggatgtgaagcgcgtcacggatgaggcgatgggtatcgaaggcttgatccgtcagaccggtgtgcatgcgtgcgccacgatcatgggtagcgagccgatttcgaatacgtcgccgctgctggaacgtaccgatggtacggttacgaccacgttggagtatcatacgtgtgaaacgcttggtttagtcaagatggacttccttggtctttccaacttgacggttattcgcgatacgttgaacaatatcgaggcgaatggcaagacgcgtatcgaccatacgaagattccattggacgatcgtgccacgtacgatctgttgtcgcgaggtgacacgcttggcgtgttccagttggattctgatggtatgcgttcgttgctgaaaacgttgaagccgaataacttcaacgatatttccgcattgatcgcgttgtatcgtcctggtccgatggatatggattcgcatacgaattatgcgaagcgtaagaatggtttgcagaagatcacgccgattcatcctgaagtggccgagccgttgaaggaagtgcttgacgaaacgtatggtctgatcgtgtatcaggagcaggtgcagtcggccgcgcgtattctggcgggttattcgttgggcaaggcagacgtgttgcgtcgagcaatgggcaagaagaagcccgaggtgctggccaaggagaaggtgccgttcttcgcgggcatgaaggagcatgggtattcccaggaggcggcgcaggccgtgtgggatattcttgtgccgttttcgggctatgcgttcaacaaggcgcattcggccgcatacggtttgatttcatattggactgcatatctgaaaacgcattatccggtggaattcatggccgcgttgctgcagggtgcgagtacgaacaaagacaagaccgcgttgtatttgggcgaggctcgtcgcatgggcatccaggtgttgtctcctgacgtgaacgagtcggtgtacgagtattccgctgtcggcgatgtggtgcgtttcggtcttggcgccatccgtaacgttggcaaggctgcggttgatgcgattgtcaaggaacgtgagaacgatcatggcaagtatgtgaatttccctgatttcatcaggcgtgtgccgatggaggcgttgaatcgtcgattggttgaatcgttgattaaggccggtgcgtttgattcgatcgatccgaaccgtcgtgccttgtttacgattcatgaggctgcgattaattcggtggtcggtttgaaacgcaagcaggccgaaggccagtttgatttgttctccgatttggaagatgccggcgaagacgatgcgggcatgggcgatgccatggtgaatgtgcccgatgtggaggagtgggataagaaaaccaagctgaatttcgaacgtgaaatgcttggcttgtatgtgtccgaccatccgttgagcggtatgcagtcgattctggtgtcgttgcgtgaaatgtcgatcgcgcatctgatcgatcgcgcggcgaatatgccggacggccagcaggtgacggtggcgggtttgatcacgaacgtggaccgtcgtatgtcgaagaagggcaatccttgggcgattgtgaccatcgaggatttggaaagctccatccagtgcatgttcttcggcaaagtgtatgaggccgccgctcccgaactggcggtcgacacggtggtgcagattcgcggacaggttgagaaacgcgatgagacggtaagcatgcgtgccacggaattcaacgtgccgacgttggaagcgcaggatgagaagccggtgacgattatgctgccgccgattgcgcttgaccaatcgcatgtgcagcagttggggcagattctttcaaatcatcctggaccctgcgaagtgaagctcgccttgatggacgataagggcaatgccaaggtgttgacgttcggcgaccgtttccgcgtacgccgcgacacgagtctgttcgccgaaatcaaaatccttttcggtcccagttctctgcctttgggctgaccggtcgtggggatgatgccgaaagttcagccgaatatctcactatgcggctgaacttgagacgcgcgggcgttctcgtgacatcacgttgttaccatggggcgttatgagcgaagaaaactatatgcgaatcattgacctgcgtggcaagaagctgacccgagctgaaatgctggaggctatgcctcgcgctgagatgggcaccaacgaggccaccgatctcgtgcagcccattcttgacgatgtgaaggcccgcggtgctgcggccctgcgtgacttcgcggagaaattcgaccatattcgtccggagaacctgcgcgtgccggtggaagccatgaaggccgccgtcgacgagttggatccggaagtgcgtgccgccatcgaagaatccgtgcgccgctcccgcgccgtgtccgcttcccaggtgccggcgccgttccacaccgatctggctgaaggcgcgcgcgtttccgagcgttggattccggtgcagcgtgtcggcctgtatgtgccgggtggcaaggccgtctacccgagctccgtcatcatgaacgtggtcccggcacaggccgccggcgtggaatccctcgccatcgcaaccccgccgagccgtaacaatgccgacggtctgcctgacaagaccattctcgccacctgcgccattctcggcgttgacgaagtgtatgcggtcggcggcgctcaggccgtggccatgttcgcttacggcgccaagggatccgaaccgcaggacggcgaaatcctgtgcgatccggtcgacaagatcaccggtccgggtaacatcttcgtcgctaccgccaagcgcatggtgtccggcatcgtcggcatcgacgccgtggcaggaccgaccgaaatcgccatcatcgcagacaagggtgccaacccgagctggctggccgccgatctgatcggtcaggccgagcatgacgaactcgccggttccgtgctcatcaccgacagcgaagagattgccgaacaggtgcaggagaacctcaagtaccgtgtgccgcgcaccgagcactccgagcgtgtgaacacgtcgctacgcggacgccagtccggcatcatcctcaccgatggcatcgagcagtccattgacgcggccaatgcgtatgccgccgaacaccttgaggtccagaccgccgacccggatgccgtgatcgccaagattcgcaacgccggtgccatcttccgtggcccgtactctccggtgccgctgggcgactacatgtccggctccaaccacgtgctgccgacttccggcactgcacgcttcgcctccggtctgggcgtgcacaccttcatgaagccggtcgaagtcatcgaatacgacgagcagggattgaagaccctcgctgctcgtgtgaacgccttcgccgtttccgaagatctgccggcacacggtgaaagcgtgctgagccgtttcatcgacgatccgtacaacaaggaaaccatcaaggaacaggaagagcaggcaggccttcgatgagtgagacttccagcaacgccattccggcatatcttccgctgcgcaacgatctgatcggtgaggagccgtacggtgcgccgcaattggacgtgccggtatgcctcaacgtcaacgagaatccgtatgcgccggaaccggcagtggtcgaaaccatcgcgcagcgagtcaaggaaatcgctctgacgctcaaccgttacccggatcgtgagcatatcgcgttgcgtcaggcattctgcgactatctcgaacgcgagtccggcgtcaagctggaagtcgaccagttgtggggtgccaacggatccaacgagatcatgctgcagctgttccaagctttcggcggtccaggacgcattgcgctcggctgcgatccgacgtattcgatgtatccggaatacgcccgcgacacgttcaccacatggaagcttgcgcaccgcaacgaggatttctcgctgaacgtcgacgccaccatcaaggccatcgaagacgtcaagccggccatgatcgtgctcaccagcccgaataatccgaccggcacaccgctgaagatggatgatctcaagcgcgtgctcggcgccgccgaaaccgctgaagtggccggtgccgccgaaggcgtgcatccggtggtcgtggtggacgaagcctacatcgaattccgtgatccgggtacgcccaccgcgctcgaactcatcggcgagtatgagaatctcgccgtgagccgaaccatgagcaaggcgttcgccttcgcaggcgcgcgagtcggctatctggccgccaacaagggcattatcgactgtgtgcgcatcgtgcgtatgccgtaccacctgtcggccgtcacccaggcagccgcgcttgccgcgttcgaacataccgacgaacagctcagccgtgtggcgcatctgcgtgacacccgcaatcagaccgcggcatggctcaaggaacaaacctacaagggccagccgctcgaagtggccgagacgcagtccaacttcattctgttcggcggtcatttcgacgatcgcgaccgcatcttcgacgaactgctcaagcgtggtgtgctcatccgcaccgtcggccctgacggctggatgcgcgtatgcatgggcaccgacgaggaaatggcgcgtttccgtgaagccttggtcgaagtgttgcgtattgtggaacaagactgagcacatacgggactgaaccaacacaacaggaccgaacattttccaaaaggagtcgcaacatggcgcgtactgcaaccatcgttcgtgaaaccagcgaatccaaggtcgaactgagcctgaatctcgacggcaccggcaaaactgacatcgacacgtcggtgccgttctacaaccatatgatgacggcgctcggcaagcattcgctgattgacctgaccatcaaggccacgggtgacaccgacatcgacgcgcaccataccgtcgaagacatcgccatcgtgttcggtgaggcgttgaagcaggcgctggggaacaagcgcggcatccgtcgcttcgctgatgcgaccgtgccgttggacgaggcgcttgccaaggccgtggtcgatatttccgggcgtccgtactgcgtgtgcaccggcgagccggaaggcttcgaatactgcatgatcggcggccatttcaccggctccctcgtgcgtcacgttatggaatccatcgccatgcatgccggaatctgcctgcatctgcaggtgatctccggccgtgatccgcaccacatcgccgaagccgagttcaaggccttggcacgtgcgcttcgtttcgccatcgagtcggatccgcgtgtcgacggtattccgagcacgaagggcgctctgtgatgagcgacgatcgaaataacgatttcgacgatttccaaggattcgatggatcaaacgatttcggtgacctcaacgccgacggcatgcatttcagcgaagaggaactggaagcggccatggccggcttcgagcaggaattcaaggatgccgaagcgtccaagcatgagcgggcggacaatccgccatctgaagctttcgattcctccgaagcttccgataacgcggaatcctccgaatcctccgaatcctccgaatcctcggaagtcgacgacatgctcaacgcggctgaggattcgttgaaattcgaagacgagctgcagggactgcttggcaatcgcgcgaaagtggcggtgatcatcaccagactgacctcgccacgattgctgtcggcattctgtgaattgtccgacatttccgcgcaatgcatcggatcggcgcaaggtgctgtcgcggtgctgcgcaatctcgacggagacggtccggaagcggcggtcaaagacatgacgatcgtcgttgccggcatgcccgcgattcttgccgtcaaccgtgcggacaagctcgaagcgacgatgtacgtggaaggcagagcgggcaaaaccttcgctccgccggtgctattcacctccaccgcgccgttcgttgaggatctcatgctgggcatcaccgatatgaacgcgctggaacaggcggatatgaccattttcgattccgctgaccttgatcgggatgcggcgatgagcattatcgccgagcatacgcggttcggacgcggcacatcaagcatcagttaacgacggtaaacgcgagtcatcctgccgaacatgcgttatgcgacacaagacgactcgcgccacagaacaacgaatgacacaagaaggagaacgcccatgacttccgtggtggttttcgattatggtttcggcaacgtgcgttccatggttcgtgcactggctgatctcgaccttgacgtgaccctcacttccgaccatcggcaggccttggaagccaacggtctggtagtgcccggcgtgggcgctttcggcgcatgcatggaaggactcaagtcggtgggcggagacaccgtgatcaaggatcgtctgcgtgccgggcgaccggtgctcggcgtgtgcgtgggcgagcagatcatgttcgaacgcggtatggaacacggcaccggcactccgggccttggcctgatcaagggcgacgtggaactgcttgacgccgatgtggtgcctcacatgggatgggacaccgtcgaggcgccggaaggttccgtgctcatgaagggtgtggaaggtgaacgtttctatttcgtacattccttcgccgcgatgagcgtcgctcccgccgacacgtccggcgaccagcttgatttcggtgacgccgaggagcgcgtgacctggtgcacgtacggacgtagccgtttcgtggcggcctacgagcgtggtccgctgttcgccacgcagttccaccctgaaaaatccgccgaagcgggctcgcagctgctgcgcaattggattgcgacgttctgatggtgcgagatcgccgatgattgtttcgacgatgctttgacatatacgcttttaaaacgaccacttggtacatttatttgcgattgccgtttagtggcggtcggttgatcacagagaggtacagacatgtctttgacattgcttcccgcagtcgatgttcgtgatggcaaggccgttcgcttgcgccaaggcgaatccggttcggaaaccgattacggttcgccgctggaggctgcccgcacgtgggtcgagtccggtgcggaatggattcatctggtcgaccttgacgcggcattcggcacgggcaacaaccgtgaccagctgcgcgccatcgtcaaggagcttggcgacaaggtcaatatcgaaatgtccggtggcgtgcgcgacgacgcatccctcgacgcagctttggaagcaggcgccgcccgtgtgaacattggcacggcagcgcttgagaatccggattggacagcttccgtcatcaagaagtacggcgatcgcgtggccgttggccttgacgtgcgcggccacaccctcgcagcccgcggatgggtgaaggaaggcggcgatctgttcgaaaccatggcgttcctggattccgttggctgctctcgttacgtggtcaccgacgtggctcgcgacggcatgatgagcggtccgaacatcgatctgctgcgtgaggttgcggaacgcactgatgcgaaggtcaccgcgtccggtggcatttccaagctcgatgacctgcgcgccatcaaggaacttgccgatctgggcgtggattccgcgattctcggcaaatcgctgtatgcgcgcgccttcactttggaagaggcgcttgaagtcgcacgttgagcattgttcgcaaacccatgacgatacggccgtccacaacgtggacggtctcgtcatattcggcgcgtgttaacgactttcgtaacatgcgcatggaacgatggggcactatggataaacagcaagagtttgctttgcgcacagtcgaagaacgcgacgtgcgcttcattcgtttgtggttcacggatgtgttgggaacgctgaagtccgtggctatcgcaccggctgaattggaagctgcgttcgaggaagggctcggattcgacggttccgcggtggaaggcctcacccgtgtgtccgaagacgatatgatcgtcaagcccgacccgtcgacattccagattctgccgtggcgtggaggcccgcaaggcaccgcgcgcatgttctgcgacgtgcttacccctgatggcgagccgtcgttgggcgatccgcgtcatgtgctgaagcaggctctgtcgaaagccaaggaaaaaggcttcaccttctacgtgcatccggaaatcgaattctatctgttcgaaagacaggatgattggtcccagacgccaaccccaatcgatgagggcggctatttcgaccatgtgccgcgcagcccaggcatggacttccgccgcgccaccgtcaacatgctcgaacagatgggcatttcggtggaatactcgcatcatgaggcgggtccaggccagaacgagatcgatctgcgttatgcggacgcgctcaccacggccgacaacatcatgaccttccgcaccgtcgtcaaagagatttcgctggagcgcggcattcacgccagcttcatgccgaagccgctttccgacgctccaggttccggcatgcatacccatttgagcctgttcgaaggcgacgccaacgcgttctacgaggcgggccaggaattcaacatgtccgtcaccgcacgccagttcgcggccggcattctgtaccatgcggctgaaatctgcgcggtcactgaccagtacgtcaactcctacaagcgcctgtggggcggcaacgaggctccgagctacatctgctggggccacaacaaccgttccgcgctgctgcgcattccgcagtacaagccaggcaagggcaattccgcccgcatggaattccgtgcgctcgacccggtcgccaacccatacctcgcatattcggtgctcttggcagcaggccttgacggcatcgacaagcagatgcagttgggcgagccgaccagcgacgacgtgtgggagcttaccgatgcggaacgtcaggccatgggcatccagccattgccggagtctcttgacgaggcgttgaaggttatggagaagtccgacttcgtggccggagtgctcggcgagcatgccttcgaatacttcctgcgcaacaagcgtcaggaatgggaggaataccgcaagcaggtcactcctttcgaactgaagaagtacctgccgaagctgtaagcgaaccgtaatcgtttcatcaaagaccgttgttgcaatcatgagaaaactgattgcaacaacggtcttttgctttccgaatgattatttgaatcttcttttgatgtttctgcaagtatcggattaaagttccaatgactcaattgaccgtaaattaacggttttgcgaagaatctcatcaccatagtcagaaaatatgaatgtcacaggcgagttgctttgcgtttcaaaagcgactgtcgtcgtcattttcacgccgggagtgaccttgcgtgttgtggaatagctatcatcgtcaagatacgtgctatgcaactcagtgccgtcttgggtcgcggaaacatccatatagttcaggaaagcccggtatttgcttccattttcgacataccaggatatgcgtgcgaacgctatgtcatgatcggcatatgaggggcttgtcttctcaatggagtctacgcggaaatgcagggtgctttcgtcataatcggttacggatccgtcttcgtcgaaattcgaagcgtccacttgctcgggctgagggacggccgcataatcaatatgtttcaaggatccttctatgtcgacttcgtcaaaggaaaacgcggcgcgaacaacattatgctgcgaataattcatcagctgaaccacaactggtgaattggtgtccgtaagaacgaaactgctggtggtctgcgagcttttcttcggtttcatttcggcgccggagaactccgtgcggtcggaatcctcgttggaagtgaatgcaggagcaagctcgatgccgttttgcatgaccatcagatctgcgacggcatgaggatacatcgttttcttgccgatgttcgtgcaggtgagcaaaaccgtgagcgtggcgtcgccgttcaaatcctccggacctgtctgcacgccttcgatgttcacttccaatgcttttcctccggtggagtagagctttccaacgtcttcgctgacggtttcctgcgtggacagctcctcgaactggcttgtggatccatcgaaatcggagatgatgtttgacatgctgtcagaaagcattccgccaatcgacgctattacagcgatgatgataacgatctccaaaacggtgacgaagccgtttttatggcggcgttgcttcttgtcggaagtggattggaactcgcgtgtggctcgttccgtttgtatgcgcggcggattatagggctgcgatgggcgtccttgcgggttctgcaggttttgctgattttgccgcaacgcctgttgcaagctttgctgcatggactgggcataccgcatggtttgcgtggaccagtcgttcaacatggtttggagcgtgtctcctcgtgtggactgatcgccttgcgcctgttgagatctaccgtcttgcttggatcgggtgttttgtggggcctgcctgtcgcgcgatgcctgatcgctctgcgcgggtttcacatatcgccgctggacataggattcacgccgtgcatggtcacggttcacctgattagacaggcgttcggcgttgctgctgggatcgatgtaatcggaacccttgaatgggtcgatatagtcgttgttgttgagtaggctcatgaaaggctccttctggtcagtcccttccatgagcaattgtatcgaaaaatcagcctcgaggagagccgaacatcgaattgtagatgattgcgaaattacgattgccgtaagtcgaacaggcgtcgccttcgccgactcccgcatccaatgcggctgcattcggctgataaggcgtgtaaatgtacagcagtgctgtcgccttgttttcgatgtacacgttgctgccaccgcagctggcgtccggattgtattgaatatagttgagcgtgcccgcatggtatccatagcgatcctcatgttgcacgtaatactggtagcgtttcgccgcgccatacacctgtttgaaaaaacctgcatattccgggtcacagttcgcgtcgtccgggcagctcaatcccatggccgacttgaattggaagtcgcttggatcggtggcggtaagcagatgctgctccttttgcagcacggtgagcagcactttttgactgatgtcgcacgcctttcccgacttgtagatgatcgccgcggcgctttcgttcggctctccctcatatgcttcgcagtattcgttggcgggttgcgattcggtgctaaacgtcatggatttcaagcatttctcgccgctgcatgcggcaccctgtttttcgatgatggcgttcacctgctgctcgctcaacgcgttcccgttgaagaacagaccatctgaaatgatgttgcccggattgaaatcgtattgcgtctgcaattgttcctgcgatgcgaccgcttcatccacttgcacacgccaaccgacgaatcgcaccaatccaacgatcaacgcgagcgcgacgatactggctatcagtgtttcgccgactatgaggatgcgttttggggtgtttgcttttttccaggcgttacggagtttggtgaggcttggctgcttgtttttcttgggtttgcggttgttttttgctgtggtggttgttttgcgtgtcatcgcgcgtcattgtatcgcgtttggcttatcgtttgtttgacgattgattcgtcaatcgattgacgtgagaagctttaatgacaatgcgagtttggcgaggcgtggggagttcgaggggctatggaggagaagtgtatggcgaagagtgatgtggcgaaggaacggtttttcaatctgcctgtgattgtgctgatctcgctgagtttcatgctgggcatgagcgagttcattgtcgttggcgttctgccggatatcgcggctggcttgaaggtgtcggaggtgacggtcggcaatcttgtgtcgctgttcgcgttcgtgtatgcgccggtcacgccgctcggatcggcgctgtcggctcgttttccgcgttttgccacgcatctgacgctggttggggtgtttcttatcggcaacgtgttgtgcgcgttcgcgtcgaattatggcgtgctcgtggtggcgcgaattctcatcgcgctggtgtccggcacgctggtggccattgccatgacgtacgcgcccgatgtaacaactgaacagtaccgcacggagttcatcgcatgggtgttttccggcttctccatcgcatccgtggtgggtgtgccggttggcacgtgggttgcgaacacgttcggctggcgttgggcgttccatttggtgaacgtgctcacagtggtgcttattgtgctcatggtggtggtgttgccgcgcaacagccgtattgtgaagattggttttctgccgcagttccgcctgtttttcgaccgtcgtattcagttgggcgtgcttgccgtggtgtttggcgcggcggcaacttacgtgttctatacgtatctgacgccgatcatgcgagacgaagtgcatgttcccgaacagtatttaagcgtcggcctggtgattttcggcgcggcctgcctgtggagcaacctgtatggcggcaagcttgccgaccgtggcaggggagtgggaccactgacgcatattcgtccgatctactgcgcgcacgccgtgctcatggcatcgctgatcgtaacgcattgggtgccggtgtatggtgcgttgctgctggtggtgcttggcatgttcatgtatctgcagaattccgcctcgcaggtgctatatatggatgttgcctctcagtcgcatccgggatcgctgaatctggccgcatcgctcaattccatgtcgttcaacatcggcatcgcggtcggctccgcggttggtggactggtcaacgcccatttgggactgatgtggcttggccctgtgggcgcgatcttcctgctgtgtgcggttggcaccacaaccctgctgcgcccgttcgcagctcgagaacgcgatttctacgccaaacagcaagcctgatggcatttggtcgggtttgaacgagcggtttctgaaagcggcaaagttatagaagttttatctgtaattcgttgagattgcggaaagcgattagtggactgcgatgttggcgggctgggcagtggacccgccgacttgcggagcgtagtcggctagatcgattacgcgatcgcaggcgtcccgcgtgtccggatcatgggttgccaccagcacgatcatgccttgaccggccagattgccgagcacatggcttacggaatgtgatgtacgcgtatccaactgggcggtcggctcgtcgaccagcagcatgttcggcctggaacataccgcacgcgcgagcataagacgctgcgcctcgcctccggacaaagcgcagaaacgcctgtctgccgcatattccagatcgaacagttccatcgcttccaaagcctttggttccgcttcgcggcggctcattcccttggcgagcagtggaaacaccacatggtcgagcgctgtgcgttccgcaacaccatacggattctgaaacatccatccaacacgatccacaccttctcgcgtcaccgtgccagcgtaaggctgctcccatcctgcaagaatcgacagcaatgttgacttgccgcatcccgacggaccgcatatcgcaatggtcacaccaggttcggccacgaaactcaaattctcgaacagcagatcggttccctcaaatcgatgagccaacccctcaaccgcaacgcgcatagccaacctttcacgaggcaatcaccttaccgatgcacccttgccaatcatttgtagtcccctaatcgcaaccacgcaacatccaccctacctcatttgcgtatatgcaagtaagtttttcggaaatgccgcctgctatgcacattatcatgcggtgctacactcgttgtgatacattagtacgggggtgaagatggtgacttcttggatgtcattttgcaagacttgcgttcttgccgtcgcattgtcaatgcttttggcgggatgctcaattaatggggatgccacaggcgcatcttctgattctgccacatcggaatcatcatccgaaaatgggtcggcgggcggacagaaattggcggcgtcgttgagtgaatggattgaacagcgggaatcgcaaggtaatatcgctgaatcgcagaaaacgatattggacaaagccaaaagtacgggtgagatttcgacgtcggattatgagaaagcctggtctgattaccggcagtgcatgatcgacaaaggatataaggaaatcaaactcatcaaatatccgagcggactctatgccgaagctggacacaaacaggggacgaccattcaggaatcccgatattccgatgattccacggaatgcggcgatgagtatgttgcagatgtgcaggatgtgtacggcattatcgtgggcaatccgaatctgtatgccgatcaagcgcaagccgtggtcgattgtttgcatagagactcgctcgtgccgaaggactataccgtaagccggttcaacaaggagttttccggaacggatggcaatacttcgtttgacatgcagaacctgcaagtgcgcagttgccttgtgtcgaacggctacaacgtgggatatgcgaccgacgatacggaacagttgtggtgagaaggtaagtgattccaggggaattatggtgatgtgttcgctgatggtgcttgttggctgtgagtgaatgggtatatgtgagtatgacgcgacgattcggaatgaggcaaaggacgggcggtaagcgttcgaagtgcactgctgtgacttggactctgctggcggctgtcacggcagcttgtattgcggtcggatcctgcgcattgtggctgcctgaccgcacgccgacattactgagctcggcggtggagaagaccgtggctcccgccagtgtgcaagaatatacgggcatgcagcaggttactgtggtgcccaccatttccagtgaccgtgatctttccggcaatgcgagtggcatggtcaccgcggactggtccggcgacggcctgatctcaggcaaaggcgcctaccaggtgaacgatcgcacggtagtggcgttgaacaccgcaacccccttgtatcgcgatttgaagaccggagacatcggcggcgatgtgctcgccctgaataatgaactcagcttacttggctacaacagcgttcccggatcggatacctacgggtgggccacatcggacgggtggaagcagttgatggccgacaacggtaatacgtcggatggatcgttgtcattggccgacacattgtggattcccgaacacgaagtcgcagttgccgagtggaacgcaaccgccggatccatggtgacgggcggcaccgcaatcggcaaaatccccggatcattgacgaaactcaccatcaaaaacggcactgcatccgcgcaggaacgttcgttgacgatattcggcattacgggaacattgccagccaataccactgaaatcacggatgccgggttcctgcaacaagtcgaagcgaacgacagttaccaatccgtggacgtggaatccagaaaagcgggatttgacgccactttggccttgagcgaacggatgcgagtgctgcgcgttcccgccggcgcggtattcggcatcaacggttcaaccggctgcatcgtgcccgcatccaacaatcatggcagcactcccgtgaaagtgtcgatcgtgggaggcgaacttggcgtgagcctcgtgcaagccgacagcgaagacatcgcttcgatctccaatgtggaaatcggcagcggacttaacaatctcacctgcgagtaggcgattatgcgattacgatcggtgctttccgaagcgttgcgcaatattggcgcgggagtgagtcatgcgctgcttatgtttgcagcggtattgttcgcgtctacattgctcggcggatatgaggccgccaatgtggtggggctcgaaaccgaggcggtgcaacgcatcaacgcctatgccgacgttggcgccatcgttgggggaacggtggacggagccgcatgtgacaggctcgccgacgctggcggcggtgtgatgggcaccttggccggtgcgatgcgtgccggtcaacagattgtgccgcttgccacgcccggcaaggatatatcgtcgtatgaagtgacgcccggcatgatcaggatgatcgccgggagcgcgaagtccgatgtgtccggcgtgtgggtatctaccgacgtggccaaggattttggtctcaccaaaggcagcgtaatgcagaccgaacagggaacgatgagcgtcgcaggcgtgttttattggccgaacgatggtcgtgacacgcgattcgcctacgctctccttgtgcccgtatctgcgtcgaatggcacgttcgacgaatgttgggtcagacagtggccgcaaagcgggcagacggaggatgtgttgttttccacgctggttgcgtcgggttcgtcatccaatgccggcgtgacgcaggtgaataagagtttcgattcgcattacgatgcgcaagcttcgtacgggcagcgtatgactcgttggatgccgtggctgggattggctgtggggctgatgttcggcgcgttcggcgtgcgtcgtcgtagattggaatatgctggcgcattgcattcagggcagtccaaaggtgcgcaattgctggaaatcgctgtggaaacgttgatttggagcggcttggcgtgtgcctcttcggccgcgctgttgggtgcgtattgcgttcgcatgagcatcgccgattcaatgaccgtatggttgggtgcgatgcgcgcgccatgtgcgatattcgctggagtgatggtatcaagcgtgctcgtcggtatgacgatacatgaaacgcagttgttccgtttcttcaagcaacgctagacaccgctaaccatggttcgattgaggatgatttcattaggttctattgccgtcgatactggaaaaccgcaagtatcgacggcaatggaatgcgaaagatgatgatgcgttagctcaacgctttcttgatgcgctgcaggctgatcggcttcggcgtgccgagttcctgcgcccacaatgatacgtagaattcctcaagcatccaacgtgcggtgaccgcctgcttcatcaacgcctcatgacgcggacctgcaggctcacgttcggccttcgccatggccttgtcggccaactgcttggcctcatcagcctcccaagcccaacgcacatcacgattcttgtcgttcttcgccttacctaaacgaagcacgtcagcatgcagataccgttcaatcggcgccaacgcatccggaggagtcttaccaatgaatcccggatacaccagcgtggcgatatgctcacgaatcgactgcaaaacgctcaacatcggcagatcggccttgcctgacacggctttatcaacctccgcataccgcttcaaaatagcgatcacatcatgcgcaaccgcatacacggtatcttcgaacacttcacgtacatcaagcaccgcattcgccaacgcctcatcatccggcaattcgtcaacattcggcagcaaacgcttcaccgcagccaactgcagatcctcagtaagatccttcgtggactgatatggtgcggacgccaacatcaacgcctccgcacccaaccaacgcgacgaaatacgctcgctcggcatacgcaaaacatcaagtgcaccgcgccacagcatggtggaacgagcttcggtagtggcaccagccttatgcagcagattggcctgctccacaagcttgccctgatttccagcgttttccgcctgcttcttcaccatctgccgtgcggaagcctcggcttgctccgcaaacttgcgctgcaactccaccaacgatttgcccgagccaagcaccttgacagggccccgcgcatgacgcctgccatgctgactcttgcgactcggaggcaactgctgctccacagagaacgtcacgcgcaaatacggcatgagcttgctccacaattcaccagtcaacacttcagggtgaatctgcgcgccaacaatgctgattgccgcctgcgtgaacgtatgaggcaaatccggccacgcggccacaccctccgcattggtaggagcaagattcggcttctgctggttaccggaaccaggcagatccggatacctctcatcaatccacgcacgaatcttacgagccgtatcaggagcgggaacaaactgcacgcgcaacgtcttcggcaacgacttgatcatgccgacaatcaactcatccaacaatccgggaacattccacgtgaactgttccggtgtcaaacgagacaacaccttcaacggcacatgcacggtcacgccatcgtttggatcatgcggatcatacacataactcaaccgcaaatcgataggggagccgtccgtacccaacgtatgccaatgatccggataatcagccaacgacactgactcggcatcagcaagacgctccaccttctccggatcaaaatccaacaaatccggctgctcatcatgctttgacttccaccatttcgcaagatccgcaaccgacgtgacagtattgggaatcaccgaattataaaaatcgaacagatcctcatcactgaccgcctgcgccatctgacgtgtgcgactcgcatcgtcggcggcatcctccaacacatcgcgattcttcgcaatgaaatcgtcatacgagaaccgctgctgaatatcaccctcgaccaaaccctgacgaatcagaaaatcacgggcctccagcggattgatacgaccccactgcaccgtacgatcctgcactatcggcaaaccatacaacagtaccttcgcgctcgccaccgcggagccacgcgaaccagaccaatgcggatccgcatacgtggttcgcgtcaacgaacccgccaacggttcagcccaagcaggatcgatctgggcggaatatcgcgcccacaagcggctcgtttccaccaactccgtgctcatcacccattgcggtgtcgacttggcgaccgcggaagccgggaacaatgcgaaatgcgtgccacgcgcaccctgataatcattcttcgccatcttctgcgcacgcttcatggcacgcgcacgggcagcgcccttcaagccagcgaaatcagatgccttcggttcacgcacgatctgcatgcccatcatcgacaacaagcccgaaagcatcgacgtatggataccctgcgcatcccacgaacaacacaacgaatgcgcagcctgctgattcgacggaagctgacgaatctcaagcggcggacgcgaagccggaatcggatcgccaaccttgaacttgaattccttgcacatctcacgcaactgcgtgaccagatccttccactgacggatgcgcagccaactcaaatactcagtcttgcaaatcctacgaagcgcggaattgctcggctcgccatcagcttggaacacgcgatcccacaagttcaacgcggtcagaaaatcactggacggatcggcataccggttatgaatgcggtcggcctcctcacgattctcatccggacgttcgcggggatcctgcaaacttaggaacgcgaccaccaccagcactgcggccaacgtgttcggcgtggtcgacttcgcagcctcgatgatcatacggcccaaacgcacgtcgatcggaatgcgtgcaagcatgcgacctgtatgcgtcagcacaacctcgccatgcttgcgcgccacggccttcaactcggtcaactcattgaaaccatcagacaccgccttcatatcaggcggatcgataaagccgaaatccgtaacatcctgcgcggtacgagccacacccaccgacagcatatgcaatacgaccgcacccaacgacgtgcgcagaatctcaggctccgtgaattccgggcgcgtctcgaaatcctcgcgagaatacaagcgaatcgcaataccatctgcaatacggccgcaacgacccgaacgttggttcgcgctcgcctgactgatcggttcaatcggaagccgttgcactttcgcgctcttcgaataacgtgaaatacgagcggtgccagggtcgaccacataacgaatgcccggcaccgtcaatgacgtttcggccacattcgtagcgatcacaatacgctgatggtcatgcggctcaaacacgcgatgctgctccttggaggacaaccgcgcgaacaacggcacgatctcaatcgcatcaggacgacgcatatcaatggcacgcggaccataatgatggcgcagcgcattctcaaaatcatgaatgtcgcgctcgcccgaggcgaacacgagaatatcgcgcgggccacggtcatgactcgaatgaatcaccaactcggcacaggcgcgcgccaccgccgtcggcatgtcaacgttcggctcgcgggaatccttcgcgtcaggagcggccgacaacgtttcatagtcggcatcgcccggcatcgcgcccgtttcaaaaccgggtacggaacgcatcaacgccggagcggtgcccagcggctcatacacgacctgcacggggtaggttcgtcccgaaacctcgataaccggcactttcgtatgcaaagcgtgctcgaaatgctcctggaacttcaccgaatcaatcgtcgccgacgtgattaccaatttcaggtcacgtcgtttcggcaatagcgcagtcaaataaccgagcagaaagtcaatattgagactacgttcgtgcgcctcgtcgataacgatcgtatcgtattgcatcagtttcggatcgcgttgaatctgcgccaacagaataccgtcggtcaccacgcgaagacgggtcttcggtgagctctcatcggtgaaacgcacctgatagccgacctcgtcgcccaaacgcacgcccatctccgcggcgatacgttcggccacggtacgagcggccagcctacgcggctgcgtgtgcacaatctgcctgccatgcgatccacggcccaattccaacagaatcttcggcagctgcgtggtcttaccggaacccgtctgaccagacacaatcacgacttggctcgacttcaccgcctcggcaatatcgctacgtgcagcggaaaccggcagttgggaaggatattcgaatttcatgccttcataacctcgataacgcggaagcccttcgaactcgcgtacttacttacctcataaccatcgccaagctgcgtggcaagccacggaatcaacgaatccgaccccaaattcttctgcaccaccaaataggcggcaccacccgcattcaaacgtggtagccacgtcatcaacaactcatgcagcacatccttgccaacacgaatcggcggattcgaccaaatcagatcaaacgtcatatccgaagggatctcatcggcggtgaccgcatgaacgttcctcacaccattgagctcggcattgcgacgcgtcagatccaacgcgcgttcattcacgtccaacgcccaaatatcagccttcggcgaagcaaaaccaagtgtcaacgcaatcggaccccaaccgcaacccagatcaaggaacgtaccctcctcaggaggctccggagcctgacgaagcagcacggacgttcccaaatccacgcgattgccggaaaacacgccattggaaacctcaacatcggcctcattgcctcgcaacacaacatgcagcctcttacgtacatccttcgactgcggatcagccgcgaaatactgttcggcctgtgccatacccactccttgcaaacgctcgcctccggcatcacgcaagccacgctcatccacgtggcgaatgcccgatacccatgtctctagagaatgatgataataaagacaccatagtttaaccgtgagaggtgccattgagccaagaaaacgacatcgagcatagcatgagcgccaacgacgtgtcaggcgtgctcgccgaccagtccgaagtgctgcttgataccaacggcgagaaccatttcaacgaatcccatgacgaacaatggcaggaacgcgaatcccgcaatgcgttgaagcatgtgtccggactcggcgaaatgcaagacgtcaccgaagtcgaataccgaaaagtccgcctcgaacgcgttgtgctcgtcggcgtgtggtccagccgtgaaaccacacaggcacaggccgaagaatcattgagagaacttgccgcgcttgccgaaaccgccggcgccgtggtatgcgacggcctgctgcagcatcgtatcaagccggacgcagctacatacgttggctccggtaaagcccgcgaactcgccggaatcgtggcgcaagaggaagccgacaccatcgttgtggacgatgacctgccgccaagccaacgccgcgccttggaagacgccaccaaagtgaaggtcgtggatcgcactgccgtgatcctcgacattttcgcccaacatgcgacctcacgtgaaggcaaagcccaagtggaactggcacaactccagtacatgctgccacgactgcgaggctggggcggatcactgtcgcgacaggcaggtggccgcgccgcaggagacgcgggcatcggctcgcgaggacctggcgaaacgaaaatcgaaatggaccgccgtgtgatccgaagccgcatcgccaaactccgcaaacagatcgaacagatggctcccgcgcgtgacgtcaaacgtggcgctcgccgtcgtttcggattgccgaccgttgccgtggttggatatacgaacgcgggcaaatcgtcgttgacgaatcggttgaccggatcagcggaattggtggagaacgcgctattcgccacattggacaccgcagtgcgcagggcgcgtgccaaagatggacgtcaatatgcgtacgtcgataccgtcgggttcgtgcgtcgactgcctacgcagctgattgaagcgttcaaatccacgctggaggaggtttccgaagccgatctgatcgtgcatgtggtggacggctcgcatccggacccgttctcgcaaatcgacgcggtcgacgatgtgctttccgacatcgacggcgtcgaaaccattcccacgattatcgtgttcaacaaggccgaccgtatggatgaggccacacgcgagcgtatcgaggcgttgatgccggaagcgtacatcgtatcggcgttttccggcgaaggcgtcgacgagctgcgtatgcaggtggaatccatgctgccgacgccgaacgtgcatgtcgaggcgttgctgccatacactgccggttcgctggtgtcgcgcgtacgtgaatacggcaaagtgatcaacgtcgaataccgtgacgacggtatgatgctcgaagcggaagtggacgatcatttggctgcgcaaatcgtggaacagtcaatcggctgaaaaccttgcaaaacagtgcaacgcaacgaacacagcgtttgtgagcgctcacatcttttgtgatgcatatcacttttcattatttgcaagtcgtgttataacgccttgaaacgtcatgctgtgtggataaagtaaagatgaaattctaagagaaaacctgctaccagcgggacattctttcttataagagaggtaagcacatggtggattcaccaatcaagcccacaaagctcgctatcatcggtgccggtgcagtcggctccactctcgctttcgctgccgctcagcgtggcgtcgcacgtgagatcgtgctcgaagacattgccaaggaacgcgtcgaagccgaagtactcgacatgcagcacggctccagcttcttcccgaccgtgtccatcgcaggctccgatgatccggaaatctgccgcgacgccgacatgatcgtcatcaccgcaggtccgcgtcagaagccgggtcagtcccgtctcgaactggtcggtgccaccatcaacattctcaaggccatcattcctggcctcgtgaaggtcgctccgaacgccatctacatgctcatcaccaacccggttgatatcgcaacccatgttgcccagaagatctccggcctgccggcaaaccaggtcttcggctccggtaccaaccttgactccgcacgtctgcgcttcctgatcgcccagcagaccggcgtcaacgtcaagaacgtgcacgcctacattgctggcgaacacggcgactccgaagtgccgctgtgggcctccgccaccatcggtggcgtcccgatgtgcgactggaccccgctgccgggtcacgctccgctcgacgccgaagttcgtgagcagattcaccaggacgtcaagaacgccgcctacaagatcatcaacggcaagggcgcaaccaactacgccatcggcatgtccggcgttgacatcatcgaagccgtcatgcgcgactccaaccgcatcctgccggtgagctccatgctccacgacttccacggcatctccgacgtctgcatgtccgtgccgaccctcctcaaccgttccggcgtcaacaccgccatcaacaccccggtgtccgaccgcgagcttgcagcccttacgcgttccgcagagacgctgaaggaaaccgctgcccagttcggcttctgataaaaacgcggtaacggagtgctagctgcgttacacggaattcgacgtacctctgtacgccttcattccgtgcgccttgctgtcacatgcgttaccgcgttttttattgttttctggcggtaacggagtgccagctgcgttaccgctttttggttgcttgggtattgacaggcgattgatcagtcgttagactgcaaaaagaaataaaggaaaccccggcctatggctggggtttcttgcgttttgagagcaatgaaaatggtattgagaaacaatttcaataagtttcttaatcgggctgaaagattaagcatatggcacatgaccacgcgcacggatcgatagcgaacacaggagcggaacatcaaaaacggctcatgatgtcgctcggtctcacctcgacggtattcatagcggaagtcatcagcgcggtcatcacagaatcgttggcgctgctcgttgatgccggacacatgctcaccgacatgtccgtactcatcgcatcaaccgtcaccgcaatactgatgcaacgcaagcccagcaacaaacgcacctggggctgggcaaggctcgaagtgctaacagcggcagtcggagccctcatcctcctcatcgtaggtatctatgcgcttgtggaagccggcatgagacttttcggcggatctgccgacgaagtaaacgacgtgcgattgctgctcttcatgggcatactcggcctcgcggccaatatcggatcaatctttatcctcgcatcgcaaagcgaagacaacatgaacatgaaagcggcattccttgaagtcatgaatgacgctttagggtccgttgccgtaatcgtatcggcaagcgtgctcatctgcaccggctgggccggattcgacgctgtggcaggtggcatcatcgcactcatgatgatcccgcgagccatcaaactgttgcgcaacgcggttcgcgtgcttctcgaagaaacccccaacggtcttgatctcgatgaagtgcgttcccacttggaacaagtgccgcatgttgtggcggtacacgacatccacgcgagcatcgtatccacaggcatgccgatcttcatggcgcatgttgtggtcgaacaaggactcaccatgaaagaagcggcggaaatactcgcacaactacaagattgcctgcgcgaacatttccccgtatccgtacctcataccaccttccaactcgaaccggaaggatacagttcgaccagcaaatccgaaatgcattcctaaacattcttaaatgaccggtgcgtttaccggaaaagaatcgcgcacacaaagatggagtctttgtttatggcttcatctttgtgggcgcgatttcaatggcgttgaatagtctaacgtcagattttgcggagcacggtgaccaccttgcccatgatctcagcatgcgtgccatcgataggggagtaggcgggattgtgcggaatgagccagacatggccatgatccttgcggaacgttttcaccgtggcttcatcgtcgagcagcgccgccacaatatctccattttccgcggtgttctgctcgcgtaccaccacaaaatcaccatcgcagatagccgcgtcaatcatggagtcgccatgcacttcaagcataaacagattgccggtgccagtgagacgttccggcagacgcatcacatcgtccacatgctgctcggcggtgatgggcacgcctgccgcgatgcgtcccaccaaggggacatcgcgggaagccatgatggatccgctggaatcagattggctcgggaatgggatgacctgcgctactttgccgggcgaaacctcgtcatcgtcgaaactcacgacttcgatggctctgcccttgttcgcgttcatgcgaatgaagcccttgtcgtcaagcacttgcaactggtgtttgacggatgacggacttttaagccctgcggcttcgccgatttcgcggaatgagggagcgaacccctgctcgacgagatgttttttgatggcgccaagcaccttgcgctgacggtcggtcagcgtgctttcatccggacgctcggcatcctttttgggcgtgaatgggacggtgctcacggtgggctcctttcaggtcttaggcaagcataacgcgaaacgccgagaaaatcaaacatctgttcgaggtgtgtctgcaattatcgaacatttgtgccatactcagaacatgcgttcgatagaacagctgttcgagaaggagtggcgtgatggatcgtgtgccgaaggctcatggcgttgatttcaaagtctgggcggatcgactggccgtaatcatgatgctgatggtgctcgcatggtgtttggctggattgatgatgcctgcacgcgcgcagtcagatcccggagcgacgccggtggtggtatataccgtccagccgggcgatacgttgtgggggtacgctgcgcgtattacgcctgatggtggcaatgttgcggatactgtggacgagctggtacgactgaataatctggattcagtatcgcttcgggccggtcaaagacttatcgttcccgacgaggtatgaacccgcgcaagattggcctagttcaatggttcaggctattcttgacaccatgcattgccctttttgtcagaatccagataccaaggtggtcgatacccgcatcagcgatgacggccattccatccgccgtaggcgtgaatgcccgaaatgctccaagcgtttcaccacgctagagaccactatgttgttggtggtgaagcgttccggcaacgttgagcagttcgataggaacaaggtgatttctggtgttcgcaaggcatgccagggccgtccgatcaaggaagacgatttgaaggctcttggccagcaggtcgaagaggatcttcgtgcccgaggactggctcaagtcaaatccgacgaggtcggcagggccattttgaaaccgttgcgtgatcttgatgaggtcgcgtatatgcgattcgccagtgtataccagaattttgagaatcttgaggatttccagaacgcgatcgacgagctgaaggccgatgcgctgaagtaggttcgaacggttgcgaacgcatatgataatgcgtttgttttggctgaaatggacttggtagcgcaaaactgggcgattacggcaaacggcattagggttcatgcattgtgggggttccagccaataagtgattggaacccccacaatgcattcgtatcgtagtggcgtttgccggattgggatcgtcagctgatcacacgcatacggatcgtgccttcgatggctgcgagttcgtccaaagccttctggctggggcgctgggccacatcggtgaccacatagccgatttcgccttcggtgcccagtgcctgtgccgcgatgttgatattctcttctccgagcacacggttcaccttggcaagtacgccaggcaaattcgcgtgaagatgcgcgatgcggaagttcgaacgaatatcagacagtgtgatctgcggaagattcacggacaacatggtggatcccctgaaccaataatcctcaagacgctgtgagacgaactgtccgatggacttctgggcttcaagcgtagacccgccaatatgcggggtcagaatcatattgtcttcatccgcaaggctcgtcaaaaactcgtcgccgctcttcttcggctcgacagggaacacatccactgcggcgcccgaaatgtggccggagtccaaatgcttcttcagagcgtccaaatcagccacaaaaccgcgggaaagattgatgaagatcgaatcctgcttcatatgcgcgaactggtcctcaccgaagaaaccggtattggacttgcggccatcgacatgcagtgtgaccacatcggactgttcgagcagttcgttcagcgtggagcaacgatgggcattgcccatggcaagcttctcttcaatgtcgtagaacaccacgcgcatgccaagtgcctcggcgatgacggaaagctgagatccgatattgccgtagccgatgatgccgagcgtcttgcctcgcacttcatgagagccggaagcagacttgtcccacataccgtgcttcatatgatgggtatgcgcaggaatgcggcgcatcaggcaaatgatgtcgccgataaccagttccaccacggagcgagtgttggaatatggggcattgaacacggcgacgccgtgcttgcccgcatagtcgagatcgacctgattggtgccgatgcagaagcagccgacggccgtgagcgtcggacgtgcgtcgatgactttgctggtcacgctggttttggagcgaatgcccagcagatcaacgtcttccaaggcgtcgatgagttcatcttcgttgagggcgcccctgaggcactcgacttcgaagccgtggtcacgcagtgactgtgccgcgtcaggatgaatattttcaagtaacaatgctttaggcatggttcctaccttatagcttgagcagtttttcgtctgcatttgtccggactataagcagacgttgtgtcggtctggtcatggcgacgtataaatcggctgcggccacaatgcgtgagggggcattctcctcgatgcttcccggctgcaccaccatcactgcgtcgtattccaagcctttcaccatttgcgtggaacaaacggtgacctgttcatcccaagagctctgcgcatcgagacggtcgaactccttcgccgtcaatgtttcgcgaagctgttcgtacacccgcctgcgcaacggcttgaccatatcgtcaggtgcgatgatggccacgcgtccggtgccatcggaggagacgaatgcgcggaccagatcgacggtctgctgtgccacggcatcggcaatcagactgtcgtcggccagagtgaggcgcttgaccgaatccggcacgccacgcaccgcattgacggtggagatgtacaatccctccgttgccgcgaaatcacaggcgagctgcgacacttccttcggattgcggtaattaatcgtcaattcgttgagttgccaattgtggggtccgaacaacggatccatcatacgccgccacgaacgggtgccgcccaatgcggaggtttgcgcaacatcgcccacaatggtgaacgaacgcgacgggcaacggcggatgagcatgcgccaatccatggcggtgagttcctgagcttcatcgacaacgatatgcccatatgtccattcacggtctgcggcggcgcgctgcgcggtgagttccgcgtccatcccgttgatattgtcgaccaacatctgcgaagtgacgatgccggagccgatgccagcttgagccagcgtatcttgcgcgaactgctcctcctcggcgcgcttggcgtccaacgccttttggcgggcgaccgctttggggtcggggccaagcagttccatggcttcatccagcagcggaatatcgctgacggtaaacggcgaccctttggggcgaaccaatgcttcgatatcgcgttcctcaagccatggtgcgaagcgacgaagctgctgcggcttgcagaacagttggtcgataagccattcgccggtcatcggcaaccatgcgagattcaacgtcttgcgcaaggtgtcattcatgcgcaactgctgcatcacatccgtcaactccgcctgctccggctcgtaatcaagcttgtccacataacggttgcgcatggcgatcaacatgctatgcacgaaagtttcgcgtgctttgttgtgctgctgtcgcgtgcgcttggcatcggtgatggcctgttcgatatccgcgcgcacgatgggcactgcgaatccgttgatgcggatcgacggcaatgatgcggggacgcgttctcgtgcggcaacggcattggcgatggctttggacatacgacgttcgcccttcaatttcgcggcgaacgggttgtcatgcgccgtcgcgatcacgccggggatcagatcggcgatggttcggctgaccactccggtctcgccgagggaggggagcacctgatcgatgtaatgcaggaaggttgagctcggtccgaccacgagcacaccggagcgttcgagcattcgccgatgcgtgtagagcagatatgccgcacggtgcagcgccacggcggttttgccggtacccggtccaccctgcaccaccacggcctggttgaggtcggcgcgaataatgcgatcctgctcggcttggatggttgccacgatatcggtcatcttgccggtgcgcttggcgttcaacgatgcgagcagcgcgccttcgccggtcagagtgccgtccgaagacgcctgcccgacctggtcggagtgcacatcgagcacctcgtcttcaacgccgaccacttcacggaagctgagtgtgatatggcggcgcattacgatatcgccatgattggaaggcgtcgcttcgtagaacggacgtgccgcgtcggctcgccaatcggtgaggatcggctcgtggttttcgttggacagtccgatacgcccgatgtatctgtgcgcaccgtggacatcgtcgagtctgccgaacaccaggcgatcttcgacggcacgcagctgggtgaggcgatcctcgtacatggtggcgaaggaatcgcgttcggtgcgttgcgtgggcgatccgtgcgagccggcagcacgcacggtgtcgagacgggcacgagcttgggcccgcagatcatccaagcggccgtacgcgcggctgacggcctgttgttcttcacgcaactgggcggaataactcgacatctgcaatcccttcctcacaaaacttaggcactccaatgtaccccgaggcttctacgaaaaccgacgagggcgagtgcgacatagcgaagcaaggatgaatttacggtagttgatttgatgccattcgttcaatgtggggaaaatcaacctcagcatttgctgattttttccatttatgtggggatttatggtgatgcgtggggtaaagtggggaaagagttttgggtctaggtgttcccgcgcatcatgtaaggaggtgtggcgatggttcaaagcgttgaaaccgagcccttctccgacgatggttcgacgcaagcgagcggtgtgatggctggactgcctccgctgctgttgggaacatacactccaaaaatcgacgccaaaggacgtatggcattgcctgcaaaatttcgcagccagctgggaccgggcatggtgatggcccgtggtcaggagcgatgtgtctatctgttgccccaatcggaatttcgccggatcgcattgcagatccagcgcacatccatgggaaacaaggctgcacgtgattatttgcgtgtgttcctttccggcgcggttaatcaggagccagacaggcaaggacgtgtgctcgtgccgcagatgttgcgcgattacgcgaatttgggaagcgacatcgtggtgattggcgtggggacccgagcggagatttggaacaagcaggcatgggaggaatatctcgccgaacaggagcagggatattccgatattgccgatgacgtattaccggcggtggaattctgatgacagatgtaacgaccatacatcagccagtgttgctgcgcgactgcgtggatctggtggtcccggcgttggcgaggccagggtcgattgcggtggattgcacgcttggtttggcggggcattccacggcttttctcaaagcgagtccgcaagcgcgtctgatcggcatcgatcgagacacggaggcgctttcgctcgccacgcagcgaatgcggatggaaggtcttgccgaccgcttcatacccgtgcacgccgcattcgacgatttcgcgcaagtgcttgatgatcaggggatcgaccaggtaaacgccgtgttcatggatttgggattgtcgagtttgcagattgacgagacggagcggggattctcctattctcacgatgcgcctttggacatgcgtatggacgtgacccagccattgaccgccgaacagatacttgctgaatattcgttcgctgatctggtacgcattttccgtacatatggtgaggaacgcttctccaagcagatagcccgcgaaatcgtgcgtaggcgtgagatcgaaccattgaccacatcggggcagctcaaccgattggtggatgaggttgtgccgcaagcgcaccgtcctgcgggaaatcccgcgaaacgtgtgttccaggcattacgtattgaagtcaacggcgagctcgacaaattggcggggacgctaccgcagatcgccaaccatcttgcggtgggaggacgtttggtggtggagtcgtaccattcgctggaagacaagaccgtcaaaacatttatgaatcaaggtctgaaagctgacgtgcccgcagatatgccggtaatacccccggatatgatgccgttcttcaaagaactgacgcgaggcgccatcaaagcggccgaggaagaaatcgccatgaatccaaggtcggcctctgtgcgactgcgcgcagtggaactgaccagaccaattcctgaacgctggcgaaaacgattcgaccaaggcaatgattacgcaagcatgaaacgacaaggaaggaggggctgaacgtggccgcaccaagaacgatcgcatcaaacgcggctcccgcaggacgccgggaccaaaccgaaaccgctggcaccactcgccctgaattgcacgtcgtcaaaggaacgcgggccgaaggcaacagcgtcaagcgaggattcgaacagctcatcacatggacgcgcaccagaagcactccattgttgcatctggttatcgccgtggtgttcctcggcggatgtcttctgggatccttaacgctgcgtacccaaatggtgcagcattccttcgaggcgaaccagattgagtcgaacattacccgcctgacccaagacgtggaagatgaccaggccaagcttgacgaacttgaagcctcgctgccgagcaaggccgaggaaatgggcatggtgccccaaaaaggcgctctaacgattgatctgaacggctaccagccaagcggagacgacgctcagtgaatccttttcaccgcacttacgcacgtttccacaagaaactgcttacgaaaaccatggccatcggcgtcattctggcgttgatgggcacggcttgccttattcaattggccaacatccagttgatcaatggcaaaaccatggcgcaggccgcggcgcaaagccgcacgattaccgtgactttgaaggcacggcgcggcaaaatcatggacacgaacggctcgattctcgcgcaaagcgtggagcgctacaccatcatcggcaaccccgaggaagcacaggccttcactcccacaacctgcaccaaacagaccggagacaactgccatcagatcgatggcaagccggtaggtgctaccggagctgcggcggtagctagactcctcgctccggtactgggcatggatgctaccgaattgggtgccatgctctcgggaacaggccaatacgcggtgctgaagaaagacgtgacgccggcggttaaacgcaaaatctccaagctcaatttgggcggtatcgtctatgcggaactcagcaacgaacgcatctattccaacggaactctgatgggagcgttgctgggaggcgtcgatggcgaaggcaaaggcgttgccggtatcgaacaaatggaaaacaagacgctgaccggcgaagacggataccaggtctaccaacaaggcaacaacggcgtcgaaatcccaggaaccatgaccgaatcaaaagatgcggtcaacggatccgacgtcaccctgaccatcgatcacgacgtgcagtggtatgtcgaaaaagtactgagagaaagctgtgagaaatacagttcgccatggggaatcgctgtggtacaggacactcaaacaggggatattctcgcgctcgccgacagtgacgagatcgaagccggcagcgatcaggcgaagatgacggtttccagggccgtcagcgaaacgtttgagcccggttccattggcaaggtcttcacaatgtcgggcatgatccagcttggattgcatcaggcgtcagacaaattcaccgtgccggaccatatcacggtgaacgggcagacctacagcgatgcgaccacccacggtgccgaacgctggacccttgctggcattctcgagcaatcgtcgaacgttggcatgatcatcgcaggggagaagatgtctaacgagcagcgatacgatttcatcagaaaattcggtatcggccaagacaataggctcggacttcctggcgaatcggatggtttgctatattcggccgatcaatgggatctgcgaacccagaacaccgtgttgtttggccaggcttacacgaccaatgcgcttcagctgacgaatgcggttgccgtgatcgccaataagggcgtcaagaagccgcagcgcatcatcaaaacgatcagcgatgccgagggacattccgaagagcaaaagcccaagggcgaggcgacgcgcgtgattgacgagcaggtggcctctcaggtgatgaacgccatggaatccgtgtctgaccattactcccagttcatcaaggtggatggttatcgtgtcgcagcaaagtccggtacggcggaagtcgctggtgccgatggcagactgtcgtcgattatcagcgattattcggcgattattcccgcagacaatcctcgctttgtcgtcacggtggtgctgaaggatccgcaaggcgtttttggtggtctgacggcaggtccggttaccgcggagattggtgaattccttatgcagaagtatgaagtgccggcgtcaagtccgcgaactgatgctattccagtaacgtggtgagtatgcaagcatgaagaacggaggggcggaaagatgagcgcggtcagtgagtccatgaacagacgaatgacattgggtctgcttgccagcagatatggctttgacttggatcctacgtttgccactgaagtgacgatcacgtccattgcggacgatatcgattcggtgcggccgggatcgttgttcatgccgtccgcaccggtggatgagcaacagttgcgtcaggctcagacgcttggcgcatatggtgcggtggtgcctcatgcgttgcgtggtaagacggaaggtatacagattcctgtgatctatgccgagccgaccgcacagcagttgggtaggcttgccagcgaaatggcgggtagcccgtccgattcgttggcggtgttcgccgtggcgggaaacgatgcgcaggcggtggaccagggagtgagggatcttgctgatttcctgcatatgcttggtaatccggttggtgtgatcagctcgggcaattcgcaatcgttggaacgatatctcgatctggactatccattatcgattcttgacgtgcagcgtacgatggctgtgtgcgctgaagacggtgctgctgctgtgattctcgctttgagcgatgagacgttgaaagacgacgcattgcagtcggtaagtgtcgatgtgcttggttgcgatgacaatggtctaggcgaagccgagatcgtcaaatcggttgcgcgatttggatgcgctgtcggaaagcgaactcatatcgccgtccgtacgcaggaatccgatgtactcgcatcgcaagcggcagcggcgtacgggcagacgaacagcagcgcattgtcgctgtccatatcgatggtgcttgcggcgggtgtacgcaaggccaatatcaaaagcgcgttgcgcgtatctcgagatctgaactagtttcaatcggaacggatacgtaaagcacacacgataatcgcaaacaacgtgaacagtaaacggaacagcaacacagaggagaaaacacagtgagcagcctgaccatgatgccaatgagcttggaggagatcgcccaggcggttcagggacggctgattgccggaactgcggcagtgaatgtgccggtggccaccagcgcattcaccgattcacggcagatcgttgaaggttcggttttcgtagcgattgccggagagcgtgtggacggtcacgattacgtgccgcacgtgggcgctcaaggtgccgttgccgcaatagtcgaccatgagatcgccgacgccggtgtgcctcagattgtggtggaggatacggtgctggccttgggggcgttggccaagcacaatatcgagcgccgtcgcgcgctggggactccgtttacggtggtcggcatcaccggttccgtcggcaagaccaccaccaaggatcttatgaaggcgttgctggcgcacataggaccgacgattgcgccggtcggatcgttcaacaatgaaatcggactgccgttgacttcgctcaaagtacatgcggaaactcgctttctggttgcggaaatgggtgccaatcatgttggggaaatcgcgaatttgacgtcgctggtgccgccggatattgcggtcgtgttgaaagtcggcgtcgcgcatctaggggaattcggctcgccggaacgcatcgcacaagccaaatcggaaatcatccgtggtcttgttccaggtggtctttccgtactgaacgcgaatgacgagcatgtggctgcgatgagcgccatcgctccgggcgacgtgatgtggttcggacttccgcagaacaatgacggcaagccggcaatcagcgcgcaacatgtgcattgcgacgaattggaccatccgagcttcattttggacaatggtgatggcgagcatgccgaggtcactctgggcatttgcggtcagcataacgttatgaatgcgttggcggctgcttcggtagcgatgcatttgggtatgtcgatggatgaggtcgcgtccgcgttgtctgacgtcacggccatcagtcctcatcgtatggctgtttccacggtgcacaagcctgaaacatcgttcaccttgatcgacgattcgtttaatgccaatcccgattccatgaaggcggggcttgacggattgttgcgttggaaggcgggtgctgagacccaaccgttccgtattgcggtgttgggtgccatgcttgagcttggtccggatgaaaaggatttgcatgctggcatcggccggtatgcggtggaaggcgacgttgacgcgttgctgacggtcggcagcacatccgatgcctctttggacgctctggccggtgccatggctgaaggtgcatccgctgcgggatgtgcttcccatattgattgggtgcacgacattgacgaggccgatcgtctggtgacgcaactcgccgtggaacatccgggcgctgtggtgctgcttaagggctcccacgcttccggcttgagcgctttggccgaacgttggcaggccctggctgcacaatagaacaagaatatttggcaagattcgaataatcgaataaacgacgttatctgaagaatgtctgactgaaacggagaacatcaggtgatttcgctcatcatcggaattgtggtgtcgctggttgtgacgatcgtgggcaccccgctgctgattcgtttggtgcacaagctgaattatgggcaatacatacgtcaggatggtccgaaatcccatctagtcaagcgtggcacgcctacgttgggtggcgtggtcatcaatttggcggttgtgttgggctggggctcgtcggcgctgtaccgcttcgtcacgcggggtgagactccgtcgtggtctgcggtgctggtgctgtttgccatgttgtcgatgggattgcttggttttattgatgatttcgcgaaggttcgtaagaagcagagcgagggattgacggttaagggcaagttcatcggtcagttcattctggctaccatatatgcggtgctggcgttgattctgcctacgaattccggtttccccagtgcccaggccggcatgagcttcattgaggagccgttcttcagtttcgaattcgcgggtaaggtcgtggctatcgtgctgttcgtgatttgggtgaacttcctgatgaccgcgtggaccaatgccatcaatctgactgatggtcttgacggtttggcagctggctcttcgatgattgcgttcatgggatatgcggtgatcgctttttgggagttctaccaccttaagggatcggggcatgagggctttacctacgcggtatctgatccacttgatctgaccattatcgcggcttgcgcggcggtagcatgcttcgggttcctgtggtacaactccaatccggcttcaattttcatgggagataccggttcgttggcgcttggcggcctgttcgctgccatgtccatcgccacgcatacggaattcctcgcgattattctcggcggcctgttcgtcatggaaacgttgagcgatgtcattcaggtcggctatttcaagatgacgcataagcgtgtgttcaagatggctccgatccaccatcatttcgaattgaagggatggcccgaagtcaaggttgtgattcgcttctggatgattgaactgctgttcgtgctggtcgccttggtgcttttctatggcgattgggttgcccgttccggcttgtgacagtcgatgctcggtctgttgccgttgcgaatgaacgcaatatgactgtgatattaaggcgtatgaggttctgacgatcgaaggatgatggatatggatatgagcggtaagaccgcgattgtggcgggtcttggagtttctggccagagcatgatggaggtgttgggttcccgcgccgaaaaggtgttgggcgtggatgagaagaagcctgatgccgatctgcactctttcgaccacattgattgggatcatgtcgacttggtgatgacttctccggtattcaatccgaggaccccgttcattctcgaagcgcaacgtcgtggcattccggtgatgagcgaggtcgagcttgcctggcagctgcgggtggattgcgatgccactgggcatcctgcgcaatggattggcatcaccggtaccaatggcaagacctccactacggaaatgacttcggagatgttgacggcttgcggtttgaccgcacctgctgtcggcaatatcggcaaagcggtgtcccatgccgcagtcgatccggcaaatgatgtgctgtgtgttgagctcagttctttccaattgcatttcaccgattctcttgagttggattgcgcggcgatcaccaatatcgctgacgaccatcttgattggcatggcggtatcgacaattacgcgtccgataaagcgaaggtcttccaccatgccaagaaggcgttggtgtacaacgcggatgatgagcgcgtgaccaagctggcattcgcagccgaaaccgcggaaggctgccgtagggttggattcacattgtcggaaccgcaagatggccagattggcgtgaaggacggctggatcgtcgacatgtccggcatcgcgggcggtgaggcgggcaagcctgaacaggttgccaaagttgccgagttcacacatctgaccgagccggatggcacggtatatccgcatttgctcgccgacgcattgaccgcattggcgttggtgttgggacttggcgcggataaggagaaggcgatcgcatccctgaagcagttcactccaggtggccaccgtatccagaccgtcgccaccgccactacggcggatgggggagccattcgtttcgttgacgactccaaggcgaccaacgcgcatgcggccaaggcctcgctcaatagttttgccgataaatccgtggtgtggattgccggaggactggccaaaggcagcagtttcgagcaattggtggctgatcaggcgcataccatcaaagccgcggtcatcatcggcagggatcagcagccgatgctggatgcgttcaagacgagcgctcccaacattcctctgaccatcatcgatccggcggataatggggtcattatggaacgggcggttgatgccgcgggcgagtatgtccaatccggtgatgtggtgctgatggcgcctgcatgtgcgtcgatggatcagttcaagtcgtatgccgatcgtggaaaccagttcgcacagcaggctcagcgttgggtgaacgagcatggaaaagcctaaaaccaggcaggttgatagtagtcgtcagaaaaagaaggccgccgtcggaaagcaggtcgacgattttcatggttatatcggtctgcgaagcctgcttaatccgatttggtgttttcatgggttcagaaccgcggtgatcattctcaccattttcggtgtgatcatggtgttttccagctcttcggtaaacatgattgccaacggacagtctccgtggtcccaagcactgaaacaggggggattctgcgttcttggacttatcgtgggtgttgcctgcatgatgattccggcggagctcatcaggaaattcagtttcgtcttcctgattatcgctttgcttttgcagtcgctgacgtttacccccttgggtatcgatgtccaaggcaacaaaggttggatcggcctttttggatttaccttccagcccgccgaagtcgttaagcttgcgttgtgcatatggctgccgcgggaactgatctacgcgcagaagcagataaacaaagtcggaccatataaggcatatctcaagttgattgcgtggcttggtcttgcattgctgttggttgtgagtggcaaggatcttggcacggccatgattctgttcgcgatcgcaggtgccgcgttgctgttgggagattttcctggcaaatggttggctatcgtggcatgcggcggtgcggttttggttggcggactcgttatcaccagtccgaaccgactcagccgtatcatggccacataccaaacttgctccgcatccgacatgcagggggtctgctatcaggcggtgcatggcaaatacgccatggcctccggaggtttgcttggagtgggcatcggcaattccggagaaaaatggggatatctgccggaagcgcacaacgatttcattttcgccatcatcggtgaggaaacgggctttgtaggcgcctctctcgtcattctgctgttcttggtgcttggatggtgcatgctcgtggtggctttgcaatcgcaggacaggtacatcactttggtattggccagcattaccgtgtggatcgtcggccaggcattcgtgaacatcggcgttgtggtgggattgtttccggtgatgggtgtgccattgccgtttgtgtctgcgggcggttcgtcgttgattctgtgtttgggcgctgcaggcgtaaccatcagcatgatgaagcagcagccgcagatccaagcggagatgcagcgggtctgagtgtcggctgcgaccgcagcatacgctaccgcgtattgcggtgtgcaaacgtagatgaaatgtgagcatccgcgtgtgcgacggtatggcgcgcggcgtactggggtgccgtgggctaagctcgtacactatgagcaatcagaagcatatcgttcttgccggcggtggtacggcaggtcatgtcaatcctctgctcgccgtggcgcatgtgattcgcgagcttgaaccagacgccgatatcgcagtggtgggcactgtcgtcggcttggaacacgatttggttccccaggccggtttcgaactggaaaccattgagaaggttcctttcccacgcaggcccaatatggcggcgctgaagtttcccgcgcagtggaaggccgaaacggccaaagtccgtgacattctcacccgtcatgaggcgcaggtggttgtcggcttcggcggatacacgtccgctcccgtatatgcggcagcgcacaagatgggcattccgatcgcgatgcatgagcagaatgcccgtgccggaatggccaacaaattgggagctcgctgggcgtccatgattggcaccgcctatgcgcaaaccggcttgaagccacgcaagggtgttgaagccgagcgtgtgggattgccattgcgtgccgaaatcgcagcgatagcccatggcatggaacatgaccgcattgccacaagacaatcggccgcagcgcaactcggtgtcgatccgaaccgtccactggtggtggtgactggagggtcgctgggcgcggtgaacgtgaaccgtgcggtggcggcttccgctagggagctgctggaacacgcccaggtgattcatctgactgggaaaggcaaagatgatgaagtgcgttcattggtgtcggtgagcgccggcgaacaggtgcttggcgagcttggcccggaccatggcaatgatggcgattatcgtgttgcgccgtatttggaacgtattgatctcgcattcgcttgcgccgacctgattatctgtcgctctggggccggcaccgtatcggaattgacggctttgggactccccgcgatttatgttccgctgccaatcggcaacggcgagcagcgattcaacgcccagcctgtcgtcgatgcggaaggcggtctgatggtggctgatcgcgaattcaccgccgaatgggtcaaacagcatgtgccgaagctgcttgccgattcggatctgcttgccaagtatggcgacaacgcctggcaatacggtattcgagatgccgccgaagtcatggccaagcgcgtgctttccatgattgacgaaaagtaggctgcggcgatggcaggtgcgttcgtcgcattccaaaatcccacccatgatcggccatatgcgagaccatgggtgagaccataatggaacaagctagaaaaaacatgcaagaggagcagtcgtgtctgacaaccagcgtgaagccggtaccatcgttcttgatccaacccatgcgtcgttcagtccgcaggaaggcgtgaatgatttgggggcaacccatttcatcggcattggaggcgcgggcatgagcgtgctcgctgaaatgctgcacgaacagggcgttgaagtggacggttcagatcgtgaacccagcgccaaaaccgatcgtctgcagggaatcggcattaccgtcgaattcgggcagcgcgcagaaaacgtcgaaggcaaacataccgtcgtattctccagcgccatcaaatccgacaatccggaaatcgtcgcagcatacgaagcaggcgaacgcatcgtgcaccgcagcgacattctcgcattgctgatgaacgcaaaacgtgcggtgacggtcgcaggagctcatggcaaaaccacgaccagttccatgctggcccatatcctcacccatgccggtgagggaaatctggccgatccaagctatgccatcggcggatccatccaaggcaaggatggtgtgacgcttgacggaggccatgctggtaagggcgacgttcttgtggcggaagcggacgaatccgatggcagctttgccaagtatcatccggaaatcgccattgtcaccaactccgaagccgatcatctcgaccattacggcacacaggaaaactatcgtgcggcttttgtcaatcatgttcagcatgccgaaaaatcggtggtgatgtgcggcgatgatgaaggcaatcttgcggtattgcgtgctctcgacccgcagacggccaagcgtacggtcgtgtatgcgacgcaggatacggtttcgttgggtgatttgaacggtgccgcgttcgtgcatatcgaatcggaaagcgaaagcgcgcaaagcggcgccgaacatttcaccttgcacatgcccgcgggattgttgggcgaacatgagcgtatggttccggtgacgcttaccgttccaggcattcacaacgcgcgcaatgcctccgctgcgattattgcggccgcgttgttgggcgtcgatgtcgagaacgctgcccaagccgccacgtcgttccttggagctgcccgtcgtttccaagtgcgtggtatggtcggccaagtgactgtcgttgatgattacgcgcatcatcctacggagatttcggcattgctggatgcggcgcgccgcaggtacccgcagtcggtgattcgcgtgatcttccagccgcacctgttctcccggaccatgttctttgcgagtgaattcgctgaagcattggccaaggcggatgatgtgatcgtcaccggcattttccccgcacgtgaaaagcaggaggactatccgacgattagctccgccaccattgtggacgaggcgcttaagcttgaccacacgcctgccgaggattggattcgcggagtggaggatatgcataccgcggcacagatgatgacgatgcgtgctcatcatggcgatgtcatcttcactgttggcgcaggcgacatcacacagatggacgaggtgatgctgcactcccttcaggctcatcgttgggattgtgagggctgatgacgcgaagggtcatcagttcgggtacgggttcggatggttccgcaacgacgcctgaaaatcagacgtcgcatggtagaaccatccaaagccggaaacacagcgatgccggaaagcaggttcagccgaaaggccgttccgtcgctggtggagcgggacgcgcgtcttcttccgggaagaagacgcaggaaaatacggttgagagtggcaacaaaggcagcgtgagccgttcgagatcaggcgatttcgtggacgcgcgcaatcttgccggcgaggatttcgtttcgaagacattggaggaaaccataggcacgttgggcgtggtaacgcgcccgaaggtggttgatttcagtgcgcgtctgaaagaacgacgcaaggcgaacgcgcgtgtcgtcgccatgcgcgcgtgcgtttccgctgctgtcattgttgttgcaggcgcgttggtatggctgtttttcttctcatcggtattccgtctcgagtccggcaatattagcgttgtcggcgccaacgaatgggtgagtgagtctcaggtgttggatattgcgggccagcaagcaggaaaatcgattcttctcgtgtcgaacaatgacgtggaaaagaaaatcaaggagattccgggagtcacttccgcgcaatccaagaaaaaactgcccgactcccttgaagtgaccatcaaggcgcaaaagcctgctgcgatgctcaagacaggcaaggacagcatgaccgcggtcgacagcaaggggcgtatattgaattccgtcagcggagcttccgtggaaggaattcccgtcattgaagtgaaggatgtcgaaacaagtctgagcaatcgttccatcaaggaggcgttgaagatcctcagctcattgccggaatcgatgcgcaactccatcaccaaggtgactgccgaaacccaggattccatcaccacggaaatcaatgggggagaccgtgtgatcgtatggggcgattcatccggcctcaagttgaagaaagctgtcgtcgataaaatcatcaatgatccgaatgtgatcggagacaagcataacgtcgacgtgtctgcgccgttgcgtccaatcatcaaatagtcgcgttgatatacgaagaaccccggttgccttgcggtaccggggttcttcgcgaataggaggagagaaggagaagttcgattattggaggccgtcaggcgttcggattggccttcaacgcaggagcgacggagaccgcgggatcgagacgcggaatcagcgtgcactgcgtggcatggtacaggtcggacttgcccggccagacggtaccgatgacctcgttgtctttgttcagctggtggaaccaagaaccgttcttatggtcgatcaggtattcgtcaatgtacttccagaaggtcgcataccaatccttgtacacctgcttgccggtgacggtggccagtgtggccgaggtgttcacggattcggcaagcgtccagtgcatgcggtcggtgacaacgggcttgccgttccaatcggtggtgtaagccaaaccgatggtgccttcggcgttccaggcgtcggcaagtgcctgagcgaacaggttctcggcggcttcgataagctgctgcttgccttcttcggaacgctgcttggagctcaacgcatactgggtgatgagacgtgcccactcgatgccatggcccggagtggcgccgtacggcttgaactggtcatccggcttgtcatggttgcattcgagatccggctgccaatcggcggtgaaatgctcaggaatacgccagttattgttggccgcccatccgaccacatgatcgatgatacgaccagcgcgctcgcggtattcctcgtttccggtcacatcggcaacggcaaggaatgcttcggtggtgtgcatattggcattgatgccgcgataggagtcaagctcggtgaattccgtgttccaagtatcgacggccagaccgatctcgtcatcccagaaatgcttgtcgtaggttgccagagcctcttcgagcagctcgtccgcgtccgggcggccgataagcttggcggaagtggcggcaagaatcacgaaagcgtgggcgtagcagaccttgcctgcttcatgggtggagccgtctgcggaaatggacggataccatccgccgttttcatcgtcatgcagcggaccgcgcaggccggcgatggccttgtcaaccagttctgcggcgcccggctcgccgtgcaggaaccccaaggaatacacgtgcgccatgcggcaggtgatccacgtgtggatgttttgggtcagatccggattgccggtatcgtccagccagtaggagccaccctgcggggcggggaaattgtgtccgaaatgcaggagctcgttggtttccgcctcgagcagggcatggttttcttcggagccgaacacgtaggcttcgggagagtaagtgcaggtcatcgatcaagtccttccttgacgtcgtctactgtgacgtgataactaggttgatgtattaactatgttaatcacttaagcggttaatgcaagtcgacacgcggaatttgatggtgggattctgatgatttgtgatgggggagagctggattcttcgtatgttgatttgacgaggttgtcttgtgaagaggagtacctaaaaacgtaccttgcatgctgtttagggtggtagacagatggaatttggaagagattaagcaagccggaggagggatttttgcccacatttttttagaacatccggcatatcgggggtaatttggagtaaacccaggaatcttcgaaaaccgttggaaatacaagaaaagccgccatttctggcggctttcaatccgtggagatgcggggaattgaaccccggtccgataaccgaaccctcagtcttctacgtgcgtagtctgctggccgtgcggcggtttttctgctcccatcgatatcgcagacaactgatggcgggcatatctacagtaaaagtcccttgccggccctgtggctcagtcgacaaagcaagtcttctaaacgacgctcagcatccttccaaagacgagaaggagtgaacggagcggctgctcactggttaatcctggcgcgaagctcaggcagcgagagcgaactcagtgcggttagatttagcacttattcttttgtagggggcatccacgagcggaccctacgttctcggcacgcttccctgcgacgaacaggtcaccgtcgaaaccgatcatccccaatcttgaattatcaagcacccggtgcaagaccggacttttcaagatatcatggaatgtcaataagtgcaaatcatctaccgtaattcttgcgctgtgagcgaagccaaagcttaaactgatagccactcacagcttgacgtgaataccgaaataatccatgaccaattcacagaacatcatattggcccagctgaaccacggacgggtataggagttcgggtcgttcgcgtcaaagctttcatgcatgagatgcgtgccggcgtcggcggcgacaagttgatcaagaatacgttctttttcggctttgtcgtggcttgtcaatccttgcatggccatggcgatcggccaaacataaccttctggcgtatgcggagaaccgatggcatgtgcatagtcaccctcgaaatagtaaggattctcctgactcagcaaagtattgcgcgtttcgagatacagcggatcgtccgcttcgcagaatccgagataaggtgccgacataagattcggcacattgctgtcatccataagcaacgcgttgccgagaccgtccacttcgtatgcgtagatagcgtttccggccgcattgcggatggttgcgtgatgggcaagaccatcatcgatggaatgctgcagcgccgcggcacgaccggcgatttcacgatcgtcaagcacgtcgatgaaaatcctttgcacatatcccatgaccacgctggcgaacatgttggacggcacgagatatgggtagacgcaggcgtcgtcgctggggcggaatccggaccatgtcatgccggtgacggcaaaaggtcctccggcaccatggttgggcacgctgtcgcgcggatcgtcgttcggacggaagaagcggtaatgcgaattcgaatggtcaagctcggtttcgaacacgtcaaggattcgacggatgccgcttacaaacgcatcatcgaaatggctggtggttcctgtattgcgatacaacagccacgccagctgaatggggtagcacagggagtccacctcgtatttgcgttcccacaaccatggttcgaacgaatcggtctgatcgttcggatcccaggtagcgccgctgggtgtttcgttgaacgcgtttgcgtatggatcgatattgatgaacctgaattgctgccgaacaagcccggtaataagcgcggtgagctcgggatcatctatggctacggcgagatatggtcggaattgcgctgaggagtcgcgcagccacatggcaggtatgtctcccgtcagcagaaacgtcgtgccgtcatcatgccgtctcacggtggtggtgagtgtattggcgaatcctgcgttgaagttttcggcccatcttgcgtgttcgccgccacacaagtcggtgatatgccgcatgaaatcggaaactgactgcggaatatcggattgtgaagcggcgtttgtggtgttgctggtgtcgttcatggcatcattcttcgttgaggtgcgtatatcgtgacaatcgtgattgcaccaattgcggattgaatatgggtatgaaaaacgaggccatgatggcagacatggcctcgttgatgatgatgatgaaaggaaaatctgggcttacttgccggcttcggcgagataatccgggacgccttccgcagggtaggttggccagccgccttccttggtgcacacgtaggcggcggtgttcacagccgcacgatgcgcttccttgagcggtgcgccgctcagcagcttgccggtgaaggaaccggagaaggagtcgcctgcaccaacggtatcggcaacctcgacgtgaggggtcagcagcgtggaaacctcgccattcttggcggtgatggtgctgaacgtggcgccgccggtcagaatgatgtactcaaggtcgaagcggtcgatgaaccacttgcatgcctcttcgtcgttgcactcaggaatggagaacatgtcgcgcatcatgatcagctcttcgtcgttgatcttgaagatgttcgcatagccgagcagttcttcgatgagttcgttggagtagaagttcgcacgcaggttgatgtcgaagaacttcagagcgccttccttggtgtgcttgagcagttcgacgatggtgtcgtgggattcgggggagcgcagacccaaggtgccgaagcagacggcgtcggccttggacacggcttcgacgagctcgtcggtgagcttgatgtggtcccaggccacgttttcgacgatggtgtattccggaatgccgttggtcagggccacgtcaaccgtgccggtcgggtattcgttggtctgcaccagcgtgttgatgccggccttgtgagcgtcggagagcagttcggtacccagctcgtcgttgccgacggcgctgatggcgaagcttttcgcgccgttctgggacgcatggtatgcgaaattgacgggtgcgccgccggcacgcttgccggtggggagcatatcccacaggatttcgccgagagaaatgacgattggcttggacatggtgttcctttctttggttgtggcgtgctatgcgacgtcaaagaacatcgaaggatgttccagaaaattggtgatggccacggccgcggcaccgctgacggtggcgtccgttgggaggttggacaaggtgattttggtatcgtgcccgacttcggggatggtacgttcccgaacgacttttttgacctcgtcaagcaagggctgtccggcttgggagatgatgtcgccgagtacgatatgcgtcggattgaaggcgttgatgatattgaccgcgccatatccgatatatcgagcgacctcggaagtcagatccatggccgctttgtctcctgccgcagctttggcgaacagcgcggtgcatgcctgcgcgtgcgtcattgcctcgcatccgggcacaatgctcggctgttcgttgagccgttcgtggattgcgttggctgagcagtaacgctccaggcacccgatattgccgcagtcgcaaggcttgccgttgacgtcaacggagatgtgtccgatttcggtggccgtgccgtgcgcgccgtaatagatcgaaccattgtcgatgatgccgaggccgatgccctcgccaagcagatagtaggcgagcgatccctcggacagttccgggttgaacaggaactgcgccaaggcgcctgcgcgtgcgtcctgttcaacgaatacgggtacgttgaacgcttcgctgaactccttgatgaagttgacctgccgccaaccctgcatggatgagacgagcgcggtgcgaccttcctccaccagatacggaccaggaacggccatgccgacggctacgatgctcgaatcgtccgcaatgagctgtcgtacggtggcccggatctgttctaccgtttcgggaatatgctcctcgtcaacggtgggcaggtcggtgagggaaatacgattgcatttcaggtcgaacactgcgatctgcaccagacttcgtgcgaatttcacgccgacgacatggtatttcgcgcaattgagattcaggccgatggaacgacgattcttatcgccttccatgtctccggtttcttcgataacgtctcggaacagtagttttgcggtaattttcgtaatggccgcgggtgtgagttcgatggctttggcgatttgcgcacgtgagctgatgccgttgtggtagaggtattgcagaattctggaacgattgttttctgaaatcgatgattgctgagcgctgtaactactcatgacacctccttgcgccagtgcacggacccttcgttgaactagttgatatattaacgccgttaattagttgatgcaagttccgtctttcggcgtgtcacgaggaccgtcgattctcaatatgggattcgctgtctcattatttgacacacacttttcggaaaaaaattaactgcaaaaccgttgtgattgctgagttttcgttggatcgagaaagggtgacgtcgcaaaatgagcttccgtgaaatgtttcgctaacaaagtgtgccctacccttgtggcacgtcgttttggagtaccaattacgacagcaggaagagaaaggattccatagtgaatcacaagaagattatggctgcggctgtctcgattgccgcactggcctcgctcgcggcatgcggcggcgtaaaggatagcggttccgcatcgggggatgcggatgtcattaccgtcggcaccacggacaaggttactagcgttgaccctgccggctcctatgacaacggttcctatgccgttcaaatcaacgtgttcccgttcctgtatgcgcaggactacaacacctctgaactgtctccggacatcgctgcggatgacggtacctggagtgacgacggcactgagttcaccgttaagatcaagtctggcctgaagttcgccaatggtcacgacctgacttcgtccgatatcaagttctccttcgaccgtgtcaacacgatcaacgatgagaatggtccgagttcgttgctggccaacatcgaatccatcgatacgccagatgacaccactgtggtgttccattccaaagtcaagaacgatgtgaccctcaagcaggtgctttccagcccggccggtccgattgtcgacgaagaggtcttctccgccgacaagctcactgatgctgacaccatcatcaaggagaaggctttcgccggtccgtacattctgacctcctacaaggccaatgaggttgcaggctactccaagaacgactcttatcagggtctgaccccggccaagaacagcactgttcaggtcaagtactttgccgattcttccaacctgaagatggccgtgcagcagggacaggtcgacgtggcctaccgttctctgactccgaccgacatcgatgatctgtccaaggactccaaggtcaaggtcgtcaagggtccgggcggtgaggaacgcttcctggtcttcaacttcaacatccagccgtacggcaccaagtccgatgaaccgaatgccgacaaggccaaggctgtgcgtcaggccgttgctaacctcatcgaccgcgaggagttggcgaccaaggtctataaggacacgtacaccccgatgtactcctacattccggacggtttagttggtcacgaagacaccttcaagactgcgtatggtgacggcaacggcaagccgagcgccgacaaggccaagaaggttcttgaggacgcaggcgtttccactccggttgagctcaagctgcagtacaatccggaccactatggatcctcttccgccgacgagtatgcggctctcaaggctcagctcgaggagggtggtctgttcaaggtcgacctgcagtccaccgaatggacccagtacaacaaagaccgtgttgttaccgaggactctgatggatcctacccggtctaccagctcggctggttcccggattactccgacccggataactatctgtctccgttcttccgtgacggcaacttcgtgaacaacgcttactccaactccgaaatcaacgatttgattatggagcaggctggtgaaaccgacgaaagcgcccgtgaggatctgctcaagaagattcagacccttgaaaccgaagacctgtccaccatcccgctgctgcagggtgcgcaggttgcagttaccggcgccaacgtgaagggtgttgtgctcgacgcttccttccgtttccgtttcgcatctgtcaccaaggcgtgatgtgtgcggatgtgcggcatgacctgccgcagcctgcatagaaaaccactggggatccccggtctatggccggaggtccccatttcccgaattatctgcctgaaacggcgcagtgattcgatattgttgtaaatcaaagccgtacaggcttcttatcaaggagcatcgcgtgtcagacacagcagctccggccgtctctcaggaggcgaagccgaaacaagccaaaaagaatcatttgtcaggcggatttttccgtttcgtcctgactcgattcctgctcattattccaaccgttttcattctcgtcaccgtcgtgttttttgtgatgcgagctacaggcgatcctatttctgcggcattgggtggtcgtcttacccctgacgagttgcaaaagcgtgttcatgcggccggctacgaccgtcctcttattgtgcaatatatcgattaccttgggggtttgctccatggggatctcggcactacgttgactgataatcagccggttatcagcattcttgttcattacggatcagcgactttcgagttggcgctcctatcgctcattgttgctttgatcgtaggtatcggcttaggtcgtgtagctgcgtgcagacgcgatcacgctgccgatgcaggcattcgaacctttgccattctgtgctacgccacccccgtgttcttcttgggattggtcctgaaactcattttcgccatctggctgaacgtgttgccggcatccggtcgatgctcgttgtcttcggaaatgcagttcacccgactcgtctctccgaccggcttctacattatcgatgcactgcagctgggtgatatgagcgtgctggccgacgtgttgcgtcacgccgtacttcctgcgctggcgttgggattgctcaccgcaggcgtgtttattcgtttggtgcgcaccaatgtgatttccacctacaattccggctatgtcgaggctgcgcgttcgcgtggcgtcgccgaaaaacgtctgctcagcaagcacgcatggaggccggcgcttattccaatcatcaccgttatgggcatgcagatcgcattgatgctcgccggcgcggtgcttaccgaaaccaccttcgaatggaagggactcggattcatgttgtcccaatatctgaaagcgcgtgacttcgtagctgtgcagggcattgtgattctgatcgccatcatcgtggccgtcgtcaacttcatcgttgacgttatcgccgcgttggtggatccgagagtgaggtactgacatgactgcatcagcaaataacgtcaccgtcccgggtgacactcgtctgaacgatctcaaagtcaacaggaaagctccgttctgggccaagattccgatcatcaaggagcttcgcgtagcggtcggctggcagaaaggcatgctgattaccggcctgttgctcacggcgttcttcctgctcgtggccttgttcgcgcccgtaattgcaccgtacggctatgcgcagctcaaagatgccaatggagtttcattcccggcccaggcagcaccctcatccgagcatatttggggtaccaccgcaggtggttatgacgtgttcagccgtgtgatttggggctctcgtaccgcggtcattgcgattgtgatcgctgtgctgctttctattttcgcgggtgtattgctcggtttggtttccggatatttcggtggttgggtggatcgtgtgcttgtcatgatcgccgacgccatctactctttcccctcgctgctgcttgcgattctgatggccattatgatttccggcggtcagtctggtctgtggagtggcattctcgcttcgggtatctccatcaccgtggtctatattccgcagtatttccgtaccattcgatccgaggtcattcgaatcaaggaatccgcttacgttgattccgctcgcgtggtgggcgcgtcgacatggcgcatcatgaccaagcaccttcttaagaactccaccagaacgttaccggttattctgacgttgaactcgtccgaagcgattctgactcttgcgggattgggcttcctcggattcggcatcgaacctaccgcagccgctgaatggggttacgatctgaatcgttccgtgtcggatgtaaccgcgggcatttggtggaccgcagtgttcccaggtatcgccatcgtattgattgttctgggtatcaccttggtgggcgaatccctcaatgaccttgccgacccgcgtctgcgtgcacgcaaatccgctggtgaggtggttggatccatcgaagatacttcggttgatcccagccagaagccgggcgttcgcaacgaggtgatagccgagctcgcggccgccaagaatccaatgggagccagcgatcagccagtgaccgttacggatcgcgacccgtcatttaccgcctccgaatggggctccaaggaagaagagtgacgcaatgagtgacgaacaaaccaatcttgcgcaagtcaaggatctgagcgtttccttcatgaccgacgcaggatccatcaaagccatcgacaagattagcttcaccatcccacgcaaaaccgtggtgggtgtggttggcgaatcaggttccggaaaatccgtgaccgcacgttcgattatcaagctgttgccggagacggcaaccacttccggcatgatttatctgtcgaaccgtgaaggcaatgagcagcttgacgtactgtctctttccggagaagatctgcgccgtatgcgaggatcagaagcggccatggtgttccaggaacctaattcggtacttaatccggtgtataccatcggatggcaaatcgaagagggacttcgcgctcacggcatgaaagacaagaaggagcttcgtgccaagtccgtggatatcctcaaaaaagtaggcattcctgatgccgaaactcgaattgactactatccgcatcagttctcgggcggccaaaaacaacgtatcgtcatcgccatggcgttggtgctcaatccaggtctgattctggctgacgaaccgactaccgcactcgacgtgaccgtgcaggcagaaattcttgacttgttgcgtcttgcccgcgacgaattcggcgcttccgtgctgattatcacccataatatgggtgtgatcgccgatatcgccgatgaagtggtggtcatgtatcgaggtcatgtggtcgagcagggaagcgtcgaacagatcttctactcgccgaaagacgattacaccaagcggttgctcgcggccgtgccgcgtatcgggcagaaactggtcgttcgtgatgagcagggcaaggtgattgaacgcagcaaggattggcatgaccaacccattgccgtcgaggccaggggactgactatcacctatcctgggcatttgacgcagcctgatttcaaggcggtcaatggtattgatttcactattcaccgttccgaagtgctgggattggtcggcgaatccggttccggcaaatccactaccggtcgtgccatcgctggtttgcagaaagtgtccggcggctccctgaacgtgttgggtgtggaaatgaacggtgtcaaggaacgtcaattcaaacccaagcgtgctgatattggttttgtgttccaagatccgggtagttcattcaatccgctgatgaccatcgcggagaatgtggcagaaccgctgatcgtgcataaaaagtactcgtctgtgtcggaagcgagcgactatgtgggagatctgctcgaaatggtgcagttgccgcgtgcatatatgaaccggttcccgcatgagctttccggcggtcagcgtcagcgtgcctccttggcacgagcgctggcgcttaagccgagcctgctgatcgccgacgagccgacttctgcattggatgtgtcggtacaggcgaaggtgttggagctgttcaagaaactgcaggcggaaataggtttcgcatgcttgttcatcacccatgatcttgccgtggtcgatatgctggccgatcgcattatggtgatgcataagggcgagattgtggaacatggtgatgccgatcaggttatgaataacccgcagaatccctacacgcagaagttgttggcatcgctgccggtgcctgatccgcgtgaacagcgaaaacatcgcgcccagctgcacgagttgctcgccaaaggaatttgattccgaagtgagtttcgtggcttcctgacatacacaagagctggtgtgacggttcatgatcgtcacaccagctcctagtttatatattcaattgtgactgtattcagcgaatcgcaccgttgaaggagaattgcgcgtgtgcgtcgccgttcgccttgttcttgaggtactcacgcacgtagcccatgcgttccactgtggtgtcggccaggggctgaggcaggtcatcaggggagaaccaacccacgttgaggctttcctcgtcacctacgaacggttcggcattaccattcggatcgggcttgcacacgaacaggtgatccatatacatggtgttgtcgccgttcgcatacgtaagcaccttgcgggaagacttcaccgacaccaaatcggtgacgataacatccacgccagtctcttccttgacctcacgcgccaccgtgtcggcaggttcctcgccaggctcattaatgccatacaccatggcccactcgccggtatcggaacgcctgccaagcagcacacgaccttgctcgtcttcaacatagccggagacgcccatcagccacaggagatcgtgaccgactttcttgcgtaactcgagaatgaattcaggcgttggcatatcaggcctttgcaccttcggcagccatgctggccatccactcttcgacctcatcgatctgctttggaatgccggcggaaatccattccggaccatcctcagtcatcagtacatcatcctcaacgcgaatgccgatgccgcgatactccggcggaatcaacagatcatcctcacggaaatacagacccggctcaatcgtgaaaatcatgccaggacgaatcgcagcaccctgatacgactcataacgtgcctgagcgcaatcatgcacatccaaaccaagatgatgggccacaccacaggcgagccaacggcgatgctgctgtccttccggagaaagcgactcctcgacatcgaccggaagaatgccccaatcatgcagacgctcggcgatcacacgcatgcacgcatgatgaatgtcggaatacgtggcacccggcttggcagcttcaaaaccagcctgctgggagtccaaaaccgcctgatacagctttttctggaaatcagtgaacttcccgttggtcgggaacgtgcgcgtgatatcggccgtatacaagctattgacttccacaccggcatcaattagcagcagatcgccggactccacggtaccggtgttacgcatccaatgcagaatcggcgcatgagcgccggaagcgatgatcgtatcgtagccgacctcattgccttcctcacgggaaatggcattgaacgcgccttccagcatacgttccgaacgaggtttgtcgagcgacgacggcagcttgcgcagaatgttgtcgaaaccatgcttggttgcggcaacggccttgcgcatttcacgaatctcatattcgtccttgcacatgcgagcctcggcggcaaactcatgaagcttgtcatcggcatgcgtattgccatccggatctgcgaaaccgttcgcctcgcgaatatcctccaccatttcggtgatctgcggatcagcctcgcgaatcacacgcacacgcacggcaccggcttccgcgccgacatccttgctcaacgcgtcagccaactgcgcgatgtcattggtctcaataccggtcattgcagtcatctcctgcaagccggcacgaggaccaacccaatattcgccataatgggcgttcatgaaaaagtcctgcgtgtaatggttcgcacgcggagccacgaacaattccggcacatgcgtcttgccggccgcagcctccggagaatcaggatcaaccggattcaacaccagcacggcaccggcttcgtagtcttcgcccaaaccggtgtaatacgaaaacgtcgtatccggacggaacgcataatcgcagtcgttgttgcgcaccttcggctgaccggccgggatcacaatacgctctccgggaaaagccttacccagcgtgtcaagacgagcctgaatgtaatgggaagactccaacggttcaataaccggctcattatcatcccaaccggtggtcatgaactccttgaacgcctcggaacgcgggcgcagcgaacgattgttcacacggtcgctcatcgcctgatcagggccgggagcgctggactgctccatggcttcatactccttgtctttatcggtaatgacttcgttcatcacatctcctgaatatggttatccatgcttacgcaattaccgcaaaccatcctataactttttgcgccgcgcaacgttcatgcaagcacatagaataagggagattgagtgagcaatcccaaggtaggggaggaatccgaaagaatatgtcattcgaacatccgaatcgcaacaatgaaagcatgatcgacgtcgaacgcgacatcatgagccgcccatcagagcgcaataccaccaatcttgacctgcaacgcatgaagatgatcctcgacatcatgggacatcccgagcagtcgttccgtgtgattcacatcaccggaaccaacggcaaaggatctaccgcgcgcatggccgaggcgatctgccgtgcctacggcatgcgaaccggtttgtacacgtcaccgcatcttgaacatgtcaacgagcgcatcgccatcgatggacagcagctttccgacgacgatttcgttgatacctgggatcaaatcaaagaccttgtagccatggtcgacatgaagatggaagaactcgacaagccaaaaatgagcttcttcgaagtgctcaccgccatggccatctggaagttcgccgacgctccggtcgatgtggccatcgtggaggtcggtatgggcggccgctgggatgccaccaacgtgctcgatgccgatgcggccattatcggaccgatcgacatggatcatatggcatggcttggcaataccgtggaacagatcgcatccgaaaaagtcggcattatcaagccgggctgcaccgcggtcatcgggcatcaaccgcatgaagaggccgtcatgccgattatcgaggaagcggcgaggcagaaccatgccaatctggtgagggatggcatcgaagcggaagttgtgactcgtattccggcagtcggcggtcaggttgcgaccctgcgtacgccgaatggcacgtacgcggaagtgccgatcgccaaattcggcgagcatcaggcccataacgcgctcgcggccttgtgcgcggcggaagtggtgattcccgtcaacggtgcgcttgacggtgatcttgtggctgaggcgttgagcacggtgaggattccaggccgcatcgagcagattcgtacatcgccaacgatcattctggatggcgggcataatgtgaatgcggcagaatcgttgcgtgccgcgattgaggaaaattacgatttccagcaactcgtcggcgtgatcgccatgatgggagacaagcaggtcgaagagtatttgggcgtgctcgaaccattactgagccatgtggttgtcactgaaaactcgtggcgtgatcgtgtgatgcccgcggaagacctgaaaacggttgctgaacgcgtgtttggtgcggaaagggttacgtgtgttcctgaactgccggatgccattcaggaggctgttaatatggttgacgccgatgatgagcttggtgttggctatggtcacggtgtgctgatttgcggtagcttcaccacggctggcgatgcgcgtctcatgctggaagagaaagtcaatcccgatttgaagaagccgaagtcggaacgtgtcttccaggaggctgttgagccggaaccgcgtaaggatcaggacgaggcggatctcgatttcgaatccgacgccaatcctgatttcgatatcaacgatttcggcagtgtcggtccggaacttcccgatgatgaagatactgatgcttccgaagttgagcatgcgcatactgcatcttctgaagatatgcggtaatcgcatatatgcatggcaatgatggatcgtcggttgttgctgacgatccatcgatccaacgatctgtaatgcaatgcaaaggaggatgcagcgatatcgattcgctgcatcctccttcgtacgatattttgcactaaccgtctgaggtgcgattattacttgcgcagtttgcgacgcagcgactgcagcagcgtgagcgaacggtagaacgccttcttgaccggaatatcgcgaccggccgaaacctgtacgatattctcggagaatttcgtcttgaatccgttcagactcttcaatgaaggcgcgaaatcgttgccgatacccatcaaatcgagaacagtgcagccctgctctccaagtgcgcaacatacaacgtaaatcagtttgtcgggaacatgctggcgcatgacttccgtacgcatgcaagcatagtaatagaccgcgtgatcgccactgatggtgatgatggaccatgccacaaccttgccgtcgatacgtgccgcgaacacgcgcgcatgatcaggaccaagattgctgatcatatcgacatagtcgctcatcggagcgggggagaatccgtcacggttggcggtgtcaaccatgacctcgtagtattcggaaaaatcagccatcgcctgcgcggtctcatcggcgcaaacggcggggctctccctcaacgccttacgcacgtcgcggcggccacgcttcttcatacgtgtaagaatcgcctcatcgccaccggtgatgtccacatacacggtctcgttgtaaggaacggtggaaagcaccgggaacgagccctcgaaattccacaagtcgatacgcaggaacacaacgtttttatcgcgtttgcgtacgtcctcaacaagcaggtcacgaacctgtgcttccagctgcgcggaaggcttgtcaagccaagccggaccatgaacggacctcaaatagtggtagccatgggtttcgtaatcgatgagtgcgatgaatgcgattggagcgccgtcctgcttcaccacatacgcaccccacggcgtacgtccgtcaatggtgttctggtatttggcccacactgcggtctgttcgatgggcagggtaagacccgcctgcacagcctgctgttccatggtgactgcgtcggtgaattcaagagtgatcatgattgttggattgttccttatggttggtgattactcgatgatggttggctgttgctgcaggtcaggcaagtccaaaaatacgtttcacaatgtggtcgtcgccttcgaagggaatatgactgccgtggtctttgaaccagcgctcgttgcctttgccgatgataaggatgatatggaggcggttgggattcttgcggtcaattgctacggtcgactccaccgctttcgtacggtcgagaatgatcctcgcatccagatcgggattggtgacactgtcgagcatgtcttggcagacgtgttccacaggctcgtcatccgtgtcttcgaaggtgagaatcagatggttgacgcggttctgcgcggccctgacgatttccgatctgcgatcgtacgctttattgcctgcggatccagtgaccagcgtgacttcaggatcgtccttgccgtagcgttggtcgacatagtcgagcaacgccgttacggaagcataattgtgcgcataatcgacgatggcgatggtgttcgacttcgtatcgtggaaatgctccatacgaccggcgatacgtaccggttccatattgcgcagcgcttccttcgcggtggtctcgtggaaatcgaatccaacggcatgcgcaatggcaatggctgcggcggcattcgcataattgaaatcaccatccaactgcaggctgatcgagccgatctgctcaccttccaccgcaatggcgaatcggctatggtcggcggattccggccatgcgatcacatccgcggccgatgcttcgccaagagcgaacgcggtgacgggaatatcggcgattgcagcatcctgacgaataagatcggcatgtgcgcatgccgtgccgagaaccaaggaacggcaattcttcacaatctgacgtttgcagtggaagtaatcctcgaatgtcggatgctcgatggggctgatatggtccgggctgatattgaggaatgcggcgacgtcgaaggtaattccgaaaacacgatcaactttgtaggcctgcgacgaaacctccataaccaggtattccatgccgttatcagcggcttcgcgcatcatacggaacgcatccatggactccggggtggtcaaatcggactcgacataggtatgtccgtcaaggcaattatcgacggaggagaacaatgcgcatttgccgccggagcagccgttgagcatggcttgggtgaggtaggcggtagtggtttttcccttggttccggtaatgccgacgactttcagctggccctgcgggtgcccatagaatgccgcggacagcagactcatggctttgcgcgcgtcattcacgatgagtcccggagctttcgtcgccgcggagaagtcgttttccgcaacgtatgcggcaagaccacgattatcgatgccatcgagatattccgctttgaaacggcctttgcagcataggagcgtgccagatacgacctgcctggtgtcgtaggtgattgaaccgaatggcttgtcgaatccgttgacggtctgcgcgtcaagcgtccaggcgtctccttggatgatttcgcgcagcaatccatgctcgctgagcagacgtgctgctgatgccagagtcaaagccatatttcgtgttctccctgttcttcggataccgaacagtcattctaccttcagctatgtgcatggcatgtggaagtcgatgtggttacaatgaagctgtgactgaagtacgaacggaaaccatggcaagcaaaagggcgcgttttgaaaaacttgccatgcctgtggttgatgcgttgtaccggcaggcgatgaagctgaccaacgatcccgacgacgcccaagatttggtgcaggatactttcgaacgggggttcaaggcgttcgactcctttcaggagggaacgaatttcgccgcatggatgacgaccatcgagcgcaacgcttacttcaaccaatacgccaaagccaaacgcagaccgcagcgggccaacgattccaccggcgaatacgacgattgggacatttattcggcttccgagcattcaccggaagagctcaaatcggcggaacaggaatatttggatgcctatgcgcctgaagaaatcatggcggcgctcgccaagctttcgccggaacgccgtcaggtgttcatcgatgctgcgatcgacggcaaatcataccagcaggtagctgacgaacagggtgtgaaaatcggtacggtgatgagccgtctcaatcgcgcgcgcacgcagttgaaacgagaacttgccaactatgcgagggaacgtggctatgccacggcagggaagggcagagcatgagtgaatcgatcgaacggcatatcaccactgtcgccaccagcgaggacggcactgtgacacaggtgacgcatgccagcgtgcgcgttagcacctccggtgattgtttcgaccccgaacgttgctgcgacgagcgtgaacgggcattgatcgcggccatgcgtgcgtatttgcgtccgcagcatgccccgcagagtcttatcgaccgccttgaggcaacgctcgaccattgttgtggagagcggtgagcaagccgatgagagtatgagaaaaccccgccgatcataacgattcagcggggttttcgatgctctgtagcgttattcacgctggcagggatcaggcgtttggacgcttgccgtgattggcggccttcttacgacgatccttgcgcttacgtccgcgcatgcccatgattggactcctttacttacgattaataagccttcgggattatcgcacacgagcgagacgtttgccaaatccggtgttcgataggtggccacttagacttatccgtcgggtttttatatgaccggaatcagccggtttaaccgactggatcactcgatcacgctcactcgcatgtttactcggccataccgaggaacagcgaggtgctggtggtttcgcccggcttgatcacgatcagctcgttgcctgtgttgaacgcgttggcgtaggcggtctgtggctccacggcaacgccggcaggatgctggaatgcagggaacttggtaccggtgcacacctggaacgaagtgatggtttcatcgccgccaacacggaccttcttgccatcggcgcgggtgaacactgccgtgacggaaccgtcttcggcatgctccagatcggtccatgcatcgtcgaacggctgctcggtaagtagggtgtcttcgcgcaggtcgtatttggtgccgtcaaccagctcggtgccggtcggaatgaggttttcatctacggtgacatgcgtgcgagccggtagcgtaaggctgcacttggcgttgtgctcgtcgatttcgtcgccatagccgttgaggctgttggcaagccacgggtgaatggccaaagcccacggcgcgttcgtgtcgccgttattgtaggcgctgacggtcagatgcatgccgtcgtcggcgaggctgtacgtggcggtgacatatagatcaaacgggtagccgaccatgttgggggaacgccaagcgagggtcactgcgtcttcggcaagcgaaatcagcttccagaacgagcggtatccgtagccgtggatggcggtgttgcggtcatgctcatcgatcggcagcgaataggtcttgccttcgaacgtgtactcgccaccctcgatgcgattcgggaacggaatgaggatctggccgtggcagcaggtcaccagatcgtccggaccaagggcgaccgtcagatcttcgcccttataggtcagcttgcgcatcgttgcgccgagttcggtgatgacggcttcatagtcgccatgggagatggagaattgctgtccggtgcgggcaggcagattgatgcaggtcatagtcactccatagtgccgttggatatgttccggtaacggtagcgttaccgctaacaccacagtctacctgttttatgccgtatggcgatgccgtttctccggcgtgccgcccatgctttagtattgatgaggttttcacgaagtgacgaaaggcggccatcatgaccaagcgtatcgtactggcggatccacgtggcttttgcgcgggcgttgacagggcgattctgactgtgcagacgattctcaaagctgccaatacgtctcgcaatgatggtctgccgccggtgtatgtacgccgtcagattgtgcacaacaagcatgtcgttgaggaattgtcggctcagggtgcggtgttcgtacaggaattggatgaggttcccgatgccgcggcttccgcgggaattccgattgtcttttctgcgcacggcgtgtctcctgaggtgaaggctgaagcttcagctcggggcatgcatatcgttgatgctacatgccctttggtgagcaaagtgcaccgtgaagtgttgcgtttcgtcaaagaagggtacgagatcatctacatcggacacaacggccatgatgaagccgttggcgtggtcggtgaatccccggaacatgtgcacctcatcgaacatgaatcggatgtcgattcgctcgagttttcttcggatgcgaaattggtgctgctttcgcagaccacattgagcgtggatgagacggcgggcacgatcgctgcgttgaaagagcgtttcccctggcttgagatgcctccgaattccgatatctgctatgccacatcgaatcggcaggccgcggtcaagttggttgccgagcagtctgattgcgtggtgatcgttggttcggcgaattcgtcgaattccgttcgtctgatggaggttgcgcaggaggggctgaacacgcgtttcgatggcgtgccgaatggtcctcacggaaaggcctaccgcgtggatgatgcgtccgagcttgatcctgcgtggtttgaaggcgttgaatccgtggggatttcgtcgggagcatccgtgcctgacgaattggtgtcaggcgttatcgaagcgctggaacagcgtggtttcgatgatgtgaccaccatcgaaaccattaaggagaacatgcatttcgtgctccccagtgagcttcgtaagaaaccagcctgctgaccggcttctattaccggtgattaccaggtgccgataggtgcggctatgccgtcaagcaccttgagcagatcattgggattgatgccgatcgaaaagccgcgtttgcctcccgacagtagtatttcgccatattgcagcgcgctttcgtcgagcacggttttgtgatgcgtacgttgaccgagtggtgagatgcctcccaccacatacccggattcgcgcatggcgacttttggatcggccatagcggctttcttggctccgactgctgcggccagcgccttcagatccatgtgcccgcttactggaaccacgcccaccacacgttcggagccggtgtcggccataagcgttttgaatacctgatgttcatcgaagcccagtttggtggcggcctcaaccccataaccgtcatccatatggtcgttcgaatgtgcgtattcgtatgttttgaatgggattcccgcttgttcgagttgcactgttgccggcgtggagccggcgcccttctcatgctttttcttgcccatatcgattcactctaaaacgtatttgtgtcggttagcaaaagggctttcgccgtgagacgaaagcccttgtaccaagttctacttagtgaactgtgcggattgctccgccatggttcactcggagatctcagcgaagtacagcagggtgcgcaccatgttgcaggtgaagccgtactcgttgtcgtaccaagaaacggtacgagccatggtcacgccgtcaacggtgttgacgtcggtctgggtcggatcgaacacgccaccgtgggtgtctccgatgatgtcggaagacacgatgccatcctcgttgtagccgtagaagtcggtggaggagaaggcagccttgaatgcggcgttgatctcgtcagcggtgacttccttgttcaggacggtggtcagctcggtgacggagccatccggaacctggatacgctgggcgtggccctgcagcttgccgttcacggacggaacgaccttgccgatagccttggcagcgccggtggagtgaggaatggtgttgattgcggcggcacggttgttgcgagccttcgggaagcgcgggccgtcgaggatcatctgggtgccggtataggcgtggatggtggtcatgaagccagccttgatgccccagttctcgtccagcagcttgaccatggcggccatggagttggtggtgcaggagccggcggacacgatcacgtcggaagccttcaggatctcgtggttcacgccgaagacgacggtcggggtggtctcgtccttggccggagcggagatcaggaccttcttggcgccagcgttgatgtgagcctgggacttctcagcggaggtgtagaagccggtgcactcgagcacgaactcaacgccatcgttcttgacccacgggatgttgttggcatccttctcggcgtaaaccttgtattccttgccatcgaccacgatggagtcttcggtggaggtgacctcaaccggggtgccatcgtcatgacggaaggtgccgtgggtgctgtcgtacttcagcaggtaggccagcatggacggggtggtcagatcgttgattgcagcgacctcaatgtcaccggcctggccgccacgagcctgcagctcgaagatgcggcggaaagccagacgaccgatacgaccaaagccgttaataccaatcttaactgtcatgtaattctccctttagggtaggccacgcgtgtgctgggcacacagaagccattgtttaccaacgtcacccactttagtgcgtcacctgtacttaaggcaacgcactcgcgcgtgtgtttcagaaaacgtcgtatttttccgtgagcgctcacatcatcttttcgagataaacgtgatagacgaaggtgattttcttcgctttgcgattagcgggattggcgttcgtgcttggcaagcgatgaagatactttggtgtccaacgatccgaggtcaccctcaaatgtgtggtgccaagagactgctggtagtggggcttccgaagggaaagtcaccaccaaggtgccatgttcgacgccgatatgggcggcggctccgttgaggaattcgttactgacgccgttgacacgtgtgctggtcatcgtcatgtcatctacctcgtatttcagtccacgttcgctcacgccaagagaggtgtcggaatgggagaatacggaaaccatacgtcctggttcgacgttgttctcgccgaaatcgagtgctccatcgcaaatcgcggtcacaatggagccgttcccgtgcagaaaacctactgcaccatgctgagccagcaatgccatcagttggatattggatatggtgtgatcgattcgtccgccgagcgcgccatatatatggaaaagccgcgcatggtgtgaccagccgatttttagtgccgacagaaggtctggatcgtctttttctggaggtagggcaatggtgtgttcaccctgtgtcggacgttctccagtaagcgaatcgaaatcgcccaccaccacgtcaggcgacatatcaagtgcgcgtgcatggtcaagccctccgtccgccgcgataatgaatgctccagacggaacgatgggggtatcgctgtagtattcgccagccgcgaaaatcacgcatgtgttggaattatctgtcatatggggtcagtgtaatatggcgttggaatgattaaagaagatgtttcagaaggtttcattatgcgacacgctgtggtcgcggtgtgtggtattatctacaaggcttgagaaatcaagaaagcgggatatctccacctggaagcctttcagggcctcgggttcaggcataagcctctggtgccgtatgaaacggcagtggaagagctgtggtatggctctttgttgcgccctcgaattgggtgttttggcttgccgtgaacatgcgagactttgaaaactgccgatctgggagcattccgtcgaatggaacatgaggattggagtcatcatcagcgacgaaccacgcattaacgacgagattcgcgtctcccaggtgcgtctgatcggcccgaacggcgaacaggtgggagtcatcgcgacttccgtcgcactgaacctggcaaaggaagcgaacctcgatctcgtcgaggtggcgcccaacgcgaagcctccggttgccaagctcatcgattacggcaagtacaagtacaacgagaagatcaaggctcgtgaggctcgtcgtaaccagagcactgcggaaatcaaggaaattcgcttccgtctaaagatcgacgaccatgacttcgaagtcaagaagggccatgttgtgcgcttcctgaacggtggagacaaggtcaaggtcaccatcatgctgcgcggtcgcgagcagtcccgtccgatcggtggcgtcgagctcttgcagcgtctcgccagcgaagtggaggaatacggcaccgtcgaattcgctccgaagcaggaaggccgcaatatcatcatgacgctcgcaccgaagggcaagaaggttcacacccagtccgagcagcgtcgtcgtggtgatcagtcccgtgccgagcgtcaggcccgtcaggctgcacgtctggcggccaagcaggaagcccaagctcaggcggcggccgaagccaaggctgcagtggcatccgacaaaccgaagacttccgaaacgaagtaataaacaaggagggcagcaatgccgaagatgaaaactaattccgccgcttccaagcgcgtccgcgtgaccggttccggcaagctgatgcacgctggctccgcgatgcgccacaacctcgagcacaagtccgctcgtaagcgtcgcgcactgaaggccgacggcgttctggctacttcccagagcaagaacatgaagaagctgctcggtcgctgagtatagcgagagcgaataagaagacttaatagaaagctgaggaatcaaatatggcacgtgtcaagcgcgcagtaaacgcccacaagaagcgtcgcgtcgttctcgagagggcttccggctaccgcggccagcgctcccgtctgtaccgtaaggccaaggagcagctgcttcactcctttacttacaacttccgcgatcgtaaggctcgcaagggcgacttccgcaagctgtggatccagcgcatcaatgctgctgtccgcgctgagggcatcacctacaaccgcttcatccagggcctgcacctcgctggcatcgaactggaccgtcgcgctctcgccgagctggccatctctgatccggagaccttcaaggccatcgtcgagcaggccaaggccgctcttccggctgatgtgaatgctccgaaggaagcctgagcttcttcgctgattcagcgtgattgacaggaaccctcgctccagcaatgggcgggggttcctgcgttgcatggcagggctcgtttgacttatggtaagggaccgctcagtggtatacgatgagccggatgggatctgctggaaggagggtgatggacgatttcgaacggacaattcggcaattcctcgctcatatcgacgttgaacgaggactgtcgaaggcgacggtgtcggcgtatggcgccgatttgaagaagtatcgtcagtggcttgccgaccaaggcgttggcggtatcgcggccgtgacgacacaggatgtggaacgttatatcgtcttccttgacgagtcgggagagtcatctcgaagcaaggcacgccggttggccagcattcatgcgcttcatcgtttcgcagtgaacgaacatattgttgtcgatgatgtgtccgcgcaggtaaaggcccctaagggcgtgagcacgcttcccgatgtgctgaccgttgatgaggtggctagactgctggactctatccccgtttctcaaaacagagagcatgatggtgtcgtgtcggagtttcccgatgatccggtgatgttgcgtgacaaggcattgcttgaattcatgtatgcgaccggtgcccgcgtgtcggaggcgtgcggtgcgaatctcgatgatgtcgatgtggacggcagaatcgcaagacttatgggcaaaggctctaagcagcggctggttcccgtcggcagctatgcgtgcgaagcgatcatccggtatttgcatgcggggcgtcctaagctggaatccaaatcgaaaggtcccgtggaacggcgtgccctatttctgaataaacgaggaaaaagattgtcgcgacagtcggtttgggaaatcatcaggggagcgggggagcgtgcgcacatcgataagccgctgcatcctcacaccttgcggcactctttcgccacgcaccttattcagggcggtgccgatgtgcgtaccgtgcaggagctgcttggtcatgcaagcgttaccaccacacagatttacacgcatatcagtcctgaaaacctgattgagacatatctgatgtctcatccgcgcgccagatgatggtgttgctgccgttttgaacggtgacaatggactagcatggattacagtgaaaattgacacaaggatgttggtaaggtaaacggtatgcctacggatttgcttggacgtgattatgagacgtttcccgctccggagccgctgcagacgcacggtccggcgaggatcatcgccatgtgcaaccagaaaggtggcgtcggcaagaccaccagttccatcaatatcgctggtgcattgagccagtatgggcgtcgcgtgcttatcgtcgatttcgacccgcagggtgcggccacggtggggttgggcatcaacgccaataccgtggaagatacggtgtacaccgcactgttcaatcctcgcatggatgtgcatgatgtgattcgacataccgatttcgagaatctcgatatcatgccggccaacattgatctgtccgccgctgaagtgcagttggtcaccgaagttgggcgcgagcaggtgctggctggcgtgttgcgtcaggtcaaggatgaatacgatgtgatcatcgtcgattgccagccttctctgggtttgcttacggtgaatgcgctgaccgctgccgatggcgtgatcattcccgtggctgctgagttcttcgcactgcgaggcgtggccttgttgatgcagtccatcgaaaaagtacaatcccgcatcaatccgagtctggaagtgtacggagtgctcgtcaccatgttcacgcataccttgcattgtgatgaagtgttgcagcgtatttatgaggcattccaaggcaaggtcttccattcagtcatctcacgttccatcaaacttccggattccacggttgcggccgcgcctatcaccatttatgcgccgaaccataagaccgcgaaggaatatcgtgaggttgcccgagagctgattgctcagggcatcgtcgcataagacgcatagggctccttcgtggggcctttttcgttgaagggcatacgtgggttgaaattcaagcggtgtggtgaaacactgcacttatagtcatgttgactataagtgctacactgtgattccggaacaattcaaatcgacaaaagatcggagaggtgaggcgcgatgatcatgggcaatgtctcagaacggcgcaaacagccgccgcaggtgggcgtttccgtggtcattctcgctttggggccagcttcccacggaacgcaggaacatgctcgaaccagtgcgggatccaccttgtggataccgctggtccggcgcgtgcgccagccttttcttggccagtgggcgttgcccggtggtggtttgagggctgaccactcgctggagcaatctgcctacgttgcgctggaatccacgacatcgttgcatccacggtatcttgaacagctgtatacattcggcgatccggcgcgctcacacggcgggctgccgatggtatccatcgtctattgggcgttggtcgacgatcttaacgggcaactcgggcagagtatcgacgacaatgtcaaatggtttcctgtggatgatctgcctgagttggcatttgaccatggcgacatcgtggactacgccctcagcagacttcgtggcaaaatcgaatatccgcagatcgtcaccagattggtaggcgagaggtttacgctgagccagctgcatgacgtgtacgaggccgttgccggtcagagcatcgatctggcgaatttccgccgtaagatgctcgcatccgggcagctggaggacaccggtgacaaattgcgtgtcggacgcaatcgtccggcaacggtgtatcgctacaccatggatgtgctccgacagtcgacatggagcgatgctcgggatcgccatgatttcgatgtgcgggaaacgcaggatgatgtgctttccgcgttgacgacgatctgacgtcttttcggattgtttccttttcagacgattctgtctggttttcggcatgccttgtaggcatggtcgtttcgtatgagaggaagaagtatgacatccgtgcaatccgcatcggttgcttcgtcgggttcgttgacacgcaatgagcgtcttgatcgcctgccgtttaacaaagcgcataggaaacttctggtggcgtccggtatcggctgggctttcgacgccatggacgtcggcttggtgtccttcgttgtggcggccatcgcggctgacccgcatttcaatctgacaccaaccgagaaaagctgggtgctgtccatcggcttcgtcggcatggcgatcggtgctgcgctgggtggttttgtagccgatcgtgttggccgcaaaacggtcttttccgcgacgctggtgattttcggtttggcgaatggcggcatggcactgtcatggtcgttggccgcgcttttgatcgctcgtctgatcatcggtcttggtttgggcgccgaactgccagtggcttccactctggtttctgaattctctccgaccaaacaacgcggtcgtatgacggtgctgttggaatccttctgggctgtcggctggattgtcgccgcctgcattggctactttgtgattccgaataccggcgattggggttggcgctgggctttgctcattggcgcgttgccgctgctgtatgccattgtgacgcgtgttcatattccggaatccgtgcgattcctggaatccaaggggcgtgaggacgaagccgaacaggccgtacgctatttcgaacaggcaggtggcatcgagccagtggcttccccgaagggcaaaccactgccgaagatcaacacccgcgaactgttcggcaaaaagtgcatcgcgcgcaccgcagccatttgggccacgtggttcttcgtgaacttctcctactatggagcgttcacatggatgccgtcgctgctggccgaccagtttggctcgctgaccaagtcgttcggctatacgctggccatcgccgtcgcgcagttgccgggatacttcctggccgcatggctggtggagatctggggccgcaggaagacgctgagcgtgttccttgccgtgtcggccgtggccgcgtttgctttctcgcaagcgggttccgtagctgcggtgttgggctttggcatgttgttgtccgcatccaatcttggcgcgtggggcgtactgtatgcggtgactccggaaatctatccgacccgcctgcgcgctgctgcgtccggtgctgctgcggcatgtggccgagtggctgccatcatagctccgctgctcatgccgtggttcctgacgctgtccggtggcaacaaggcggtggcattcatcgttttcgcggtcgccttcattctggcctgcgttgcggcgttgtgcttgccggaacgcactggtaaggaacttgaggattaacgaattattttgagtggtcccaagagatcatacgtttgcggttgttgagattcgacaaccgcaaactttgtatgtgggcgaaagcgctgggaccggaactgtcgtaatggttcgctaggattggctcggtttgtgtggagtacggatttgtaagtaccgataaccagtatgtaccgaacggtaacgcaagagaacagcaatactaagagaggtttcgatggcggttcgcggcgatattcgaaatgtagcgattgtggcacacgtcgatcacggcaagaccacgttggtcaatgccatgctggcacagtcccacgtgttcaacgaacgtgaggaagttccggatcgtgtgatggattccaatgatctggaacgtgagaagggcatcaccatcctcgccaagaacaccgctgtgcagtacaccggtccgctggccgccaagtacggccatccggaaggcatcaccctcaacatcatcgatactcctggtcacgccgatttcggcggcgaggtcgagcgtggcatctccatggttgatggcgtcgtgctgctcgtcgacgcatccgaaggcccgctgccgcagacccgcttcgtgctgcgcaaggctttggaagccaagctgccggttatcctgtgcgtgaacaagaccgatcgtccggacgcacgtatcgaagaggtcgttggagaatcctccgatctgctgctcggcctggctcaggacgttatcgaagagggtgtcgatctcgatgaggatgcgctgttcgacctgccggtcatctactgcgcggccaaggccggctacgcttccgaaaaccagccggagaatggcggtctgccggataacgaagatctcgaaccgctgttcgaagccatcatcaagaacattccggctccggaatacgaggaaggcgcgcctttgcaggcacacgtcgccaacatcgattcctctgatttcctgggtcgactcggcttggtgcgtatctacaacggcactctcgaaaagggcaagacctacggtctgtcccgtgtggacggctccgtcgaaaacttccgcgtctccgaactgctgcgtacgcagggtcttgagcgcaccccggtcgattccgcgggtcctggcgacatcgtcgcagtcgccggcgtgaatgacatcatgatcggcgaaaccatcgttgatccgtccgatccgcgtccgctgccgctgatccacgttgatgatccggccatctccatgactttcggcatcaacgattccccgcttgccggaaccgaaggcaaggaccacaagcttaccgcccgcatgatcaaggatcgccttgaccgcgaactcatcggcaacgtgtccatcaaggtgctgccgaccgagcgcccggatgcatgggaagtccagggtcgtggcgagctcgccttggccgtgcttgccgaacagatgcgtcgtgaaggctatgagctgaccgtcggccgcccgcaggtggtcaccaagaccatcgacggcgtgatcaacgaaccgatggaaaacaccaccatcgacgttccggaagagtacatgggcactgtcacccagctgctcgccgaccgtaagggccgtatggagaacatgaccaaccatggcactggctgggttcgtctgcagttcaccgtgccgtcccgtggtctgatcggcttccgcaccgcactgctttccgccacccgtggcaccggtatcgcatcctccatctccgccggctacgctccgtgggctggccagatcgtgacccgccagaacggttccatggtctgcgatcgcaagggtatcgccactccgtacgccatgcagcgtctgcaggcacgtggcaacttcttcgtcgaaccgcagtctccggtgtacgaaggccaggtcgtcggcgtgaacaacaagcctgacgagctggatgtgaacatcacgctggccaagcatatgaccaacatgcgttcctccaccgcagatgtgctcgaaaccctgactccgccgatcaagatgagcctcgaagagtccttggacttcgccaacgaggacgagtgcgtggaagtcactccggaatccatccgtgtgcgcaagattattctcagccgtgaggattggtacaagtggcgcgccaagcagcgtcgacagaataacgctcagaataacaagtgattcttcacgttgttctgtcggcttcgcaagcacggtagtgtgcttgctcacttcgcctacggtgagcccgctgggctctccgtttgacggctcagcagaataacgctcagaagaacaagtgattctgttattgcttccatgaaaagagatacgtgtcctcgcgtatctctttttcttttcaggttggtgagcgatagtaggggatatgatgcaacagatgaagcaatcgcatgatacgtatgggtcgaatcaagatgcggcgcccgatgcgcaactgatgccatggtcataccgtctgccgatttggggacggttcctcgtcgatctggtttccggaatcatagtcggagtagtgggaaccatggcccatcgcatgggcgcatccatgaatattccctacggattggcgatcgcctatctcatggtgatcatttcgacatggtcagctcgatcacgcgacggtgtctcaggcctcgcattgcacctgatcggttcctctctggtggtctggacggtgatgtcggggtatggtccgggaggagacgccatgattcctgtgggattcggtggagatgatcccatgccgttcttcagtgaacaggcaggatacatgtggctgtacggtgtcgtgcttattccggttgtgatgctggtgctgccgaaacgttggttcgtcacacctccgcgtaaggagacgcgtgatggtgcgtttgctgctgatacgcagacgaacgagggtaaaacatctgataacgcccaaccggtggaataatcggcagtcgattccacggcaatgaggtaaggttcaggggaacaccaagaataaggaatggggttgaatgagcgcacgaaagctgttctatctaggtccgcaaggcaccttcacccatcaggccgcagtcaatgcatcgcaggcactggcccatcttgagccggaaggattcgaattggtggctgcggatgacgtaccgcaaatccttgatgccgcgcagcggggcgaaggatggggcgtcgtggcatgggaaaacaacgtcgaaggttacgtggtgccgaatctggacgcgctcatcgacgccaaagatctagtcggatttgcgcgagtgggcgtcgacgtaactttcgacgcatatgtgcgtgcgggatccaatccggaagacgccaccgtggctaccgcacacgcgcatggtctcgcgcaatgcaaacgtttcatcgcggaacaccatttggaaccgactccagcgccatccaatgctgccgcatgtcgcgatatcaaagcaaacgaaatagctttcgggccaagtatttgcggtgaactctacaatgtgacgcgcatcggtaccgccgtgcaggattatcaaggcgcacagactgattttcttgtgctcgcaccacgcaaggaagccggaaaactgttggaacagcctcgttcgcaagctgatatggaatacgaatccgtgctgacgcttattccgcttgtcacaggtcctggcgtactcgcgaacctgctggacgtattccgcgatgcaggcctcaatatgacaagtttcatctcgcggccaatcaaaggacgcacaggcacatacagttttatcgcgacgctcgatgcggcgccatgggagcaacgcttccatggcgcgctggttgaaatcgccgaacacggtgactgggccaaaactctggccgtatacccacgaagagaacgccccaatcctccagtcacctcatggatgctgccgcagggaggcgtacggcttgacgaacagcatctgccagatgattggcagaacagcgaaacggtcggaaaggagctgatgtggtgaagcagcgtatcgcaatcgtaggccttggtcttatcggagggtcactggctcgcagactcgttaatgctggctgtgaagtcatcgcatggaaccataacgatcgtccatatgaaactgcgaaagcggacggcatacgatgtgtgtccacactggccgcgctcgccgacacaaaacctgacgtgctggtgttatgcaatccgctcaaggccatgccgcaaatcctgggtgcgttgaagccactgatcgatacggacatcaccacgctcaccgatgtcggcagtgtcaaagcaatggttcgggaacaggttaaagccgttggattggaacattgctatgtgggcgcgcatcccatggcaggcaatgagctgtccggatgggaatcgtcggatccgacgctttacgatggcgcgctctgggccatcaccgtagatgaaaacaccgagtatcagcggttccgcgccgttgcgacaatgattgtggatcattgttccaaccgactcatcgttcttgacgatgcgacccacgatcgttgcgcggcactgatttcccacatgccacacgtcatttccacagctatgatcaacgagctggtggccaatcccaaccggaacatcgcagccgcgctcgccgctggttcatggcgggacatgactcgtgttgcgctaaccgatccaaaccgtacccgtgcaatggtggaagaggacgccgccaatgtcgaagcgttgctgcgtaatatggccaatcggttgacgcttatggccaacgtgctgcacggcatgaccacgcaacagggctcgcccactgccggtgacgacaaggagatggcgcgtttcttcatacaagggcagccattccgtgaatacaaggctctcgccaaagaacctgacttcgaagaacgttgcgaaacggtcgaactggcaattcccgaaaccggatggcagcagatgcttctggagtcggcgcgtaggggagagcatatcgtgcgattcgacggttaccgtcaagctatggcacaggtgcgttccgcagtgtgacgcgctatgggcgcggccgtgtcatggaacgttccggaatcggtttgacagtgacgatggtgtcggcgggaatgctgacacgttgctctgggcgtgaaccgttggctgccgcatcgcgcgtcatttccaatgtctgcccgtcccaagaacgtacgtgaccgacataatcgcggaatttcatgcgctggtcctttggatcgacaccttcgcaggtgcgcaccacaatgcgtgcacctgctggaatttcgtttggaatcggcataatctccccttcgaatagacgatcatcgacggattcgctgagcgaacgctactggacagcatagttggtctcctttcaagttgtgccggtatttcggtttctatcggagaatggacacataatggaaagaaattcatggattcgggcttgctgttgagctcgggaaaggctgatcggcatgctgttcgataagagcgtagaggcattcgatacatatctgaaagccaaccgtggattgagtgaaaacacacggaaggcataccgaggcgatgtcgaagaatgtctgcttgccttggggcggcttagatgcagggatcttaacgaggtgaccatcgaagatcttcgcatgtggatggcggaatcatcgaaaaaccatgcgaaaagcagcatggcccgaaaaactgtggcggtacgtggttttttcgcgtggacgcatgagcatggcgtgacgacgacggatccggcttgtgcgctcatgaccccgaaaatacctgatacgttgccggatgtgctcagcgaatcacaggctgaacagctgatggaacgcgtggatgaggacggtgaaacgtctcagccgaaggaacggaccatgaagcagcaggccattgagctgcgtgacgccgcaatgctggaactgttgtatgcaacgggcatgcgtgtggctgaactggtgggacttgatgtgccggatgtggtcttttccaatcgaacggtcaaagtgaccggcaaaggcaacaaacaacgagtcatgccatttggcgctccggcgcaaaaagcgatacgtcggtggctggatgatgggcgtcccctgttggtgggggagcagtccgcggctgcgctgtttcttgggagacaaggcaaacgcattgatcagcggatggtacgtcgtgtggtgcacgaatgcgcgcgtgatgccggcgttcccgacattagccctcatgctctgcggcacagtgccgccacgcatatgcttgacgggggagcggatttgcgtgaggtgcaggagctcttgggacattcctcgctgaagaccacgcaacggtacacgcatgtctccatcgaacaattgaaagcccgatacggtcaggcatttcctcgtgcgtagtcgcggtccatggatatttcgttacattcctgtaacagaaattggtgtttcttcttgatttagggtgtattacctagatgaagctggtacggggaaacaataccgaccggtaatccgaataatgagggaaaacataatgagtataaggaaaagcaaggtgtttgccgttgcggcggcggcctgtgtgcttggcatgatgctgggcggctgtgggtcttccacgtctgggaacgcgactgaaggatcgaatgtcattacggcatttgactccgaaccgcagaatggcttgattccgggcaacaccaatgaaaccggcggtggccgtccaatcgatctgctgttcgctgggttggtgtctttcgataaggatggcaaggcccagaatgaagtggctgagtccattaccgccaatgatgacgccacccagtacgacatcaagctcaaggatggttggaagttcaccgatggcaccgatgtgaccgccgagtccttcaccaaggcttggagctatacggctaatgcgaagaacgcgcagctgtgctcttccttcttcccaccatcaagggctatgacgcgctgcaggacaccgacaacctcaagggtgacgagcagcttgaaggtctgaagatcgtcaacgatcacgagttcaccgtcgacctgagccagtcggattccgcgttcgccaccaagctgggttattcgggattctatccgatgccggaatccttctacaaggatccgaaggccttcggagagtcgccggtttccgatggcccgtacaagttcgattcctgggaccatgacaaggaaatcaagctggtcaagaatcccgattacaaaggcaatcgcaaggtgaataacgacggtgtgacgttcaagctctacacggatgccaacgcggcctatgccgatgttcaggccggcaaccttgatgtgatggatacggtgccgtccgccgacagcaagaccttcgaatccgattcctccgtggtgccatacaacaaggccggttccgtgattcagacgttcaccattccgtcggatcttgaacattggaagacatccaccgaagaaggacagttgcgccgacaggcgttgtccatggccatcgaccgtcaggccatctgcgacaaggtactgaatggtttgggaactccagcggtcgaattcacgtctccgaagactccgggctactccgattcgctcaagggcaacgagaatctgaagtacaacaaaaagaaggccaaggaactctgggagaaggccaacgccatcagcccgtggacttccgacgacaagcttacgttctcctataatgcagacggcggagccaagccgatctttgaagccgtggtgaactccgtgaagaacacgctcgatatcgacgtgaccactaacccggtgccgaccttccaggaattccgaaacgacgttaccggccgcaagatgaccggcgcgttccgtaccgcttggcagccggattatccgtctcctgaaaactacctgtaccagctgtattcctctgacgctgctgatggcaatggttccaacgatggcgattacaagaattcggagttcgatgacctgtgctccaaggctgctgccgcacagaccaccgacgaggccaataagctgtaccagcaggctcaggagattctgttgaacgatctgcctgccatcccgctgtattactccaatgccaatggcgttgccgcatccggagtgaagaacttcgtcatgaactggcagaacgttccggtgtataacgagatttcgaagagctgacttattcttcggatacattgttcgacatgacggcggaaaacgtatgttttccgccgtcatgtcgtcaaggaaggtgtgcgttttttgggttgcatggaaaggttgtccgtcaattgagcaagaatagtgcactatcgccaaatagagatgcgtcggtgagtaggtcggctcgtttccgtttgtgggatgataatcctgatgtgatatcgaataggagaatgattatatgaagaagaaagcactggctttcgctgccgccgcgtgcgcttttggcatgttgctgagcggctgtggctcttccaacggcagcgacaccgccgctgaaggtgccaacatcatcaccgcatacaattccgaaccgcagcacccgctcatcccgggcaacaccaacgagaccggtggtggcaagccggttgatctgctgttctcccgtctgatttccttcgacgccaaaggcaatgcttccaacgaagtggctgagtccattaccgccaacgatgacgccacccagtacgacatcaagctcaaggatggctggaagttcaccgacggcaccgatgtgaccgccgagtccttcaccaaggcttggagctacgtggccaacgccaagaacggtatggtcggctcatccttcttctccaccatcaagggctatgacgcgctgcaggacaccgacaacctcaagggtgacgaacagcttgaaggtctgaagatcgtcaacgatcacgagttcaccgtcgacctgaacaagtctgattccgtgttcgccatcaaggtgggctattccgcattcgctccgctgccggaatccttctacgatgacacggatgccttcggtgaggctccagtcggcaacggtccgtacaagttccagtcctgggatcacgacaacgagatcgtgctcgtgaagaaccctgactacaagggcaaccgaaccccgaagaacgacggtgtgaccttcaaggtctacaccaaggatgacgcagcctacgccgacatccagtccggcgccctcgatgtgatggaatccgtgccggcctccgccaccaagaccttcgaaaccgatgagaccgtgcaggcctacaacaaggccggttccgtcatccagcagttcaccattccgtccagcctgaagcacttcgaagctggtaccgaagaaggcactctgcgtcgtcaagccatctccatggccatcaaccgtgagaacatctgcgacaaggtgctcaacggcaccggcactccggccgttgactttacctctccgctgaccccgggctactctgattccctcaagggcgtcggcaacctgaagtacaacgagaagaaggccaaggaactctgggagaaggccaatgccatcagcccgtggacttccgatgacaagctcaccttcgcttacaacgctgacggtggccacgagaccacctacaccgctgtggtgaactccatcaacaacacgcttggttccgaagtggctgccaccaacccgtacccgactttcaacgattaccgtaccgccgtgtccgatcgcaaggttcagggcgcattccgtagcggctggcagccggattatccgtccgccgaaaactacctggtggccaattacgcttccgccgccgctgatggcaatggttccaacgatggcgattacaagaattcggagttcgatgacctgtgctccaaggctgctgccgcacagaccaccgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttccaacgatggcgattacaagaattcggagttcgatgacctgtgctccaaggctgctgccgcacagaccaccgatgaggccaataagctgtatcagcaggctcaggaagtgctgctcaacgatctcccggccgttccgctgtactacgccaacgcctacggtgtggctgctaccggcgtttccggtttcgaaatgaactggcagaacctgccggtctacgagaacatgaccaagtccggcaagtgagccgatcttcgtgagtgaatctcgctgagccaattgcaggaaggggcggatcatatccgttccttcctttccatgtaatacgcaccgtttcagggtgacatcagtgtggccaagaggcgtcaggggtagatgccggtagccaagcatttttcccagctgattcccatgaaactgcaatataaagcagtttgttgtgtgttgccacaaaacttgcggggtaaatcgttaaccttccccgatgattatgagtaataatctgaaaaaggttgacaatgaataagcaaaaaaggagaaaccaatgggcagatatcttctgcgacgcattctgcagatgatccctgtgattctcggcacgacgcttttggtgtacgccctggtgttcgcgttgccgggcgacccggttaaggcgatgtttggcgataagccggtcaatgaggccgtcgccgcgcagattcgtgccgaatacaatctggataaaccgttcatcgtgcagtatttgctgttcctgaaaaatgcgctgactcttgacttcggcaagactttctccggtcagctggtcatcgaccagatcggacgtgcattcccggtcaccatcaagcttgcgctgatggctttcgtgttcgaagccgtgttcggcgtgatcttcggcgcgatttccggcctgaacaagggcaagtggtgcgataccgtgatcctgattatctctctgttgctcatctccgtaccgaccttcgtcacgggcttccttgcccagtatttcttaggcgtgaagttgcgtctgcttccagttacggccggtgccaatccaggattcatcgacctgctgatgccagcaatggtgcttggatctgtgtctatggcatatatcatccgattgagtcgttcggagatttcttccaatatcgcgcttgactatgtgcgcaccgcacgtgccaaaggcatggacaacaggtcggtcatgaatcgtcacgttttgcgtaactccatgattcctgtcgtcacttaccttggtcaggatcttggcgcactgatgggcggtgccatgatttccgaaaccatcttcaacgtgcatggcattggttacctgacttatcaaagcattctcaagggtgaaggcaatctggtggtgtccattgtgactctgcttatgctgatcttcgcagtgtgcaacctgctggtcgatatgctctatgcggcgcttgatccgcgaatccgctacgcgtgagttgggaggattgaacaatgactgatatgaacgagacgaatctttctcacgcgcttccgggacaggaacgatatgttgctcctctcgaggagacgccgcttaaggacgttgactcggtagatgagtccgcaccggcttcaagcctttgggctgacgcatggcgtaccctgcgcaagaacccgatgttcatcatttccgctgtgcttattgtgttcattatcttcgtggcgctgttcccaggagtgatgaccaagcagaatccgaactactgcacgcttgagaactccttggaaccggcttcgaagggacatcctttcggattcgatctgcaaggctgcgatgtgtactcccgcgtggtgcatggtactcgtacctcgctgagcgtcggcgtgttcgctacggtgctggtggtgctgttgggtacgctgatcggtgcgttgagcggtttcttcggaggctgggtcgacaccattctcagccgtttgaccgatattttcctggctttgccgattttgcttggtgccatcgtggtgctgcagatgttcaagaccaacgattccatttggaagattattctggtcatgacgttattcggctggacatccgttgcgcgaattgcgagaggcgctgttatggaagctaagaatctggagttcaatacggcttccaccgcacttggctccacgccgtggcgtaacctgttccgccacattctgccgaattccttggcaccgatcattgtggtgggcacaacgtctctggctacatacatcgtgttggaagcaacattgagcttccttggtgtgggtctgccgaccactaccgtcagctggggtggcgacatctccaatgcgcagtccattctgcgtaccgatccgatggtgctgttctacccgtccgcggcacttgccatcactgtgcttgccttcatcatgatgggtgacgccgtgaaggatgcgcttgatccgaagagccgtacgtgagtgtaagtgagggatattcgatgactgaaatgaataccgaaaacaagctcgaggccatgcaacgtgccaacggtccgctgctggaagtcaagaacctccaggtcgacttcaccactgatgatggtcagccggtacatgcggttcgcaactcctctttcagcgtatacccgggtcagtgggtggctatcgttggtgagtccggctccggcaagtccacgtccgctatggcggtgcttggtctgcttccgggcacgggccatgtggtcggaggatccatcaagcttgacggcgaggaaatctccggttacaagcagagggatttcgacaagttgcgcggcaacaagatgggtcttgtcccgcaggatccgatgagcaacctgaacccggtgtggcgtatcggtacccaggtgaaggaggctctggccgccaacaatatggatatcgcccatgagaagcgttcctcgctgtcgaaggctctcgccgatgccgatgtcgaacttaaaggcaacgacgatgaaactttccttggctccaaggagcttcctgagctgttgtccgcggcgaaggaagcgctgtccaagatcggtaagaccggcgacgacttcgacaagaccgtggcgtacttcgagtcggagtgggtcccaggatctgaaacgcgttggcgcgtggccgacgacctgatcaaggtcggcgtggccgaggatgacgcttggtacatcgccaagaagtatgtaatcggctccaccatggatgaccgcatcgcaggtcttctttctgaggctggtctgccggatgccgccactcgtgcacgccagtatccgcacgagttctccggtggtatgcgccagcgtgcgctcatcgccatcggcttggcatgccgtccggaactgctgatcgctgacgagccgacctccgcgcttgacgtgaccgtgcagaagaagattcttgatcatctccagatgctcaccgattcgttgggaaccgcagtgctgttcatcacccatgacttgggtttggcggctgagcgtgcgcagcacatcgtggttatgtacaaggggcaggtcgttgaatccggcccgtctctggaagtgctgcagcatccgcagcatccatacaccaagcgactggtggcggcggcgccgtcgttggcctcgcagcgcatcatctccgtcaaggagcatggtggcgatgccagcggcgtgatggaacacaaggtgaatgaagattccctgaagtccggcgaatccatcatcacggtggatcatctgacacgcgagttcaagctgccgcgcaagaaggagatgttcaaggccgttgacgatgtgagcttttccgtcaagaagggtaccacgctggcaattgtgggcgagtccggttccggcaagtccacggtggccaacatggtgctgaagctgcttgaaccgacctcaggcaccgtcacttatgaaggcaaggacatttccggcttccaaggcaaggaattgcttgacttccgccgccacgtgcagccggtgttccagaatccgtatggctcgcttgacccgatgtactccatttaccgttccatcgaagaaccactgcgtatccacggcattggagacaagaagagtcgtgctgcccgcgtgcgtgagttgctcgatatggtggaactgccgtggtccgtgcgtttccgctacccgaacgagctttccggtggtcagcgtcagcgcatcgccatcgcacgagccatggctctcgatccggacgtgattgtctgcgacgaggccgtatccgctttggacgtgctggtgcaggatcaggtgttgcgattgctcaatgacctgcagacggaaaagggcctgagctacctgttcatcacccacgatttggcggttgtgcgtcagatcgccgatgaggttgtggtgatgcagcacggcaagcttgtggagcacgccaccactgacgaggtcttcgaccatccgcagaagcagtacacccgtgatctgcttggcgccatccccggcggcaagctgcagctcggtcttgactgatttgatgcgataacatcatcaagataagccttcggcatgtgccgagggcttttcttgtatgcaagctaggctagaacgctatgacgatcactatcacgacttccaatgtgaacggaatccgagcggcaaaacgcaaaggcatcgaggagtgggccggacgcaacacacctgacgtgtggtgtatgcaggaggtgcgtgccccgcaaaacgaaatcgatcctattttcgacgaattcggtttcgaatactcaacggcgggacgtatttccgatcagagcgaactgcatcgtatgaacgagatttgccgtatcaaggggcgtgccggcgtaggtctgttgtcggcattgccggttgtcgacaaacgatatggattgccgggacttgaggatgacgtcgattccggccgttggatcgaagcggacatgcaaactccacaaggctatgtcattaccgtggtttgcgtgtatgtgcatgcgggaaataccgatgatccggaaaaaatgaagcagaaataccgtttcctcgacaccatgctgatacgcatggaacagttgcgtgacgaggcagcacacggcggaaaacaagcggtgctctgcggtgatttcaacatcgcgcacacgccgctcgacatcaaaaacgccaaagccaacgaaacgcatgccggattcctccccgaggagcgcgcatatgtcgacaaatggttgggagaactggagtttgtggatgtgatgcgtaatctcgccggagacatccaaggaccgtacacatggtggagccagcgcggtcgtgcattcgacaacaatgtcggctggaggatcgactatcagttcgcaacaccggaactggcggaaacggcctgcggattcgtgatcgataaggctccgacctacgacctgcgctggtccgatcatgcgccgctcagcattatgtatgacatttaagccactttttatcgtgaacagactgggaattggaatatcacaccccgattcccagcccatattaagcataggtgctaggctattcacggttgcaactgttatgaaatgaggaacatcatgggattgtttggattcggtaagaagaagcatcagagcaaggaagctcttgaagcggccgccggagaaaacgaagaggctgtcgacgcagctgaaaatgttgacgaagctcaggaagttgtggcgcttccggagccttccgctgaatacgagggccgcggtgacgagcatggtccgtgggatgtggaagatgagaacgttcccgactacgacgagtacctcgatatgggatcatattatctgccgttcctgaagggcattgaattgcgagtgaaggccaaccgtgccacccagcaggttcttggcaccaccatcacctacggttcctccagtgtggagattgaggcattcgcggcaccgaagacgctcggattgtgggatgacgttcgtgccgacctgattgaagccaacaaggacgcgaaggaagtcgaaggcgtattcggcaccgaactggcattgccggttaccgtcaagggtggacgcaaggtgcttacccgcatcgtaggcgtcgacggtccgcgttggatgttgcgcggcatcttctcaggcaaggctgccaccgatcctgagggtgaggaagcaaaggcattgaaccagttcttcgctgatattgtggtggaacgaggcgatgatccgttggcgccacgcgaccttattcccatgcatccgccggtcgctccggccgaacgcaaggctgcgaaggcagctgcggaagaggctgagcagaagactgagattcccggcaaaccgaagggtccattcgactccgaccagcaggttgaggtcaagaccacgctgtctcgtggaccgatgttctccgaagtgcgttgagccgcttgaaccgatagctaatacgtatggctgaaaccgaagcgagaaaacgaactggtcttggtgcgcttgccgacgccggtaatactgacgatttttccgtgatcgacgccatcggcggtccgagaggcgttattgaatcgatgctgccgggcgtcgtgttcgtggcactgttcgtcatcacgtccaatttgcaactgaccatcggcgtgtccgctgcgttggccgtgctgcaggtgatcgtgcgcctgtgccaacgacagtccgtcatgggagcggtatcaggcttgctggcagtaggtatctgcctgatctgggcatggaacagtcacgaggcacgtaactattacatgttcggatttctcaccaacgccttttacgttgttttgctgacgatttcactgctggtccgggtgcctggcttaggattggtcatcgagttcatccgaacgttaccgactgaacattttcgtgcctggcttgccgattggcgaggtgacaaggcgctcaatcgcgcctataccatcatcaccgcaatgtgggttggagtgttcgcgctgcgtctgatcgtgcaggtgccgctctatctcggcaatcacgtcggctggctgggaacggcgcgtctgctgatgggcattccgttctgggcgctcgcgatttgggtctcgtatctgatcgtggcgacgccaatgcaccgacataagatgatgcaggaagtttctgaagacgatgctgaggcagcacaaactaccgaaatgagggaagagcactgatggaatcgaccatccgcattgaacggtacgccgaccagggtcgttgcgtcggtcatattgacggacgtgttgtgttcgtgcgattcgcattgccgggcgaactggtccgtgtcgcattggacgagccgcatgatcgtgaggatcgcttctggacaggcgaagtggtggaagtactcgaagcgagcgaagaccgtactgatccaatatggtcgttagctggaccccttgccatgggcggtggtgtcggcggcgctgacttggtgcatgtgtcgcttgcagggcaactgaaatggaaagtcacgtcggtggccgaacagatggcaagactcggccacgtcgacgtggaagtgcccattgagcgtatgtcggaagacgatgcggagcgaggtttgcattggcgtactcgcatcgagatgattgctgatgctgatgggcgtccgtcgatgcaccgtcgaggcacgcatgtgcgcgttccgattgataccatgccgttggccagccgtacgttgctggaagtggccgaacgtgagcatgtgtgggaagggagcttcgaaccgggttcccagattcgtctatccgttccggaacctcgcgataatgcgccgatttcagacaattacgccgtgcttgtgaacggcgaggtggttgctggaagccgtgagcttacggaaaaggtgattgtcgccggccgtgaattcgaatacaacgtggatgcaggcggtttctggcagatgcataggcatgcgccgatcgctttgaccaaccatgtgatcgatttggtacgcggcgagcttgacggtgccaaatccgcatgtctgtgggatttgtattccggttcgggtctgttcacgctgccgttggccacgctgacggcggagcgcactcgcatgttgagcgtcgaaggcggcaaaactgcggtaaggaacgcgcaacgtaatttgaggcacattcatctgggtaatgtcgatgcgcgtgtgggcgacgtggcgaaaacacttgccaacgtgcgcaatgatctcgccaagccagatgtggtggtgcttgatccgccccgtgctggcgctcgcgcgaaggtgtgcaggcagattgccgaagccgaagcgaaaagtgtggtctatatcgcatgcgatccggcaagccttgccagagataccgccacgctcgtgttacttggctacgaattggcggatatccgcgcgttcgacatttatcccatgacccatcatgtggagactgtggcgctgttcagaaagcacgaacagtgagcatgccgttattcgcaagtcgtgcgttttttggaatgactgcgattgcgttgtcttgcgcggcgctatctggttgcgtgccgtcgaatgccgcggtgggggatacgcaatctcccaatactgcggtggcgcactccatggaggatcgtgacagcctgtccatcgccatgattggatcggatgatgtcaccgccgattccatggcaatggatgccatggaagccggtaaactcaagccggtgtacattaccgtctcgggcactgtggacgcgcaatccaccgcgcagcaaggcgtgcgtgacatggcgcaacgcaaggccgacctcattatcatcgcaggaatcgacgcgaacgaagccaatgccgaaaactggaatgatgctttggaaaccgcaagaacagcgggcgttccagtggtgcttctcaatcctatcgccgtgccgaaagacaacaaactgtatgcggctaccatgacggtcaacgatcgtatgaccgacgcgataccgctcgacgatgctgctgtggccgtggccaataatgatcctcacgaccgggaaatgctggtaaccacgattacccactgatatggttttgcaccatgtcggtatgaatgaccagcagttcgtcttttgatgaaataccctgaaaattccctgatttttacctgtgtttcacaagaagttgaccggaaaacgggagtgtgacggtagactggcaatcatgagcgaaagtcgaacaatgcccctcatcgaagagacggggctgacacaaggcgaagtgatcgccctcagggaaagcggattggacaatgtggtcaaggcatcgacctcatgttcgcttatcgatatcgtgcgagccaacgtgttcaccttgttcaacggcatcatctttgcggccatggttatggtattgatcactggatcgtggagagacgcggtgttcggcatgatcatcatcatcaataccggcataggcatctgcaccgaattgaaagccaagcgtactcttgacaaactgtcgattctggtggcttccgactatcttgtgcaccgcgacggcaaagacgttgaaataccgcacaacgatatcgtgctcggtgatttcatgtggatccgttccggcgaacaggtgcccgcggacgcgcagatcgtgcacacttggggactggagctggacgaatccatgcttaccggcgaatcacggaccgtacgcaagggcgaaggctgcgatattttctctggatccaccgccatctccggcatggcgttggtgaaagtcaccgccgtaggagagcacagttacgcggccaaacttaccgcacgggcgaaggtttacaggaaaaccgtatccgacctaaacaagggcatcaacacgattctgaaattcatgaccttcctggtggtgccgctctgcgtactgctcatctggtcgcaggtacgcactgttggcggctggaatgtggccatttcgaccggcgaatggcgttccgcggtcatttccgcagtggccggtgtggtcggtatgatcccggaaggcctggtgctgctcacctcgctgaatttcgcgctcgcagccattcgtttggcacgtaagaacacgctggtgcaggagctggaatccgtggagactctcgctcgtgtggattgcctgaaccttgacaaaaccggtactgtcaccgacggcaccatccgactcgattcgttggaattgctgggtgttcgtggccccgacgacatgcgaggcaccgtgaacgagcatgacgtcagacaggctctattcgacctatcgaacgaaggacagcccaacggtacagggcaagcgattctgtctggactacgggaacagggatttgcggacggcactgtcgaggcacgagtaccgttctcgtcggcgcgcaagtggagttcgatctatgacggcaatgcagtgtggacgatgggtgcgccggaagtcattctttcccaaatcaacggcgaccatgccgacatactcaaacaagtcaatgatctcgccaatgacggcaaccgtgtgctgctggtcgcgcgaatctacggtgcagcgcccgacgattacgaaaccgatccaaaactcaatccggcatcgtgccctgtcgcattggtgtgctgttccgaacatattcgcgccgacgccgaagaaacgcttgcatggttccgtgaacaaggcgtgcgttgccgcatcatctctggtgacaatcccgtaaccgtcggcgcgatcgcaagaaaagtgcatctgaccggcgaacatgaaccacgattcatggacgcgcgtgagctgcccgctgacattacggagctggcgcaagtactggaaaacgtggatgtgcttgggcgtgtgctgcccgatcagaaaaaggcgatcgtggaggcattgcatgcaggtgagcatgtggtggcgatgaccggcgacggcgtgaacgacgcgctcgccatcaaagaggccgatctgggtattgcgatgggcaatgctgcgcccgccaccaaggccgtggcacaggtggtgcttgtcgattcgaagttctcacatctgcccgatgtggtggcgcgagggcgtcaggttatggccaatatggaacgtgtggcaagcctattcctcgtgaaaaccgtgtattccgcactgatttcgttgggtgtgatgctgacgcagataccattcccgtatctgcctcgccacatcacatatgtgggtggattgacgattggcatgccggcattcattcttgcgttggctccgaacacgcgtcgttatattccaggattcctgaaacgcgtgctgcattttgctgtgccctgcggtgtggcggtcggattgtcgattttgtccacgtcgtggctgctgccgatattcatgaagtggaatgtgcaggattcgggtgcgcagttggcgatgctgcgtggcgtcaacgcgattattctgctcatgatgggagtgttcgtgcttgcgcgggtggcaaagccgttgcattcgtggcgtggcatattggtattggcctttgccgcaattggattcgggggcatgctcgtaaaaccggtggcgaatttcttcgcgctggtggtgccgaccgggcagatgctggctgcgacggcggtggcaatggtgctttcggcactcgtgttcttgatgtgtttgcgtttggtgccgaaaattccgagtattgtcccatactttaagaagacacgccagagctgaattaacttggctgtatcgtaggcgacgaataatcagctgtgttatacagccaaaaagctcggaggtagcatgtctgtgcgcgacgaccagctcgacaccctgaaggtggacggcaaggattatgaatattaccgcatcgcagatctgccgggcatcgatcatctgccgtattcgttgaaggttctcgtcgagaacctggtacgtaacatcgatggcgccaacatcacggatgatcatgtcaaggcactgttggattgggatccggctgcacagccgagtcatgagatccagttcaccccgtcccgcgtggtcatgcaggatttcaccggcgtgccctgcattgtggatcttgccaccatgcgtgatgcggtcaaggatcttgggggagatcctgaggtcatcaacccgcaggtgcagtccgacatggtcatcgaccattccgtacagatcgacaagtacggcatcgccgacgcggtcgaacagaacatggacatcgaataccagcgcaacggcgaacgttaccagttcctgcgttggggtcagcaggcattcaagaacttccgcgtggtaccgccgggaacgggcatcatccaccaggtcaatatcgaatatctcgccaaggtcatcatgaccaaggtcgaagaaaacggtggcaagactcttgcctatcttgattcctgcgtgggcaccgactcgcacaccaccaccgtcaatggcttgggcgtgctcggttggggcgttggcggcattgaagccgaagcggccatgcttggacagccgatctccatgctggtgccgcgtgttgtcggtttcaagcttaccggttccattcctgaaggcgtcaccgccaccgacgtggtgctgaccatcaccgatatgcttcgccagcatggtgtggtcggcaaattcgtggaattctacggtgatggcatcgcctcggtgccgctggccaaccgtgccaccatcggcaacatgggtccggaattcggctccacctgcggcattttcccaatcgacggcgtcactctcgactatctgcgcttgaccggccgttccgaagaacagatcgcattggtcgaagcgtatgccaaggcgaacaagctgtggggcgacaccaccgatccaaactacgtcgaaccgcagtattccgaatacctggaactcgacctcggtactgtcgtgccgtcgatcgctggcccgaagcgcccgcaggatcgcatcaaactgtctgaatccaaagcgaaattcgtcgaaaccttgcccgcgtacgaaacggacaagaccgtgcaggagccggttgccgtttccaccgacttccgcggtgacttcgacatcaccaacggtgatgtggcgatcgcatccatcacctcgtgcacaaacacatccaatccgtccgtgatgatcgcagccggtttgattgcacgcaacgcgcatgccaagggtttgaagcccaagccgtgggtcaagacctcgctcgcaccgggctcccaggttgtggccgactatcttaaggcggctggcttgcaggacgatctcgacgcgctcggttaccagctggtcggtttcggctgcgccacctgcatcggcaactccggtccgctgctgccggaaatctccgaagccatcaacgccaacgatctgaccgtcacctcagtgctgtcgggcaaccgcaacttcgaaggccgcatcagcccggacgtcaagatgaactacctggcatctccgccgctcgtcatcgcttatgcgctcgctggcaccatggatttcgattttgaaacccagccgcttggcaaggattcggacggcaatgatgtgtatctgaaggatatctggcccaccaatggcgaggttgccgccgtggtggacggtaccgtcagccgtgagatgttcctgaaggattacgcttccgtattcgaaggcgaccgtcgttggaaaggacttgacgttccagaaggcgaactgttcgcatggaatgaggattccacctacgtgcgtaagcagacgttcttcgatggcatgaaggccacaccggatcccgtcgaagacattcatggcgcccgcgtgctcgcactgctcggtgattccgtgaccaccgaccatatttctccagccggcgcgttcaaggcttccagtcctgctggcaagtacctgaccgaccgtggcgtcgaaccgaagaacttcaactcctatggttcccgtcgaggcaatcatgaggtcatggtacgtggcacgttcggcaatatccgactgcgcaaccagttgcttgcgtccgtaggagaagaggtcactccgggcggtttcacctacgatttcctcgaccagaagccgaccacgatcttcgaagcatcccgcgactacatcgaacatgatgttccgctggtggtgctcgcaggcaaagaatacggcaccggttcctcccgcgactgggctgccaagggaaccgtcatgctcggcgtcaaagccgttatcaccgaaagcttcgaacgtatccaccgttcgaacctgatcggcatgggtgtgctgccgttgcagttccccgcaggcgactcctatgagagcctcggccttgatggcaccgaaacgtacgatatcgccggcgttgaagaattcaacaatggcatcaccccgaagaccgtgcgtgtcaccgccacccatagcgacggttccacaaccgaattcgacgcggtcgtacgcatcgacaccccaggcgaggccgactactaccgcaacgggggcatcctccagtatgtgctgcgcaatctcatgaaataaataatcacatgattgagatcggcaagtgacaaagcccgtgtcgcactgtgcaatgcagtatgacacgggctttgtcgataccggtttttcatgcgtttgatactacgtcggaatcggtctgtctcgtcacattgttgacccaacgatactttcgataatgcagcaaagcaggaatcatcttgatgcattcgtcggtattcagcaaagcatagaccgccaataccggcaacttccacacgaaagccgccaacagaccgaccggtacgacgacaagccacataacgctcgcatcgcagacaagtccgaaccgggaatcgcctccggcagggaaaataccggcgatagtcagattggccatgcacccgcatgccgcataataggcgcagataaacagcataaccgacagataacgcgtggcctgcggcgtcaatcccgcccactgcaacgccaaaggacgtgccgcgataatcaacaggccggttccaacgccaactgccgccaccagtacacagagcctgtcgcccataaccttcgcctgatcgaaagcattgcggccaagcagattaccgacaagaatgccgcccgcattgccaaggccaagactcaaacagaccaacagatccttgacgatattcgcaatggaattggccgccaccgcatccgtaccaagatgacccataatcacggtgtacatggtgaaaccgcagccccaaaccagctcattgccaagcacgggcagactatacttccaaaaatccttctgcaacgccacatccggatgcaacatcatcgacaaccgcaaacgtgggcggccattgcggctggctacaagcacagaccacaccagttcgatggctcgggaaatcaccgtggaaatcgccgcgccgaaaatacccaatgcgggtaaaccgaaccaaccatagatcagcaccgcgttcagcgcaacatgcacgatcacgccaaccgtgcttaccgtcattccggtaaccgccgcacccacattcttcatcagacacaaatacatttgcgacaaaccgatgaacaggtacgaaaccgacgaaacccgcaaatactgtgagccgatggcaatcagcgtcgcatcgttcgtcataatcgacatcaacgtttccggaatgagtagcgtcaatgcgaaaaacaccagcgacaatccgccggcatacagcatgatgaacgccaagacacgttcgacggcattcgtgttgcccgcaccccaatactgggccaccagaatgctcatgccaagcgtgagcgcggcaagacacaaactgaaaatgaactggaactgcgtggcaagagacactgccgacagctcgttttgaccgacgttcgtcagcataagagtgtcggcgcacgatgacagcgccagcatcagttgttgaaacgcgatgggcagggcgagcgtcaacgtctgtcgaagaaactcgcgccaagtgatggaagattgcatgatgatgtgaggatggtgcggtgcgttttactgaatcgaatccttccaagcgtgatattccgctgccttgccttcccaatattcgcggtcggcgtcggtgatctcacggatcacatggcatggattgccgactgccaccgaatgcgaaggaatgtccttgaccaccactgatccggcaccgatcaccacatcatcgccgatggtgacgccagggccgaccaccacattgccgccgaaccagacatcgttgccaatggtgatcggacgagcgccttcagggccggaggaacgcaccgtcgcatcgatcggatgatacggcgtgtacaggcccactcgggggccgaagaacacgcggtcgccgatggtgatgcgtgccacgtcaaggaaaatgcaatccatgttggcatagaaattcttgccgatgaacgtgttgcatccataatcgcagttgaatgggggttccacgaatccaccctctccaaatgcgccgaacagttcgtgaaacagttcgtcacgttctttgaacgcgtcatattcggacgtgttgatggcctgcaccaggcgacgcttgcgcatattcgcttcctgctgttgcggactatcggccacatacagttcgccggagagcatacgctcccattcgtcgcgtgccggatgattggtggggtccaccatgctgcctcctctgctgtattacgtcaatcgattgacgtgacatatcatgttccattcaacggcatcattattcgttgacactgtatttcgttgtattatcgttcttgattttcgtattatttaccgtatccactgatggggtattgcatgggacagatgggattagacgttcgtgacgtgcaggtcggacaaaacgaacaaacggaacagcctgaacttgcgcaagacggtcgtcttccatatgagttcatgccggtcaccaactggggacgcaagcccaacggcgcggaaatggtgcaatatgatgcgccgatgttcttctcattcaccgaacattcgctgctgcatcagtatccgaacatgcgcgcggaatgccattggcatatcgatttcgaattcacccacatcatccgtggacacatgtggtatttcgtgaacggcgaaagcattcgtcttgaagaaggccaaggcattttcgtgaattcgcgccaattgcattacggtttcaccgaggacggcaccgattgcgaattttcctgcactctgctgaacccttcatgcatgtgcatgccgaacatggtttatgaacgctttgtggctccgttgatggcggacgaacggctcccgtacatggtgtgtgatcctgaagatgagcatggatccgcgttgctggaatgcatgatgcggctgcatgatgcgaaattcggtcagatgccggctgcccagaccatgcatcccgccaccgttgacaatatgaaattaaaggatgatacggcatcgttgaccgtgctcagctgtttttatacgatggtgcgtgaactgacggccatagcgggcgaacatggcaagaatggttcttccaaatacgacaggaagaatccgaagattgctattttgagcaagatgattgattacgtgcagcacaattacgttcgacagatcaccctggaggagattgcttcagcagggtccgtcggccgtacgaaatgcgcgcagatcttccatgagatggtcgatcagacgccgattgaattcgtcaatgacgtgcgtatgagagctggagcggaaatgctggacaccacatcgatgccggtttccgacatcgccaaaaaacttggtttctcatcatcgacattcttcacgcgcacgttcaagcagtacatgcatacgacgcccacagcctaccggaggaatatgctcaagtagaccgtggacgtcgtatgcgatcgtcatgcggctgccacagtgttggcgtcgactacttggccaactgcgttgtggcgggggaggccaacgtcgggcgggctcgccgaatgcgtcccaaggccaagcccagacagatgaacgctaccgcgaacattgccaccaatccggttgatgacgcccacgcgccgtagtccacgccgctcgaggaggccgtacccagtccgaatacgtggtctatcgatgagcagagccaccatccaggcagcagttttccgatgatgatcatgggatctggcatcatatccacggggaacgccataccggaagtgaacatgaccagcagagcgaacacattgacgaaaccgttcgttgccatttcattgaaaccggatgaccccaacaggaatccgcaagcgatcgccataagcgtgtagaccatcagcgacacgaacgacaagcctacgttcacggcattcaggccggtaaaggacactccggccagcgccatcaacaggaatgtcaccgcggtatacgcagcacataccagcagaccgaacgtcccgcatgtcagcatttgctgcgcttccaacgacaccagacgcgcgggggacgagtagagcctgcggcggatttcgttgtcgttgaatgtgctgaccacgaggaacgtgcataccggcatgaccagcaacagtggatacaagccggttttgagcgtgcccgcgaatgccgatgagcccggtgtggtgccgtcgtcttcagagtccgaggacaccacggcgatatgcgactgtttcatatcggcggtggcagcatccaacgtcgttgtcatggcggcgtcgagcgtgcgctgtgcctgcggcatgccgagataggcggtacgcgtcagcgaaagaaactcgttgactttcagctgtgcgagcgatccggctccggaagcataactgacgacggtatctatggtcggttgcgtagccgtggcgttatccgcatactgcagataacgctcggcgaaaccttgtggcacaatcgcaatcaaatcaacataattcgatgcgacagcctgctgcaacgatatggaatcgtcatcaatggtgaccatctcaccgtccaaagcgaggtaggaacgcaacgattgagccacatgctcggcgtcgtcatcacggtcgattaccgcaatacgggcggattccggctcatacgtcgtcgctccggcagctgtggagccacgcatgatctgccagctgatggaaaacatcatcgtgccgatcagcaccaagtagataatcacatacaatttgcgcgctttgagaatacgcagtgctgctttacaagtgttcatagcgttgcctcctcaacagaacggtcgccataccaagacagaccaagctcatcgcagccaatacgcccaccgtggcaaagaacgggcggaaactgtcgtaatacagaatgtcgtagaacagattcgtaatctgttgcgccggattcaacatgctcaacaggggcgcatgctgcgctatctgatcgcttaaatccatggcgaacgagccatacaaaccggaaaacagcgacagcgtgcatgccaaggccgtgcacaatccctgcttggcactcgtggaaacaccctgtattgcgccgatcaacgtgccgaacgcgcttgtggcgaatgacgccatcaagcacgcgcccaagccggcccattcacgaccgccgagagaaatctggcagccgaaacgaatgtacagcatggccacggtcagacttaggaacgagcagatccaactggaaagaaaacctgccagcagctgttgcagtttcggcaggggagcgacggaacggcgaatgccaagtgccgacaggtttgcctgggccaacgataccgcgttcaccgcgaaactcatggccatcatcgcggccatgccgagcaacgcgtaatagtagcgtgcggtgccgcttggcttgaaattcgtcagctgcacttccttcgtgaacccactcgacgagccgatgctgccggtgaacgcgtcatccaacaacgcggacggattgtgctgcgcggcattgaccaccacggcggtgttgcgattgtacaagtccacgatattgcccaacaccgtcagggaaatatccagaccactgctcgacgccatcacatccgtggcggatgtttgcgtggcttgggaaatggccagctgcagtttcccactaccgtcgacggacagtctgccctgcgccttggcgtcaagcagtgctcgatccgcggcttccatagatgcggcttccgtgacggtgatgagtttcggcatggcgtcaccgtcatcatcgaccttcgcatgatcgccatcggcaccggtcgcgccagtatcggacgaaatgccgtcgaccagcatctgcgcgcccggagaggcgcgccaatcgtcgttattaaccacgacgacgtcaaccgtgtgcaatgcgtaactttccgcgatattgccgaacatgccattgaacatggtcgccagaatgatgggaaaggcaaacagccagaacagctgcgctttctccctgaaatgcaatttcagattgaccagcaatgtctgcaacataatgtcaaacctttcgaaccatgattccgtcagtcacgcaacgccgtgccggtcagttcaaggaacacatcgttcagcgtcggctgccgggaggaaagatgcccgatattcgtgccattggatttcagcaacgtcaacacgtcaagaagattgtgatcgccccgacggcaacgtaccgtcaactcatgaccgtcataatcggcgctcatcacacatggcagcgcacgtaactgttccaatgcctgctgcgttcccgcctcatgatgcaagccacccagatcgtcggtttccacactgatgcgttcgccggtgtcgatcatcgccttcaactcgtcggcggtgcccaaggccaaatgcctgccatgatccatgatgagaatgcggtcgcagatctgctcgacctcctccatgtaatggctcgtgtaaatcactgtcgcgccttcgtggttaagacgctgaatgccctccagaatcgcattgcggctttgcggatcgacggcgacggtcggctcatcgaagaaaatcagatccggcttatgcgccacaccgcatgcgatgttcaatcgacgaagcaaacctcccgacaatttcgacggacggaacctgcggtaatcgcgcaagcccacaaaatccagcgcatcctcaaccagcgcatgacggcgtgccctgtcaggcacatacagcgagcagaaataatcgatattctcctcaaccgtcaattcattgaacacagccacattctgcggtacgatgccgatgcggcgtttcagcgcataactggtcgggccaatcggttcgtcaaacacacgtaccgtgccctcatcgaacgtcaacaatgcgagaatgcagttaatcgccgtggtcttgccggaaccgttcggtccaagcaaaccgaaaatctcaccttgatgcacgtcaagatcgaaatagtcaagcgccagcatatccccataccgtttgaccagcttcgacaccttgaccgcgctgctggagctctcacctgtttgcctttccatacgctcgctcatcggctctccttacctcacatgttccaacagcgataaccgccgtttacgatagtgattccattgtctccgaccaaacggagacgacatggtgtctgagatcataaacctggcgcaacacagccatatggaagatgacaaatgtcaccttcgtggcaaagatggcccgcaacggcggcaacgtacactacgctgggaagacataaccacaagaagcggcgacgatggaggaaggcatgcggcgattattgcttcaggccatattcctcacgttcgggctgatcgcaaacctgtatatcgtcggagacgtatcggctgaactggtatgcggcgcgttgctggccatatgctgtgccgcggtgggggaatacgcgcgctcgtcggcatggaccatcgccatactgttgatgttggattgcggcgcatgcttcacgccatcatggtgcgcgatgatgccggtcgccgcatacaacgcggccatgctgcccgccatatcacagaacgtcgaacaacaccgtgcgggacggaaccatgccggcttgcgttcgcaattgccgaacatgccgcaatacgatgcgatgcaaatcacgacggtcatcgcacgatgggtgtggatcattcccgtagtggcgaccttggtccgttgccgtaatgcaggcgcgcatgcggatgatatgggagctgcactcatcgccgtactgctggcattgcatgtagtgttgggattcatggttggcctgttgtgcgcgcgcaatgtcacgctcacccggcagaacaggcggcttcaggattccaaacgtgaccagatccgccggctgcgctcgcaattggcggaaagcgaggaagatcgcgccgcgtcggttcgtgtggccacgctcgcggagcgtacacgcatagcgcgcgagattcatgacaatgtcggccatatgcttacccgggccatcatgcagtccgaagcggcccaagtggtggctcaggtttctggtcaggagccggcggctcaagggttcgcgcagattcacgacacggtgggcgaggcgatgacattggtgcggggcgcggtgcatgatctgaaagacgaaggcacggatttcgtggcgcagattgaggcatccgcgcatggtttggacgattccagtacagtgaacgtcaccttgagcaacggcatcgatgcggctccggccgcggtgtcacgctgtttcgccacgacgattcgcgaggcgttgaacaatacgattcgccatagcatggcgcgcaatgtcgatatcaccttgcgtgattttcctgcgttatggcagctgcgcatacaggatgatggcgccctgtggaacgatggctcccaaggaaacatcaacggtatgatgggggagtcttccgctcgttttcgtcagttccatgatgccgcgcgtacggcgacgatgcgtgatgcttcgggcattggattggcggatatcgaggagcgtgcgcgggcgctcggcggtaccgcggtgtgcggcccgtatcatgaggggtggcgggtgttcgtgtccattcccaaaacggacgatgatgcggcagcgtccgcaacaacgaaggagaacgtatgatgcgagtcgcaatcgtcgatgatgatccaatcgtatgctcgtcgctgtccacgattctcaaagcgacaggcacggccgatattgcatggacggcctatgatggcgaaaccgcggtaggtcagtatgaagaagataatccggacgtgctgctgatcgacgtgcaaatgccggttatggacggtcttgccgcgtcgcgaaagatcatcgacgcccatccgaatgcgaaaatcctgatacttaccacattcgcggacgaatcgtacatcgccgaggcgttggaaatcggcaccaaaggctatctgatcaaacaggatgtctcatcggtgattcccgcagtgcagtcggtgatggccggacaggtggttatgggagcgcaggtgttgcggaaactgcatgtcaataaagcgagtcagacgcagcgtcacgtttcgcaagctggcgataacggggaaaatcgtttttccggtcgtttcgcgaatctcactgagcgcgagcgggacgtgatgcaactggtcgccgaggggtacgacaatcgtgagatcgctgcgaaactgtttttaagcgaaggcacggttcgcaatcgtatcagcgatattctcgcgaaaacgaacgttacgaatcgtacgaaacttgcggtcgaatggctcgcatgccaataggaaaccgtcgataaacggcaaactcatcaaaacgaacaacgttttcagcgcttgcgtaggcgataggccttccacacgtcgctaagcttctgaccgttcgacgtgcgcttccacacggtcaatcccgccgaaccgccaccgacggcacgggccgctgcggttggtgtggagtactcgctgccgtcatccagtcgaagcttgccttcggcggtgacggtagccacccaacgttcgcccttgcgcggtcggtcccataccagcgtctcaccgggaatgagcagaccagcggcgagcacctgcgcgatggacacgcgtttggatgttggggaggtggacgtgtccgtgactcgcaacgactcctcactgagcgtggataggtcattgcgctcggcatcgtaacggatattccaataatcggcgatcagacgaatggtttcatcctggcggtattgcaaggtttgtggcgtacagtccgcaatgtcggcaagctcggcggtgagcgggaagcgtttggaactcgccgacagcagcatacggtcacgacggtccgtataggatgccaatcccgcgatctgcttgtcattagcctgactgagcgcaagattgccgatgcggttgacccaatggtcgcgcgtcgcctcagaccatgatgcaaacgatgagtcggaggcgacctgttccggcatgatcggcagcgcgttgaggctgcgtggtcgggcgatacgatgcccggcccgctgctcgttggcccgaaccagaagcagtttcttcatggcgggactggtctgcaggtcgccacgcagatgcgcgagcgcgttgcggcggtcttcgtcggtgatgagtaatcctcggatttgttggatggtgtggtttttatcgaggtcgcgaatggtgctggctgcgcgtgtgcgtcggttgagcggggtttgcctgttgagactgtccacgccggttacgcgttctagggccgcgagtacgtcgtgaagtcgttcaaggtcgtggagttgaggttcctcgaggtttttgttcgacgtgcgcgaggctgcggcagtgtgtgtgcccggcgtggagaatatgcgtgtgtcgggattgccgaggttgcgtatggagttgacgagcgcccacatggctactggtttccagtcggtggtttggtagtcgttgagggatacgagttggccaatgatatcgtctggcaggttggcgtcggtcgggtgttcgatgatgcgccaggcgttggcgtagggtgcgagcaggtcgtcgatgaaggagatgacgttctgctttttgacgaatggtttgagcacgtccttgcggaattcctcaagtagttgtgtgcagatggctttgtgcgagatgatgagatggatgtcgctgaagaattcttcgagcgtctgtgcgtcgtcgccgagtggatccatgatgtcgtcccagcgtgaagcgtaggcgttgcgtgcggcgggggagatttcggcgatagttcttgctttgaacacgtcggatgcggtgaggggaactccgcgcatgttcatgacgtcgaaaatacggtgtgcgccggcgagatcgtcggtggttacgatgacgagggtgacttcgttgacgaggtatgatgcgaatgcgcggcggtcttgtgtgggcattttcgcgagttcgtcgaacacttgtctggtgttgatggcgatgttgcgttgcgcgtgcgattcgatatcgttgtcgcgcagatcgaacagtccctccagatcgccttcctgcacgtacatgcggaagaagttggtgtcgcgttcgcggagtttgagacgtggttcggctttgatgccgcgtagtttgtctcctggctcgacgatgaggtcgttgaggttttccacgagttcggggtcgtcttccagatcgcggagcacggaaatgatgatggaaagtgagatgaggcgttgctgtccatcgatgacttggtatttggtctgtccatcatggacgaggatcagcgatccaaggaaatacggcgtgtccgggtcgtggcatgcgtcctgcagatcggtgaccagttgcgcgatgttttccgtttgccaagtatatgcgcgttggaatgatgggattacgaaccggtaatccgaagtgaagattttgcctaaaggcttttccgttgcactgattgacatggcgttcccctcattgcgttgctctgtgttcaagtgtacgatgcatgatgtcatagtcgtggcggcaggtcggctcgttctaccaaacgggccatctgcacgcggcccatgcagagtttatctgcggcggatgaaatatgcgctttgaccgtgcgttctgaaatgaacattttctcgctgatttccgcattggtgaagccctcggccgcgagaatcaccgcttcgcgttcgcgttccggcaaggcgtcgagcatggcacgggcctcatcgcgccgcgactgaggctggtgttgatgcaaatcgccgatgagctgccgttgacttgccggattgaactgtggctccccttcgcacacgtcggccacacggcggatgatatcttccggagcgtccgttttcgatacgaatccttccgcgcccgcttcgatggcgcgttccaccgtgttgtttggactcagcgacgtcagaataagcacatgcggaggatcgggaagcatgcggagctgacgagtggcttcaatgccatccatgccgggcatggcgatatcagccagcacgacatcaggaggattgtgcgacgcatgttcgatggcgtctgctgcgttggtgcaggcgaaggcaacgctgatgcgtccggaggaataatcctccaaaatcagacgcatcatctggcagatcatcggatcatcatcaatcacgccgacggtgatcggctgctcgtcatggttgcgttcggtgctcacccaacccatggtagtcgtacatcaaggtggaagacgttatgttggtcaaaaccgtattggcatgttccgccagcctgctgtatgcgtttggccaaaccaggaagaccggcccccttcctggtgtctgccatatgcgagggggattgcggcatcgtcggattgctgacgtgcacatgcaccccttgcggggggttcgcatcgacctgcaacgacaccggagcgccaggcgcatgcctgcgcacattggtcaatccctcctgtaccacgtgatacgcaatcacgccgatggactcatctaactgccccagctgttgaacgtcgatccacgtatcaatccgcatattcgcggcacgggcgtcgccaatcaactgcagcaatgagtcacgggtcaacgacgcttcggcatcattcgcagccaactgcaggcgagcatcctccggatgacgaagcatgtcaatcacactatgcgcctcatccaacgcgccggaggcctgcctgcgaatatcctcggtagtgccggcgatctttccagccataccagccacattggcattgcccaactgctcggcctcagccttcaatttcctagactcggcctgcaaagcgctcgcattcaatgcaagcaacgacagcgaatgagccaacgtatcatgcgcttccgcggctatcgcatcggcaagctgctgattgtcaagcgtggtccgcaacctgctcacctgctcgttggccgactgagccttcgcttcggccacgcgcgcaagggcgcgcgagcgaatatgcaatccggccaatgtggcgatcgccaccgcaatcagggcaaccacaacggcgctcgcgatgatcgttctttcgtcgacaagcatcaccatggtattgccataccgaactccggtatatggtttggagaagatcgcatgccagatcgaagcctcggcaggatgcaaagcgtctcgcacctgggaccagatcgtcgttgtcgccgcggcaagcactgatcgaagcgtcactttggttccctgtctccgcgcaagcagagaagtcaacgccataagcgcgatcagcgaatcgtaggggagcgccaccaccagtaggcatgcggtccagaacacggcttgcgggtaactgttgcgagccagaagaatcaaacccgaagggatcgcaacgagcacgcacgcgatcatccacaagtagggggcactatcctgcgcatactgttgggatgcgaaagacacctgcgccagacaggcgaaactcgcgcacaccaccatcggcaccgtgcaccagattctggtgcgcactggcacttcggcggtggaagggtttgtgatcacgctcatgactcccattatcggcatactcatggaaacatgccattgagctatcgggcatgatggcgcaagccgcgcgccccaaagtgcaggcaggaatggactttcgtccaataccgggaacgaagccgatcccgtaggctcgaaagtgttccgaccacttcgagaagaaagaaaaagatcatgagtgagttcaacaatgctccgattcccaacggcggcccggcagcgccgaacggtatgagacccgcgccgatcatgccgtccccggctccgcaaggcacgacggtatgtggcatcgtgggagtggtgttcggcgcgctcggcttggtgctgagcttcattccaatcatcaacaacatcgctgcgatcttcggactcgtcggcgcggtattggcgatcgtggccatcgtgggcacgttccgaggcaaaaagcgtggcaaagccctgtccatagtcgcggcggtgctgtcggtgttggccatcgtcatcaccttggccatgcaatcggccgccagcaaggcgcttgacgacatcacgggcacaagcacgtcgcaatcctcgtcggcggacgccgataaggacgccaaaaccgatgattccaccaaaaccgatgattccaccaaaaccgacaccaaggtgaaaggcgagcaagacatggaaggcgatctcaccgatatgcacgtcaaaatcgtatccgcagtgcgttccggcaacgactacaacaatcagccgaccgtgctcgtcacctacgagtggaccaacactaccgataagaacaactccttcgccatgctggctaatccgaaagtgttccaaaacggtcaggaactcgacaccgccatgtacttggacaatccggaaggctacgattccggctcctatctgtctgaactgcagccaggagcaaccggcacggtaaccctcggatatgtgcttaaagacgattccgaaatcaccgtcgacgtgacgaaccttctcgatttcagcgacaccgccaaagtgacgtacaagttcgccatctgacatggcatgtcccagtctttcgcgtccggcacactccccgtgtcgaacgcgaaacctatgcgggctttgaagaaatcatgagattaagccaatattcatgaaatcgtcaggaaaatgccgtatcgtgatgcgcaatcgagcaaaaaggagcgattatggcattcggtcagcagccccagggtaacaacgcccagaataacggcttcaacaatcaataccagtacaaccaacagtacaaccagtacaatgcgcagccacagtacgcctatgcgcccaacggtaccgccgcagtcaacgtgcaggccacctattcctacgagcaggccgaacgcagttccgtcaacagcgcatacacgcacatgacccttggtttgatcgtcactgccgtggtcgccatcatcacccaaatgagcggcgcgtacctggcactcatccaaaccacgggcatcatcggcatcttcgcccccgccgtcattgaaatcgtgcttgccatctaccttggcgcgcgcatccatacaatgaaggtctccaccgcatacgtcatgttctacgtgtatgcggcgctcatgggcttcaccctcagcaccatcttcatggcctacgatcttggcaccatcggcatttccctcgcattgtgcgccggcttcttcttcgcgctcaccatgttcggacgcaccaccaagatcaacatgctcaaggccggccccatccttttcgtcggcctcatcgtgcttatcatcgccgaagtgattctcatgatcttcgcccccggcaacaccaccctcatgatcgtctctgccatcggacttctgctcttcgccggcatgaccgtctacgacgcccaagccacccgcgccatgcttgaacagtattccgcccaaggccccgaaatggtcaagaaggtttccatcctttgcgcactgaatctgtatttggatttcgtgaacatgttcatgtatattctccaactcctcggcaatcgcgactgaaatccaaatgacggagcgtccccggcattgctcctcagtcggcgtaccttcgtgcgccttccttcggtgcgttttggggacgcacgcgtcatttggctttcagcctttgatgggacattattggcattgctcctcggtcaacgtaacggataaagcctgaccagaatgtggccaggctttatccgttggtcaaagacatgctttacggtgggtgctcatgcagagaaaagagattggcggcatggcatgcctcgtactggcggccctcatttggggattcgcattcgtgtcgcaagtgcaaggcatggactccacaacaccgctgttcttcggagccacccgattcaccctcggatccatttctctgataccgttgctttggtttcgccgcagcaccatagcggaacaagagcgtaaacgccgtgaaacccagggaaaaccgtccatcaccctcggtaacggcgcaatcgtcgccatgccgaaatgggccggcaatcccatcgtggtcagcatcatctgcggaatcgtgcttttcaccgcaagcaccgtccaacaatacggcatcctttactccggatcggcgggacggtccggcttcatcaccgctctatacatcgtcatgacgccactgcttgccttcgtcatattgcgtcgacgagtgcacctcagcgtcatcatcagcgtcgccatctccgttatcggcttctacctgctgtgcgtcaccgacggattcggatccatcaccctggcggacatggtgctgctgttcaccgcagtcctcttcgccgggcacatcctcgtcatagacacctttggacgagacatggaccccatcctgctttcattcgggcagatcaccaccaccgcgatcatcagctggattggctctatcatcgaaggatccatcgactgggccggtgccgcgcaaagctggatcgccatcgtctacgcgggcgtctgctctgctggcgtagcctatacgcttcaggtcataggccaacaacttgtgcctccgaccagagcgtccgtgatcatgtcgctcgaatcgttcttctccgcagtcggaggggcgcttctgctgggcgaaatcatgaccactcgagcctacctcggctgcgcgctcattttcgcgggcaccatactcgcccagctgcccatcgaccagctcctgcatgcggccaaacgcaaaccggcagacgtcagccggccttaggggcctcgccaacctgcggcgcgccattgatatcgcgatgaatgttctgcatctgcgcttcgacattctgcagacttctcgcgcaatcaagcaacgtctgcgaatgctccgacagcttcgcgtcaggcaaatccgtcttataacgcagcgcatgctccaaactcgcccaataatccatggcgatggtgcggaactgcacctccacaggcgtgtaatgcggtccggaagatagaaaaacgggaaccgcataaatcacgtgcagcgaacgatatccattctgcttcggattcttaatataatccttcacacgcaacacctgaatatcgttctgcgcggacagataattcgacaccgaatacacgtcatcgcgataattgcagatcacgcgaatgcctgccacgtcaaacagattgtccttgaccgactccaccgtcaacggcagatccttgcgcctcaacttgccgagaatggaattgatggacttcaacctgcgttccatgtgatggatgggattatgggagaaacgcacctggaactcggaatcgagaatctccagtttggtgctgatctcatacatcgcgccctcatacacctgcatttgatcaatgaactcggtaatctgatcggaaggcaacggaccatcgtcgaaagtcaccgacttcagccgtgcttgcagttcactggtattgatgcggctctgtctatcaagtatcacggttccatagtgtacccaaaaggagcgcggaaaaactgaaaaagcgctgaaagcgccgtcatccctccaattccaccgcatgccacgctgcattaaggtgcatacggcgcgtgatgggaatccctgccgatagcatggaatgctatgaacgaagacatgatgaccgaggcggagcgcgcctcgaaacttgcggaacctgccacagaagacaccgccacgcgaggcaagggcgtgttctacgtacacaccctcggatgccagatgaacgtgcacgattccgaacgcatcgcgggtgtgctcgaagcggatggctatgtgcccgccaccgaagaacaatacctcgatcatgacgtggacctcatcgtcatgaacacatgcgcggtgcgagaaaacgcggcggaacgcatgtacggcaccatcggcctgtgggccgaactgaagcgccagcgtccgaacctgcagatcgcagtcggcggatgcatggcacagctcgaccgtgagaagatcgcaaaaaaggccccttgggtcgatgccgtgttcggtaccaagaacattggctccctgcctcagctgcttgaccaggcgcgcatcgaaggccatgcgcaggtcaaggtcaaagaggaactcaactacttcccaagccagctgcccaccgaccgcgcgtcgaaggtgtcaagctgggtggccatctccgtgggatgcaacaacacctgcacgttctgcatcgtgcctaccacccgaggcaaggaacatgatcgtcgcccgggagacattcttgccgaaatccgccagtgcgtggacgaaggagccaaggaagtcacgctactcggccagaacgtgaactcgttcggttacggcatcggcgaccgtttcgccttctccaagctactgcgcgcatgcggtgagatcgaaggattggagcgcgtgcggttcacttcgccgcatcccgccgccttcaccgacgacgtgatcgcagccatggccgaaacgcccaatgtcatgcaccagctgcacttcccgctgcagtccggatccgaccgaatcctgcgcgccatgcgccgttcgtatcgttccgcgaagttccttgacattctgcgtaaaatccgtgaggccatgccggatgcgcagatctccaccgacatcatcgtcggtttcccgggtgaaaccgaagaggacttccagaaaaccttgcgtgtggtggaagaggcgagattcgcgtccgcattcaccttcatctattcgccgcgcccaggcactccggcagccgaaatggagcaggtgccgcacgacgtggtccaagaccggttcgaacgactcgtggcattgcaggaacgcatcaccgaagaaaatctcaaaaccttcgaaggccgtgacgtcgaagtgatggtcaccggcgcatctggcaagaaggacgccgcgacccatcgtgtcaccgggcgcgagaaaaccggcgtgctcgtgcatgtcggtgtgcccgaaggcgagccgatgccgcaggtaggcgatttcgtgaccgccaccatcacccacgctgggcgtcacaacctcatcgccgatcccgatctgaaggcggggcagacctatgccgttcgacactgaacagacctctgagaaaacagacaaaacaggagacgccgatcctgccatgcagcgcaaggtcgtatccattgtcggaccaaccgcatccggcaaaaccgggttgggcattgccgtcgccaaagcgttggcgcgcaaaggcgaacaggcggaaatcatcaacgccgacgcataccagatgtatcggggcatggatatcggcacggccaaggcaagccttgaggagcaggcgcaggtcaggcatcatctcatcgatatcatcgaaccggacgacgccatgtccgtggcgaggttccaagagctcgcccgcgagaaaatagccgaactacaggccaggggagtgcgtccgatcctcgtcggaggctctggcctgtacgcacgggccgccatcgacgacatctccttccccggcaccgatccgcaagtacgcaaggcgcttgaggaacgggaaaaaaccgaaggcgcgggcgcgttgttcgacgagctgaaagccaaggatcccgaagcggcggcgcgcatggacccgcacaatccgagacgaaccatccgcgcgctggaagtcatcgaagtgacgggacgaccctattcggcaagccttccgcactaccggtacgtcatccccaccgtgcaaatcggtctcgatctgccgcgtgaggaactggaccgtcgtatcgatattcgcaccaagcagatgctcgaaggcggattcatcgaagaagtggaacgtatccgtcccaagctgggcatcaccgcagccaaagcgctcggttaccagcaggtcgtcgactatttggacgggttgcgtgacctgaacgacacgttcatggacattgcgcagaaaacgaagcgtctggcacgcaagcagatgggatggttcggtcgtgacccgcgcatccactggctccaagcgctcaatccggcgctgctagacaacgcgatggccatcatcgaacatgccgatgcaggtgcctatgacgtcatagacgcacaggcggacgcctacacccagcatcatctcggagacctcgcctgaaatgaaactcccgctgccgtattcgtcgaagctttccaccttatccacggtcttctccggcttggcctccagattgacggtgacgatcttggcggaatccaatcagtgaaattgcgtgttcacttaagttagaaaatgtgtgcgattcgaggaagtgccatgtcatggcgcctcccatgggtaaaatcatgaccgttatggcacgaacagcatcttccaatacgaaatccggcggcaaagggtccacgggcaaggcacgttccggcgagaccaaggtcatggacgcggtcgagccgtcgcctgtgatgggtgtcttgaccaagtacggacgtgatatcgcatgttttattctggtgattctcgcggtaatgttctgcgcttcggaatggttccgggtgcagggcgtgttcggccggatgctccacgccttggcttccggcctgtttggtctgatgagcgtcatcctgccggtctttttggcgctggtggcattcagcctcatatatgagaccaagcgcaaaagcggcaatgtgcgtatggtggcggggtggtccatgattctgtggtccgtctgctccatactcgatgcggcgctcgcgtccgacgcccaaggtttcgacatggcgttgctgcagaatgcgggaggtctgctcggctatgtgcttggctgcccgctggcatgggggctttccaaggcgttcgccatcgttattttcgtggtcgtcattttgttctcgttgttgctgattaccaatacaggggttcaagagattcccgacaaagtacgtgcattgaaggtccgttttggattcggtgcaaataaaaaggttgatgacgagaccgagcaattcccgaacgaagtgcgtataggagataccacgctgtcgttcgcagaaggcgtgccggcgcataatggagccgacgatgtggcggctgaaaagaagaagccgatgccgttctccctcataaagcaatggatatcatcgaaatccaagaagcagggcgctcaggacggactcgatcattacgacggtgatgaggcgtttcgtaatgctgccgaacggcatggcgaaacggcggaaaccatgcttgacgaaccataccagagcgtctcgcggccgcgcagcatttcatccgacgaacattccgctcaggatttcggtggaaccgtcgccatgccgcagacgcctgtggtgcgttccctttcctctgacccaatcggtttggcgagcggcaccatgccgcagatcccggaaaccattccgacggttgccggccaggcggcgtccgacgagatcaaatccgttggcgtggctgtaggggacccgtgggccgtcatcgacgaggacggcacgtccaacgggtcgcaggtcatggtcgatgcggcgaccaatgaggtcgtgaacgatctggatgccggatcgaacggagagggcgtttccgacgagtccggtgagattccggagggcccctatcatctgcctgatctcggcatgctgaagcaaggcgcgccgcatgccgtgcacactccggagaacgatcgtgtgatccgcgctcttacggtcacattccagcagttcaatgtcgacgctaaagtcatcggctttctgcgaggcccatccgtgaccatgtatgaggtggagcttggtccgggtgtgaaagtggagaaggtcaccaatctgcagaagaacatcgcctacgcggtggccagttccgacgtgcgcatcctgtcggtgatcgaaggcaagtccgccatcggcatcgaaataccgaacaccgaccgtgaaaccgtggtgcttggcgatgtgcttcgttcggacaaggcgagaaacgatccgaatccgatgctcacaggcgtgggcaaggatgtggaaggccattttgtaacggcggacctcactaagatgccgcatcttctggtggcaggcgccaccggttccggtaagtccagcttcatcaactccatgctgacatccgtgatcatgagggcgacgccggatcaggtgcgcatgatcatggtcgatccgaagcgagtggaactatcggcatacgcgggtattccacatctgctcacgccgatcatcaccgatccgaagaaggctgcgcaggcgctcgaatgggtggtcaaggagatggatgctcgttacagcgatcttgaattcttcggattccgccatatcaaggacttcaatgctgccgtgcgcgccggcaaggtgcatgcccctgccggatcgaagcgcaaggtcgctccatatccgtacattctggtggtcgtcgacgagatggccgatctgatgatggtggccaagaatgatgtggaaagctccatccaacgcatcacgcagctggcacgagctgcaggcgtgcatctggtgctcgccacccagcgtccatcggtcgatgtggtcaccggcctgatcaaggcgaacattccttcgcgtttggcgttcgcgacctcgtcggccactgattctcgagtcattctcgactccactggcgcggaaactctgattggacagggcgatgcgctgttcctgccgatgggacaggccaaaccgttgcgtgtgcagggcgcatgggtcgacgagtcggagatccgacgtgccgtggaattcgtacgcacccagcgcaagccacattaccgtgaggatatcgaggaaatggccaaggaagccgacaagaaggccattgagccggacgaagacatcggcggcgatatggatgtgcttctgcaggcggcggaactggtcgtcacctcgcagttcggttccacgtccatgttgcagcgcaaactgcgtgtcggattcgccaaggctggccgccttatggatctgctggagtcacgtggcgtcgtggggccgtccgaagggtccaaggcgcgcgaggtgttggtgcagccccaggacttgccgcaggtgctcgccttcatcaagggtgagacctcgtcgctgagttcgggagtctcttcggcggcggattccgaagcggcgatgtgactggggaacgctccgtatgaaacgcaaattggtaagcaagtagaagtgtcagggtaacgtgaacggtatggaaaagcaagaagaacgcaaatcatcgttgcttgacggctggaacgtgccgccgaaccttgtcaccttctctcgtatcattttggtcatcgtgtttttggcgctgtacgccaaagccggcgcgtggggcgtggacaacgtcaccatgcgttgggttgccgctgtcatcttcatcatcgcggcatgcaccgataagcttgacggttggatggcccgcaaatacaaccaagtcactgaacttggcaagctgatggacccgatcgccgacaagctgctcacctgcggcacactgatcgttgccgccatcttcaacgaatttggcaatccggtgctgggatgggtcgtgaccgccctgttcctgattcgtgagatcggcatcaccgtcatgcgcttctttgtgatcgacacgggcggcaaggtcatcgccgcatcccaggcaggcaaatacaagacgctctgccagtgcattggtctggccatgctcatgctgcctatgtggagcttggcgccggaaggggtcaacgacaccccgatgtggatgaccgtctactacaccatcacgtatgcgctgatttattttgcgctgattctctgcctgtattccggtggcgagtatctggtcaatacgttcggcggccgtaagaagtccgcgggcaagtccggaaaagaaaccaagtaaggcattcatgactgaatctatggaccagacggctgccgccaaccaatcgcaatgcgatgaattggctgcggccgttcttgcatattgcgaaaccaaccatttcaagatcgcagccgccgaatcgttgacgggaggcctgttggccgacgctttcgtgcgcgtgccgggagcgtcgaaggtttttctcggttccgcggtgacgtatgacattcgtgccaaggcctcgattcttggcgtagatgcggaactgctgcgcagcgagggggctgtccatcctgaagtggcccgccagatggctgccggaacggcgaggctgtatcggcagcagggggatggcgactgcgttattggattgtcgaccacgggagtggcggggcctggacctgatggaaataaaccggcaggtcttgcatatgtcggttgttccctgccggaggggttcggaggtgttcgctctcggcgaacggaggcttttgagcttcgcctgcagggagatagggagagcgtgcgacgcggcgtcgtgcattgtattctgcaaaagctgagggagctttcagcggattcacaggaataatccacaaagatgagtgttgaccatagtggacagacgtacgcacgaaaaaggggctgatgaatggaaatgatgacactcaccaaagagcagagggaactcaaggctatggctcctgcgactgcgcaggctgccggagctcgtgtcagggagcttacgccggctcagcggcgcgctgtgatgttcgcgcagcagcaggtgcttcgtgcgcgcgctgcgaaaaaggccaaggatgagcgtcaggccgcattgacgcgaatgtggcaggaagaggactccgatcgggtacgcacgcatgctgtgccgcacgctcaggaacagcccgatgaggctaaggaggtttcgctgcgtgaagccataggccatgtgctgcgcgacctgcgcacgcgagatcataagacgcttcgcgaggtcagcgaaaaggccggggtgtctttggggtacctttccgaagtggagcgcggccagaaggaggccagttccgaactgctgtcgtccatcgcgcagtccttggggctgtccacagcccagatgcttcgcatggtggctgactatctcgattctgtggctgcctgattcgaatgtaaggttgacgcccggcgattgttcgccgggcgtttttcgtgtctgtacatggattcaagtctgtgtacactggggcacgtgcaggaacgtgaattttggcagttacttgaagaggtgcttggtcgtagctatggtcgagcgctggcgcatgaccaggtgcttgatcgtcttggcggcatgacggcggtggacgcgcttggcgctggtgaggagccgcgagtggtctggaatgtgttatgcgaccagatgggcattcccgattcccagcgttggggcaaggaccataacgcgcctcctatgccggtgcgctgagacgttttccgaacacaacacgcctcttcgaacagatgttcgcatgttgggatatagttatccacagacaacaacctagacgggctgtttccaaattcttcagatcgcgtgaaaacgttgattttccaagaaatgttggttatgactcgttagatcgcatatcctccgaccacaacggccgttagatttgcgggaacgaatgccgtggccttacggtgaagccaccattcgtcatagtcagcaaaaggagtagtcatggcacagacgagcgcggcaaagggagccgcacagaacaagtccgcgaacggcatcgacccgcgtcgtcaggctgcgcttgatacggcgctcgcgcaggtcgagaagagtttcggcaagggatcggccatgcgattgggcgatcgtcccgagcaggatgtcgaggtgattcctactggatcgctggcattggatatggcattgggtatcggcggcctaccgaagggccgtatcgtggagatttatggtccggaatcctccggcaagaccacactggcgttgcatgtggtggccaatgcccagaaaaacggtggcgtcgccgcgttcatcgatgcggaacatgcgcttgacccggtctatgcgcgcaagctcggcgtcgatactgattcgttgattgtttcccaacctgataacggcgagcaggcgctggaaatcgcggatatgctgattcgttctggtgcgcttgacgtgatcgtcatcgattcagtggctgcactggtgccgaaggccgaaatcgaaggtgaaatgggcgacagtcatgtcggtttgcaggcaagactgatgagccaggcattgcgtaagatgactggcgctttggctcaggcgggcaccaccgccattttcatcaaccagcttcgagagaagatcggtgtgttcttcggcaatccggaaacgaccaccggcggcaaggcgttgaagttctactcgtccgtccgcatggatattcgacgtatccagaccatcaagaatggtgatgaggctgtaggcaatcgcaccaaggtcaaggtcgtcaagaacaagatggctccgccgttcaagaccgctgaattcgacgtgttgtacggcgagggcatttccaaggaaggttccgtacttgacatggcgttgcaggtcaatgtcgtgaagaagtccggatcatggttcacctatggtggcgaccaactgggtcaaggccgtgagaacgtacgccaattcttgaaagacaatccggagcttaccgaagagatcgagaataaggtgaaggccgagtttggtctcattgagcccaccgaccaatttgccgaagatggtaatgaggcttctgcgtctaatgccacaagcgaggagaaggcgaaagcggatgctggcaagccggaagcagccaaaggcgcggcaaaggcttccaagtcagccggcaaggcgtgacgtatgatcagcgctgagcgatttcttgaacagcagggcctccagccggtatcatccgaggttgggggccttgccctttcctgcggtggtcggccgcaggccggtcgaaccgaattcgattacgaccgaactccgtccattggcggcaatgacacgccgaggcgtgcgcgacacgcacgacactcagggcgtgtcgcagtcggcgtgtcgcggattcctgacgatccgaatgatttggatgcatgcagggaggcggcccttcggctgcttgatgcggcgccgcgtccgtcaggcgcgatacgggagcgactcatcggcaaggggtatgcctccgaggtggtggacgatgtgatcgtcagactgattcgggtccgtctcatcgacgacgaggcgtacgcccagtccgcggtgcggtactgcgcatcacgactgatggggtataggggagcggtcatggagctcaaacgcaaaggtgtggaccgccagctcgcgcaacgtgtgtgcgatgaggccgaatcccaaggcgtgttcgccgaggctgcatgggagctgggacgtcggacagcaagaaaaactgctggattggatgtcgaggtgcgtaaaagacggttctggagtgctggtgggcggaaaggccataatcctgaagttctgcggaaaatcgcacaggaattgttcgtctgaaacgactgattcgcatagtggttatgcggttttcaaacactgtttcgccacgggaatcggtcggtgtgataaaggagtgagacctcttataccccgggttctgtcgtgcctcaggcacggatggccatccatctcgacctgacgttgccgtcaggctctagcagcctacccgaaggcttcgggcgagcagccctcaaacgccttctgcttggccttgctcccgatgaggcttgccatgcggccgactgttaccagtggcccggtggtctcttacaccgccgtttcacccttacctaccggtcgaaaccgataagcggtctgttctctgctgcgctatctctcaggtcgccctgggcggacgttatccgccatcgtgctctatggagcccggaagttcctcaaccgacggatcggtcgcggccatcaagaggtctcaaatgcactatgctagcaaaaaaacggacgaaaggaaaatcaaaaaaactttatttttcttgcgtcaacttttcagtgaaatcacaatgttgcggctacaatgttgactaccgaacagcgaagcagctgtttggtccgtatatagcgggtaacaccgcttgagtctagggaggtccacatggaaatcgtcgttaccggacgtcatacgcagattaagcaaaggttccgtgacgttgtcgaaagcaagatgaatcgtgtgaccgctatcgccccggatgcgcagcgtgttcagattgtgttgtcgcacgagggcaatccgcgtcaggccgacaccgccaagcgcgttgaaatcaccgtcatcgcaggtcgtaccgtggtgcgcgccgaggcttccagcgccgacgagttcagcgctctggacatggcgctcgacaagctgaccctccgtctgcgtcgcacccgtgatcgtcgcaaggatcatcgtcgtggctacagcgatccggtcccggtcgatcttggtgtcgtcgagccgactccagaagttgaggagccggtcgaagtgccgaataacagcccggccgaagccgtcgccgctgagctgggtccgggagagtccgtcgaagtccaagtaggcgacaccccgattgtcatccgtcgcaagctgcatatcgcggagccgatgaccatcgatgaggcgctgtatgagatggagctgattggacatgacttcttcctgttcgtgaacaaggagaccggtcgtccgtccgtcgtctaccatcgtcacggctggagctatggcgtcttcgagatcgacaccccggagaatgtggcgaagtaagacgtgcaacaggttggatagggagataatctgaccgaacggggctcgcgcagtgtatgtgcgggcctctttttcatgtctgaaggtggtgtgtcgaatggaagaaggccgcaacaagctgaaagttacgtaaaatggacggtgtttttcggaaatcgttaaacagcgactaatctcagatgagataactcgcatacacaaagggagtgattgtggtagatatcgttgacaaagccctgcgaatgggcgaaggccgacagatcaagaagcttgagcacgtagctcaggcgaccgacgcgctggaagatgagattgcagcgctcaacgacgaagagctcaagggccagaccgccaagttcaagcagcgtctcgacaatggcgaatccctcgacaagctcatgccggaagccttcgccaccgtgcgcgaggcatccaagcgcaccttgggcctgcgccacttcgacgtgcagctcatgggtggcgcggcgctgcactggggcaacatcgccgaaatgaagaccggtgaaggcaagacccttgtggcgaccctgccggcatacttgaacgcactcgacggccagggcgtgcacgtcgtcaccgtcaacgactacctggcaagctaccaggccgagctgatgggtcgtgtctaccgcttcctcggcatgagcaccggctgcatcatcaccaaccagaaaccgccggagcgccgcaagcagtacaacgccgacatcacctacggcaccaacaacgagttcggcttcgactacctgcgtgacaacatggcgtgggaaaagtccgatctggtgcagcgcggccaccacttcgccatcgtcgatgaggtcgactccatcctcatcgacgaggcccgtaccccgttgatcatctccggtccggccgaaggcgacgtgacccgttggtaccgtcagttcgcacgtctggtgctcaagctcacccgtgacgaggactatgaggtcgacgagaaaaagaaggtcgtcggcattctcgatccaggcatcaacaagatcgaggattatctcggcatcgacaacctgtacgagccgaacaacaccgcactgatcggctacctgaacaacgccatcaaggccaaggaactgttcctgcgcgaccgcgactacgtggtgactggcggtgaagtgctcatcgtcgacgaacacaccggccgtatcctgccgggacgccgttacaacgaaggtctgcaccaggcaatcgaagccaaggaaaacgtggaagtcaaggctgagaaccagaccttcgccaccatcaccctgcagaactacttccgcatgtacgacaagctgtcgggcatgaccggtaccgcagaaaccgaggccgcggagttcatgggcacctataagctgggcgtgctcccgattccgaccaacaagccgatgattcgcgaagacaaggacgatttgatcttccgtaccaagaaggagaagcttgccgccatcgtgcgcgatgttgccaagcgccacaagaagggccagccggtgctgctgggtaccgcttccgtggaatcctccgaaatcgtgtcgtccctgcttgacgttgccaacattccccaccaggtgctgaacgcgaagcagcatgacaaggaagccgccgtcgtggccgtcgcgggccgtaagggcgccgtcaccgtggctaccaacatggcaggccgtggtaccgatatcatgctcggcggcaacgtcgagttccttgccgatgcgaagctcaagtccgaaggctattctccggatgacactccggacgagtacgagaagcgttggccgggcaccttggccgaaatcaaggagcaggtcaaggacgagcatgaagaggtcgttgaactcggcggcctgtacgtgcttggtaccgagcgtcacgaatcccgtcgtatcgacaaccagctgcgcggccgttccggacgtcagggcgatccgggcgagtcccgtttctacctgtcgctcgaagacgatctgatgcgtctgttcaacacccagctcgtggcccgcgttatggccaagggcatgccggaaggcgagccgatcgaagcgaagagcgtttccaagggcgtgcgcaccgcacagaaggccgtggaatcccgcaacttcgaaatccgtaagaacgtgctcaagtacgatgacgtgatgaacaagcagcgcaccgtcatctacgccgagcgtcaggctgtgctcaagggcgaagacatccacgaggatatcctcaagttcatcgacgatacggtattgagctacatcaagggcgccaacaagggttctgacaagccgaaggattgggattgggaaggcctgttcaaggctctgaacgccgtgtacccgattgccgtcgatccggaagccgccaaggacgctgtctccaagctcaagggagacaaggccatcgtagccctgcaggagcttatcgtttccgacgcaaaggaccagtatgccgacttcgaagccaagcttggtgaagagggtctgcgtcagctggaacgtcgtgtcgtgctcgcggttcttgaccgcaagtggcgcgaacacctgtatgagatggattatctcaaggacggcatcggtctgcgtggtatgggtcagcgcgatccgctggtcgaataccagcgcgaaggctatcagatgtacaactccatgattgaagcaatcaaggaggagaccatccagctgctgttccacgttgacatcgatcgtgtcgccaccaccgaagacgccgaaaccgaatccgatgaggaagaggccgtgaacgcagccgaagcggtgatgggcctggatagcgaagcgcagccgaccggtgaaaccgctcctgccgagccggaaaccgacgatgaggccgagaagaccgtcatcgacgaactggccgaagaacagaagaatgagcctggcatcgtaggcatgcagccgatcagccatgctgagggcaaggttcctgccaataagcgcccgaagagcgaggaattgcgctctccgtgggcggatggccgcaccttcccgggaactggcaagaacgcccagtgcccgtgcggttccggtcgtaagtacaagatgtgccacggacagaacgaacagtgacatatcgtgtgatgctctgatgattcgcgcataatgaaggcggtttgcggatttttcgcagaccgcctttttgtttcatgctcgttgcccgatatgcggaagatagatattgaaaatgtctgtgttgtttatgatgagcgcttttctgcaattacctgttcgtgatatggacgttgaaaaaccatgaaatgtagaacggttacaatggcggcgatatcgtatcaacaacgtgacatgctgaagcgtcaaggagggcatcatggctgaaatcacatggaagtcgatcctcaccaagctggtcggaggggaccatctgagtgccgaggaatccgagtggttcgtcgatgacctcatgaacggcaacgctaatccggcggccgtcggtgcggttctggcaacccagcagcagcttggcttgactccggatgaggtgcgtggagcggccaaggccatggtctcccatgccatcaaacttgatatcgacggtgagaccaccgatatcgtcggtaccggtggagacggcgccgcgacggtgaatctgtcttccatgggcgcggtggtggctgccgcagccggagcgaaagtcgtgaagcacggcaatcgtgcagcctcttccaagtgcggcactgccgattgcttcgaggcgctgggactgccgctcgatctggaaccggaacaggttgctgaggtcggcaacgaatgcggcatcgcattcgctttcgcacgcacattccatccggcaatgcgcttcgtgggacctgtccgtgcggcgctcggcatgccatgcgtattcaacgttcttggacctctgaccaatccggcctcgccgaagcacatggcggtgggctgtgccaatcgcgcaatgagcccgatcatggctgcggtatatgcggctaatggacagaccggcatggtgtacacgtcaagcgagggacttgacgaaatggctccgactggtccggtgtccatctgggagttcagcaacggcaaagtcactgagagtgaattcgatccgactgtggagcttggtctcgacaaggtgacggtggctgacttaaagggtggagagccggagctcaacgctcagctgttccgtgacttccttgcaggcaaggacgttcctttccgcactaccgccctgctcaacgcggcatccgcgattgttgcggacggccatcaggtgccagctgatgccagcctgactgaacgattcaaagcggcctatgccattgccgaagaaaccgttgattcaggcaaggcctcggcactgcttgaccagtggatcaccgccgcccagtccaagaaagcttgatattcggcgaaatagcagatcataagaacgtataaggcgtgtctcgtcaaaacactcaacgacgagacacgccttatacgtatcgcagcgacaaatatcacagagaagagcacaaaagacgtagctgatgcagtcttctccatatgttgctatacgcgagctccatcatcgaaaacatcgcggcgggtttgtgtatgtcccttgtgctgtacgatcaatccagcagcgccaatcaacgtgcacacaccgaaaatcgatcccaaaatcccagccaaagcaggcatgaatgcagatgcgatgataccggcgacaccagcgatcaaaagcacccaaaacaccaacttcgatatcttgacatgaccgatggagggattcggaggagtgaaatcatcaccgtaacgatccattacactatcggtgtccaaccagctggaaccagtgaaatcgcgcggtccacgaccttgcggagtgtcatcagtgaacgtgccctgatccaaatcctgaatcgaaagcaacgcctccttctcacggcgctgcgcatgcttttcaaaacgtttcgcgctacgagaatgctccacggcctgcaaatcgtcggcatgcgaacttgcgaattcagcccatgcggcatccaaatcgtccgcatttgaagaagccccttcgccaccattcggcgcggcatttgggcgttcttcatcggcattgctattgttgaggtcagtcatactgataactgtaatcaagcggatggccatccgctaggaggatcgtgaaaaatgctctactggtttttcgtcaaaggcctaggaccgatcgccatccaccgcatgggaccgactgccaagggacttgaaaacattccgcgcgaaggcggtgccattatcgcagccaatcatcttgccgtcatcgatgacgcgctgttgccgctgacttgtccgcgcatgattcatttcatgggcaaagccgagtatttcgaaggcaagggcatcaaaggcaagttcaagaagtggtggttcacttcggttggcgtgttccccgtggatcgttccggtgggtcgaaatcgcttggcgcattgaaccacgcgcgtgaaatcctcgaagacggccacctgttcggcattcatattgagggcacgcgtagccctgacggtcgcctctataaaggtcataccggagctgcgcgacttgcttttgaaaccggatgcccaatcgttccgtccgccattatcggatctcgcgagttgcagaagcccggtcagattattcctggtaagggcaagaccacagtgatctacggcgaaccgattgccgtggagaagaagcccgccgaccagatcacgcacgacgatttgcgcacgctgactgatcgcgtgaccatggaaattcagaagatgagcggtcaggaatacgtgaacgaatacgctcagaaagtcaaggaacagcttaaggctcagaaagccgccgaacaggcgaacagctgagaaaccaaagagaaaagccccggcacgacactacacgagccggggctttccttatgcctataccatgatgttttggcaaagcaggtaatgcattttttagaacagtgaggaatacatcttcaatgtgatggtggttggtatgccgttctcgtcgcgaagacgcacttcggtgccacctaccggatcctgcgaagcgaccttcttgtcttgattggaatccaacgtgagctgcgaacttaccttgaccgtgaatccgagtttttccaatgcggctttggcgtcagaggctttctgccccacataattcggcagggttatggtttccggtcctttggaaaccaccacgtcgacgctgtctccccagtgcaacgtatcaccgttgttgacggaagcggaaatcacctgcccctgtggaatcttgtcgtcgaaggattccgtccaattggtggtgagtctaagatcatccagcgcctgctgtgcctcgtccttcgtcttgccgacgatatcgggcatagtgactggctttggcccctgcgacaccgtgacggtgatcgtcgtattatgcggcaatgtggcgccgggatccacacttaacgacagcaacgccccttgaggcacgtcaatggaatacgtgtcatcagaagccgcggtctgctcgacattatcgaatccagccttcttcagcgcgttgattggatccttgccggatgcgctggtcgcgtcgagaatatcggcgggaaccgtcgcctgccggactcccttggagaccacgaccttgactttctggctacgacgcttgctgccgcgatcgccgacattcgccgggtcggtggagatgatattgccttcctccacggaatcgctatactcttccgacacctcatattcgatatcggaaatcttgagcagactctcgtagtcgctccacttcacattggtgatggggcatgctgcggacgcgtcgcatgtcataccatccggctggggcatggtccaatagctgccggggccctgatagtaccaccatgcccaaccgccggcgccacatgcaagcagcagcgccaccacgcctgcgacgatgagcggtgtgcgacgctttttcgcggatttgctgtttggagtattgccggattcgtcgctttgcgcgatgggggattgcgatgcagcgctgtcgacggcattgtcaaggctattgacgatgccgtctgccggcagcgagaaacgtgtcgtcgcttctggatcgatgttctgttgctgcaccggcatgacggttgttgcgttcgtcctgaccctgtccagcttgcgtgtgcgatcatcgaattgctgcgtcggcggtgccgggggagcgggaggaacaggattgccgacattggttggcgcaccgttatttgcgggcgcggcaccgtcggaagcgctgacgtctaccaggggaagacgatactgccaatcgctgaccgcaagcgtcgattgcagacgctgcagctcggttaacgcaacggatgcgtctgctggacgagcctcgaccgcgcgagccgtgagatgggcaaggaatgcggccacgccttcattgatgcctttgcaagcggcggcaatgcttggcacatcctcgtgaacatgcttgaataccagtgttactggattatctgaagtgaatggcacgttgccggcgagcatctcccaagccatgatgcccacggaatacaaatccccctgaggtgtggcttgattcttctcaatcatttccggtgctagatatgctgctgttcccagcagtatgccggtggaggagagtgtggcctgcgataccgttttagccaagccgaaatcggtgatctgcacatggccacggtcgttaagcaagatgttttccggcttgatgtcgcgatgcaccacgcccgcacgatgtgcggaagcgaggccatccaatgtctcgccaataatgcgtaacgtctctcgaacgctgaacgtaccctgctggttcatttcgtaacgcaggttcacgccgtgaacatactccatgacgagataatcgagaccgtcgaattcgccggtgtcatacacctgcacgatatgcggattggcaatggccgcggccgaacgggcttcacgatggaatcgttccacgaactggtcccggtgcggtccctgcgccagctgggtatgcatgattttgatggcgaccgtgcgctccagacgttcgtctaccgcttggtacaccgtggccatgccgccatcggcgattctgctgacgacccgataccggccctcgatgacctgaccttcaggggcgtgtggagcttcactcatggttgatcgctacggttccttcttcaaaacaactcacgttcgaacgtgttcccacttgtagtctacaagcagaggtttgcggattgtgcaacgaacgcgcgtcctgtccggatgttggttggaaaacacgcaggtcgcgtgtcacgcgcgtgtttggacgtgaatacttggcacgaaacgtgagcaggcctcgatgagcagtgactcgtggtattcggaaaggctcaatgtttcgatagctgttttcgattcattccacaaatccgcgattctaccgcgggaacgttcgatggctcctgtttgctcaaatagttcaatggcgcgttttacttgagtttcggaacgcgaatcggcctcccacatgtcgatgagctctcgccgctgcgtgtcgttcgccgcgttgatggcgtcggctagaagcaccgtgcgcttgccttcgcggatatctcctccaacgggcttgcccgtattgctgctcgaaccgacaacatccagaagatcgtctgcaagctggaaagccaatccaagaggcaagccgactgccaatgcctgcttcctcgcatcgtctttgcctatacccgcggcaagcatgccgaattccagtggggcaatggtggtgtagctggcggttttccagcggaatacgttcaatgaagcttccaccagttcgtctggatcgtccaacggattgagctctacggccaaatcaagtacttgaccgacttcgacctcgcggtgcatgttgagcaatgccgcgaccacatcggaaccatgagtgagcttggaagctgccttgtccgcgatgtccacgcttgccgtggccaacatgtcgccgagcatgatgcccaagccatggccaatggcctcgctatgcgtaccagtggagaatgcgcgatgcgcagacggcttgccacggcgcagatcggaatcatcgatgatgtcatcatgcaccagcgcaccggtctggaacacttccaccgcgcacgctaaatcgagcagcgcgtcgaaatcacgttctcgcacatcctccgaagcgaatgcgcggaacgaatccaacgtcagcaaggagcgaagccgcttgccaccctcacttgacgtgaccgcctgcttggcgaccatgtcggcaataggcctgcaagaggaggcaaccgaatcgtccgcatgaaggaatgcgaaatccttcaccaacgaaacaatgcgtgattcaatctgttccaaatcggaggagctagtcataccaacagttatccacaggcattcgacaagaccaaatctcaatgattgcaatagttgcggtaccgaaatcattttgcgaaacgccgaagaagccatcctccgaccacaggcctcgaaaaaagcggcatcgcatcggctcatcgggcatagtgccatataagcggcgagcgaggaagccgatagaccatgccaaggagggcagaataatgacaaccaacaaaaccggacgcatcaccgggactgaaatggaagaagccatcagccgattcgaaagggattgcagatccgacggcgtgggcgaaacagtgcgttcgttcattcgtgaaccgcttttcatatggatggacgcgcttgcgcaggcatcggacgagagcgtttcccattcggaaggcgaattccatgccgaatgcggtcttgaccggaatatgatcatgcggactacggtgggcatcaatcggatgctgtccattcgtgacgtatttctcatttccgccatcgttgacgaacgatacgccgaccgagactttctcatgagtttcgccgaaagacccaagctgtctcgtaatgcgcagcgtctggaacagctgctcagcgattcattccgtgatcccctagccagacccgatatgaaacgttgcgatcaggcgatcaacatgctgttcgacattatcgatatgattccgaagacatatcgggcgcagccgttcgccgtgatcagctacatcatgtggtggatgggccaggaaggagccatggcatcagccatcagcgcgctcgcgatagatgatcaatgttcgctggcggcgattgtatgctcggcggttgaacgacgtattggtcctgcctggacgtcggaaacataaggcaacacgccgtaaagtggcgtgacttgcgcgtgaaggcctcattatgcgggaataatcgtccttgcaagatggtttactcacatagttgacgatttgcccttgccagaagtgggtccatgtggtatacgcttcgaggcaggatcaataggaggataagtttggccaccaaggaaacgacggcaagcatggaacaggctgatctgaccgaaaagaccacctccacgaagaaagccgccacgcgcaaggcctccacgaagaagagtgcggcgaagaaaaccaccgcaacgaagacccctcgcaagactaccgcgaagaagagcgcccctgccaagaaggaggagccgctcgaggatgatgcacttgacgatgaggacgctcaggtagacgacgccgatcttgacgatttcgacgccgatctcgatgacgtcgattcggatgacgaggatgacctcgacgacgacgaggaatccgaacctgaagatgatgacgacgaggatgaggaagaacgcaaaaagccggaagagcctaaggaaaagggcgctttcgtggtgcgtgatgacgatgatgatgagaatctgaccccatccggcaatccgaagcgtcgtgtgattgcggcgggtgcgactgctgatccggtcaaggattacctgaagcagatcggtcgtgtgagcctgctgaatgcggaacaggaagtcgatctgtccgagcgtatcgaagccggtctgtatgcccagcacctgctggacaccgaatccgaccagatggacttcaaacgcaagcgtgagctcaagtgggctgcgaacgatggcaggcgggccaaggaccacctgctggaagccaatctgcgacttgtggtttcgttggctaagcgttacaccggccgtggcatgctgttcttggatttgattcaggaaggcaacctcggtttgattcgcgccgtcgagaagttcgactggaagaagggctttaagttctccacctatgccacgtggtggattcgtcaggccatcacccgagccatggctgaccaggcgcgtaccattcgcgtgccggtgcacatggtcgaagtgatcaacaagctgtctcgtgtgcagcgtcagatgctgcaggatcttggccgcgaacccacgccggatgagcttgcacgcgagctcgacatgcctgtcgagaaggtgcaggaagtgcagaagtacggccgtgagccgatttccttgcatacgccgttgggtgaggatggcgattccgagttcggcgatctgatcgaagacaccgacgccatcgcgccgtccgacgcggttgccttctcgctgttgcaggagcagttcaggcaggtgcttgaaacgttgtctccgcgtgaggctggcgtgatcaagatgcgttatggcttggaagatggccagcccaagacgctcgacgacattggccgcgtgtatggcgttacccgtgagcgtattcgccagatcgagtcgaagaccatgtcgaagttgcgtcacccgtctcgctcgcagacgctgcgtgacttccttgatcagtgattgaaacaagaggtgaatgaagtcgagaaattcggtaagaatatcgaatttctcgacttcttacgtctacaagacgttcttatggatgaaaaccgaagcaaaactgcaagtcagaatgaggaaaatggcgaaatacaaggacaattacggcgcaggtagtcttaccgtgcttgaaggtcttgacgcggtgcgcaagcgcccgggcatgtatatcggcaccaccgatagccaaggtctgatgcactgcctgtgggagatcatcgataattccgtcgatgaggctcttgcgggagtctgcaatcatatcgttgtgacgttgcacagcgacggttccgtggaagtggccgataacggccgcggtatccctgttgacatcgagccgaaaaccaaacttaccggtgtggaagtggtgttgaccaaattgcatgccggcgcgaaattcggtaactcttcgtacggagcctcgggcggtttgcatggcgtgggctcgtcagtggtgaacgcgttgagctcccgtcttgacgtggaagtggatcgtgacggcaagacgcatcatatgtcattccatcagggtcatcctggtgtgtataccgatgctgatccggagcacccatctccggatgcgccattcaaacgcacgcgtaaaaaccgtccgactgagcttgaaatcattggcaaggtcagtccgaagaccacgggaactcgcattcgttattgggctgatccggagattttcaacgacaccgcggaattcagctacgagcagctgattgatcgcgtcaggcagaccagcttcctggtgccgggtttgaaaatcactgttatcgatgagaatattccggaaaccggcgatgaatcagtcgacgaaatgctggaagtcgacgatattgcaaatgctgcaggtgatgaaccgcaggaaattgccgaaagcgatgaatctgaacatgacgctgccgggcacgaggaagctgcggagcagatcgaggaagccgatgttgcggcacaacctcagggatcgaagtatacccactcccgtatcgaggaattctgccataccggcggtgtgaaggatttcgtggattacctgtccaaaggcgaagcggtttccgctatttggcgtatcactggcgaagacacctatgttgaggaaacccaagccgttggcgatggcggtgaactgcacgcgcagaaggttacgagaaattgtgccgtcgatatcgccatgcggtggaccaacggatacgacaccaccatgcgcagcttcgtcaatgtggtggaaaccccgggcggtggaacccatgtggatggctatctgttgggcctgaccaagcagattcgcaaagccatcgaagacaatgcacgtaagctcaaagtgaatctcaaagattccaacatgaaagtcgaacgtgacgatattctggcaggtctggttgccgtcgtcactgtgcgtatcgccgaaccacagttccaaggtcagaccaaggatgtgctcggcaccgcgcaggtcaagccgatcgtcagcaaaatgaccgacaggcagttcggcgagatgatcaccggctccaaacgtggctataaggaacagtccggccgcgtgcttgaaaagatcgtcggcgaaatgcacgcccgcatccaagcacgtaagaccaaagaggtgacgcgacgcaagaacgcgctcgaatcggcatccatgccaccgaaactgtctgattgccagccaggcaatgacgatgtggccgaactgttcatcgtggagggcgattccgcacttggcaccgccaaagccgcgcgtaattccggtttccaggcgttgctgccgattcgaggtaaaattctcaacgtgcagaaggcgtcgttgtcgcagatgctgtcgaacaaggaatgcgcggcgatcattcaggtggtcggcgctggctccggagcgagcttcgacatcgagcaagcacgttacaacaaggtcattatgatgaccgatgcagatgtcgatggcgcgcacatccgcattctgctgctcaccttgttctactgttacatgcggccgctcatcgagtacggtcacgtgtatgcggccgtgcctccgctgcaccgcatcgccttgaccggagctcacaagggggagtatatctacacgtattccgacgatgagctggccggcaaattggctgatcttgataagaagcacatcagctataacgaggacattcagcgctataagggtctgggtgaaatggacgccgaccagctggccgacaccactatggatccacgcacacgtatgctgcgtcgtatccgtatggaagacgccgaacaggccagtcagattttcagtctgctgatgggcgatgacgtgccgccgcgtaaagcgttcatcgttgagaatgccgacgatttcgaccgttcgaagatcgatacctgatcgaggttgtcgtcagctcgccttccgctacgtcaagacgtttcggagggtattttttagtgaagatggtatgcgatcccgtgtggtaaagattgaagattctacggtagacagtgcaatcaagtagttaccgattggtagctatatgtgcttacaataatggcggatattgtcttctgcggctaccgatcaagaaggagtagggcgtggttaatcttttgcttgcggtgatttatgtggcgttcatcagccttggcctgccggatgcggtactgggtgccgcatggccgacgatgagtgtcgatttgggtgctcccatttcgtgggctggcggcatttccatgacgatttccgctggcaccattgtttccgcgttgctttccgatcgtatgaccttgcgttttggtgcgggcaaggtcactgcggtttccgtggcgttgacggcgttggcattgttcggcttttccgttgctcctaactattgggtgctgattctgcttgccattccgtacggcttgggtgcgggcggcgttgacgcggccctcaacaactatgtggcgatccactacgagagccgtcacatgagctggcttcacgccatgtggggcattggcgcgttgactggcccatacatcatgggattcgccttgggcgccggccaaggatggtcgtggggctaccgttatatctccatactgcaggttgtgctcaccgccattcttattttcagtctgccactgtggaagaagcgttccgaggtaaagacgggcgaagtttccggcgaatccgacggaacggccaatgatgaaactcgcaaaccgcttggtgtgcgaggtgtgctcgccattcgtggcgccaaagaaatcctggtgatgttcttctgctattgcgcattggagcagacggccatgctgtgggctagtagctacatggcgcttggcaagggcatcgataagaccacggcggctatgtgggccagcctgttctgcatcggcatcaccgtgggtcgcttggcgagtggttttctgaccatgaagtttaatgatccggccatgattcgcctggggcaggcgctggtgctgaccggtatcgtcatcatgttgctgccgctgcctcgcaatatcggcaccattatgggactgatgattgtcggtcttggctgcgcaccgatctacccgtgcgtcattcattccacgccggcatatttcggcgaagacaaatcgcaggcgatcgtcggcatgcaaatggcatgcgcatacgtcggctcgatgtgcatgccgccggtattcggcttgatcgcacagcatatcagtgtgctgtggttccctctgtacatgttggctttcctggtgctgatgatgatcatgcacgagagcctgcgtaaaaagtgcgctggtcagaccatcgactgatacggtgttgtcgccattgccattgcgataccatgagccgcattgtggatttcgcatatatggttcgggttgctgaagccgagcgccacgtaccatacgataagcagtgcggtcatggttgcagccaatggcagttgtcgtattttcaggcgaataaggcatagcagaatcgcgatcgcaagcagggcgataaatgacgccgaaaggtaccgcagccaagtcaaaccgtatgcgttgatgtacagtcctaaccgaagcgccgccgaagctagaatgacggcggttaacgccagcaatgctaccagtgccgcgttgagcatgcgcgtacgtggcgcgagtgcgatcgccaaaccaaatagcgtcacattaatggccgtgactgccagcagttgaaagaatccgccgcgtgcgtattcgctataggtcaatccgtctggcagtgcgatcgaaccatcggtgaacaatcctgcgaacaggaaccggatctgtacgatgcaaaacagcatgtacacagtcaaagtcacggccaataccacgaacgcagttaccgagctgagggagaatcgttgctccggaggcgtggaagtgggttcatcgtcgagtccaataagcagtgagaacagcaaaggccacggcaacacgatgaacatgatgtgcagagtgatcgtcatcgggttgaaatcactgaaaacgttcagcacttcatattgaactatttgatcggctccgatgagcaatggtacgatcgtcagaagtaatggagtggaaatcagtagcgcaatgccgatttcgcgcgctttcgaacgttgcttcgacgcgactgcaaatcttgcgaatatgacggaaaacggttccgcaaaatcgcgaatgtgaataaacggctgctgcaaccagccggtaagccaattccaggcaacttgaagtggacggcgaacatcgtaacgcccgttgaccagctgacagtgcagcataagcaacgccggttgaacgaattgcgtggtgagcgcgtactcgtcatttctcgaatagcaccaggtcgactgagcgagtgtattccacacgccaatggcgacgatgcttcccaaaacaagccaaacaagaacttgttttcgtgcggttttccagtgcagcgcggttacggtaagagcacagatgatccagaaaaccggcagttcatatccgataagccatgtcggaggtatgctgcagatcagacggtcgaatgcgaaagtgatgagaaatgcagcgccaatggtgatgaccgcgcgtttgttgagggggcgttgcgctatttcttcccgcgtgattttgggtttcgccaaaggttgttcctcctgatgcgcggatggttcatgtgttggctggctcccttgtgtttttggtgtttcttgggtttcttgtgcttctggtaatggcgatgattgttgggattgcgaagtctgcgatggggaagtgttggctggttccggcatgataatgattcctttctgagatatgttggacgtcatcgtacatatcgaaaaacgatagaaaaatatcgactaacatactttcacaagatttgcatatcgaatatcgatagattattatcgatattcaggtttattggattgaaggagacggatatcatgccgaattccgcagcgaaacgttccatggtgattggcgtattgcgtgtgctgattgtgataattgcaatatgctgcctcggactgcagttcagtgcgattgcggcatccgctggcgttgcttccaagtatgccgacgctgactcgatgcattggctgtatgcggttgccgcagtgctgattgtcgcttgcttcgagttcgcgttggtgccgctgtggagattgctgaccttggttgaaaaacgtgatgtcttttccggcaaggccatgcgttgggtgaatcacattctcgtatatgcggggattgaaggcatgctggtgctcgccgtgatggtcggtcaaatctggttgtcgccttcacgctttctgatggctgcgatgggggttgacgggcaaatgtttccatacgtcgtgctggcggtcggagtggcggcgcttctactgatcgcggcgttcgaactgttgatggtggtgatgcgctcgctgttgatgcaggccatcgaacagcgtgatgaactggcagcggtgatctgatatggccattcgtgtgaaccttgatgtgatgctcgccaaaaggaagatgagcgtcaatgagctggcggaggctataggcataacgccggtcaatgtttcggtgttgaagaacgggcgggccaaggcgatacggttttccacgcttgataccatatgcgagacgttatgttgtcaaccgggagatgtgctcgaatgggttgccgacgaagatgaataacgtcttgcggtaatgcgatcatcgaacgtatgtacgaatgtttgaacctgttttcagagccgaccaaggcatggttcaaacatgcgttcagtcggcccactgaagtccagcagcaggtgtggccggccatccattccggcgagaacgtgctcgttgtggcgcccacagggtcgggtaaaaccctttgtgcgttcctttcggctcttgaccggcttatggcgggcgggacgcgttccgcaggagtggatgttcatggcgaaatcgcggcagccaagagccatgcggaacaaaaagctgcagggaaaggctcccgcaagaaaacgaagcgtggcgtcaaagtgctatacatttcgcctctgaaggcgcttggcgctgatgtggcgaagaaccttgaactgccattgcagggaatttcccagcagtatgaggcgatggagctgcccatccccgatgtcgaagtggccatgcgcagcggcgactccacacctgaacaacgtcgaagaatcgtcagccatccgccggatattctcgtcaccacgccggaatcactattcctgctgctcacctccaaggcgaacagcatattgacgagcgtggagacggtgatcgtcgacgagattcatgcggtcgcaggtacaaaacgcggcgcgcacctcgctgtcagcctcgaacgccttgataagttgattgggcatccagtgcaacgcatagggctttcggcaaccgttaatcccgttgaggaagtagcacggtttctcggtggttcgcaaccggtaacggtggtgaaccccggcgctgttccggccatggatttaaaagccgtggaaccattgcgcaatatgctcgacaccagcgctacaggcggttcggtatggccggtcattgaacggtccattctcgacgaggtgttgcggcaccgaaccacattgatatttgtcaactcgcgtggactggcggagaagctcaccgcacggctcaacgacatgtatgcggagtcgaaacagggcacggtggcaactgatctgagtgagcaccgtgacttgggctcaccggagggccgcgagcaatttgccgggcactatgactcggtggtaggatccaccaccatgctggttgaatcgcatgaagacattgatgcgattgccatggctcatcacgggtccgtgtcaaaagatagacgtaaacagatcgaagaacagttaaaacgcggcgaattacgttgcgtggtggccacttccagcctggaactcggcatcgatatgggttcggtggatctcgtggttcaggtggccgccccattgtcgatcgcatcgggattgcagcgagtgggccgtgccgaccacaatgtcggcggagtctcgcacgcgttgttcttccccataacccgccaacagattattggcgtaacaaccagcatggaatgcatgagggaaggggctatagaaccattgcatatgccccgcaaccctctggacgtgctcgcacagcagaccgtcgcagccgcggccatggaagatctttccacgaacgattggtacgagcttgtgcgtcgttccgcacctttccaaaatctcgaccggtctatgttcgacgctgtcatcggcatgatgacgggcgcctacaacagtgagagcttttccgcattccgtccaccgctgcaatacaacgaagaggcaaagctgatttccgcacgtccaggagcgcaacgcttggcggtgaccagtggcggcaccatacccgaccgtggcatgtacgcggtggtgcttccagaagagggctctggtccaggtcctcggcgagtgggcgagcttgatgaggaaatggtatacgaatcccgcgtgggagatgtcatcactttggggacttccacctggcagattcaggagatcacacgagatagggtagtggtggttcctgctcccgggcgcaccgcgcgcttgccattttggcatggggatcaggatgggcgtgattatggtttcggattggcgcaagggcgtttgacgcgtgagctcagccaaggattgcataggcgtgaaccagcaaagaatggtgatcagaatacggctcagactgtattggaagcacagttcaaccgtgagaccgcgcaacgtttggagcgagatggtctcgaccataatgccataagcaatcttgccaaactgcttgacgagcaatgtgaagcgaccggtacgattccttcggatcgtgatctcgtggtggagcgttgccgggatgaaggcggagattggcgcatcatcatccattcaccatatggtaggcgcgtgcatgagccttgggcgttagccatcaccactcgaatcaaacagcggtttggtttcgacggtcaagtgtacgcggtcgacgatggcattgttttacgattgccggacggttacggcgatttgcctacacgtgagctgttgctattcgacgtggacgaattgcaacgcactgttgagacgcaagttggcgaaagcgtgctttacatggctcgattccgcgaatgtgcggccagatcactgtttctgccgcgcacacgtcccggtaagcgtgtgcctctctggcagcagcggttgaaggccgcgcaactgttgaatgcggctcgtacttgcaagaacttccccctcttgttggaaactgcgcgcgaatgcctgcaggacgtatatgatttgccggcattacgcacgattatgacaggcctgcatgcgggaacaatacttttatcggaggcaactactgaaacaccttctccgtttgcgcagaacatgctgttcggcttcgtcggatcggtgatgtaccagtatgacgtgccccaagccgaacgaagcacgcagttgctgtccatggatctggaagtgctcgaacggcttctaggaagcacgaatatggcatcgttgttggacgccgaagctattacacaagtggagggcgagcttgctgggcgaacattctggaatgatctcgccgaagaagatatcagcgggcgcgtaacaagatacgccaaaacgcatggaccattcaccgctgacaagatgattgccgaactgggcattgacgcggctcaggcggtgcatgcgcttgatgaactggatgcccgaggagaactcatcaagggaagattcactgattcaggtgagacttccgaaaagaacgatattcagcaatggctccacaaggatgttttccggcgtattcgagcattgtctcttgccaaggccagaaaggccgtcaaaccggtcgatccgagcgtctatcaggcgtttctgcttaatcgtcagggcgttggccctgttggaggtgaacgctacgaaggcgttgatggtctgatgcgtgtcatcgagcagttggaaggcgtgttcctgaacgcttcggtatgggagtccatggtattcccggcacgtgtgcgtgactatcagcctagtatgctcgacgaactcatctcatcgtcggatgtggtgtgggtcggttcgaaagcaagtggatccaacgccaaagaagctggtgagatcgccttctatccagcaggttccttgctgctcaaccagcctgaatcggcggtggataagctgaacgataatgaaacgttgatcatgccggatgccgtgttaacggcgttaagcggtggcggagcatttcctattcaactgctttcagccgtgacaaaaaccatctggcttgagcatgccgaagcgcaggtgaaccccgaaacgggcgaaatcatctttccggcatggggcgagcggcagttcgaaggacaactggaacatgttttgaggcgcttggatgtccgattcttcagaatcggacacgctgggggcaggattagcaggggaggatggtggcgctgcgggctgggacgtgcagttgggtgccgtcgaagcgtgcggggttgccgatgctcagcagtactgttttctccgctggttcttgcgttggtttcgctgttggttcttgcgatatttcctgcgctaagccgccagacagcagtttcacatagtcgctcggcagtgtgcagcttgcgtcggtgtttgacggattgatggcgacgacgatgcgctcgccacctgcttcgcgattaatcttgctgcatgtttcacaaggtgtttcacagctggtttcgtgtgctgtttcgctgcgttcgccgtcagttgcgtcgcgttcggcttcgccggcctcggagcttctcgcatacaccagcggatacgcgtgatcttccgcgtagaggaactcgatgcctccgtcggcctgcagtgcgggatgtgccaggcgtagcgtgttcagtgcgcgtacggtttccagcagcgagtcgctgcgtccggtctgcgaagccacgttcgggcgctcgctgtcggcatcgatcggcagatacagatcatcgggccgggctgcggagaatcctgcgttggttgcgcagctccattgcattggtgtgcgcgatccggtgcgctcgtatccgccttccttggatttgagcccgtgcatgtagcgcatgccgatttcgtcgccgtagtagatgaacgggcagccgggcatggtcagcaggaatgtgaacgcgagcttcatttcatcggtggtcaaggtgtcgcgcatgcggatcatgtcgtgattgcccgacggaatgcagatgtatccaggcgttccggcggtgctggcaagcatggccgtatatgtgtccacaaacgccttgatgtcgccgctcgcattgccgacattgtcgttattgcaatttggattgtctccgtcgacgactgaattgccgttgctgtcgcacccgctgctgcccgcgccgtcgcattcgctgcgttcgccgtcgtgttccgtttcggcagtttcggcgctgcccgtagcttcggaagatccggccgaaaaatacggattctcgcggaacaggtcaagataatgcgacggcccgaaatgcagcaggaagtccatgtcgaatccggcgtgcagcgcctcttcggggtcaccccattccgatacgagcaccgcttccgggtaggtttcgtccagatgcgctcgcacttgctgccacaagagtttcgtccaatagtggtcggggtcttccttgacgaggctgcctgccatgtccacgcggaagccgtccgcccccaacccgagccagaagtccatgatgtcttggatgagcagccggccctgcaccgcttcgggggagtcggcggcgaactgccagtcttcggtgacggtgccgaatccgtagttgaggcatgcctgcgtggagaagcagttcacggccgccgcgtcgggacgttccgcaatgcctccgaggaatccgcggattgattcgtatggcgagttcagattcggcgattgcgtcatcggtcgccagatgtagcggtcggtccatgcgttgcgttcgtccttgccggattcaagaaaccatggattgtcgaccgcggaatgcccgggtacgaggtcgagcagtacgtgcatgcctagttcgtgcgcgcgctcgaagagccgctgcaggtccgcgttgctgccgtagcgttccgcggctgtgtagtagtcgcgtacgtcgtagccggcatcgtagaacgacgagtcgaagcatgggttgatccagatcgcattgcaccccagatcgcgcacgtattgcagtttgtcgatgatgccttggaagtcaccgataccgtcgccgttcgagtcgttgaatgattgcggatagatttcataaaagattgcgttgttgagccagcttgccataaatcctcctgttttcgcgtctttgctgttggtctaccgatgtatcgcaacgttggaaacgtcggtcactgcttttccgtcattatagcccgtgaagacactttttaggggtgtatggaatgccaatgtttgcaatacgtcaatcgattgacgcgacacgccgacggatggcactgtacacaaggtttctcgaaccggtttgacaactctcgaaccggtttggtatcctgtataccaaggacggagagattccgacaacgcgagtcggggattcaccttcctttatcacctcattgggcagggctgctcggtgaatagtggatagaaagggattggaaaatgagcaagttctcttcttggaagaaggctggcaccgctattgttgcaacgctgatgaccgttggcatgctgggagcatgcggatcgtcatccagctccagcggcaccaagatcaccatcttcaactccaaggttgaaatcgaaagccaaatggaagacatggctgcgaagtactccaaggaaaagggcgtagacgttgaggtctactactccaacgacaccgtcgcagcgcatctcgccaccaagtacgcatccaaggatccgtacaccatctccatggtcgacgccaaggacatctactccttggctgaagagcacgccgtcgatctgtccgaccaggattgggtcaaagacaccgactacgccatcagcattgacggcaagacctacggcttcccggtttccgtcgaagcccgtggcctgatctacaatgctgacgccatcaagaaggtcaccggtaaggaattcaagcctgagaactacaagacccttgacgagttcaaggatctcatcgacgagctcaaggccggcggcatggaatccccgaccggtgtcatgaaggaagactggtccctcgccgggcacctcctgccggaagtctacgaggagcaggaagatccggacgccttctgccatgagctcaaggacggcaaggtcgacctcagctccaacgccaagtggaactccctgatggacttcttcgacgtgatgaaagataacaactacgccaagtcctccgccatctccgccgagcgtgaggtgactgagcagaagctggccgagggtgagattgctttcatgttcggcggcaactgggattggtccgtgctgaaccagtacgattacaccgagaacatgggtctcatgccggttccgcagaacaccgatgacggctccaatgagaagctcgtcggcggcggctccaagtacttcttcatcgactcttccgacaacacctccgacgagcagcgtaaggccgccaaggacttcctgaactggcttgccgaagacaaggaaggtcaggagttcatctccaccgatgccgctctgatctccccgttcaagaacaacgacatcgaagcttccgatccgctgggcaagtccgtgaagtcctacgctgacgccggcaagctgatcggcaactacaactacctgccggacgatcactactccgtgctcggcgcagccttccagaagtggctcgcaggtgaagaggaccgtgcaggcctcgcccaggacatccaggactactggaagaccgctaagttcaccggcgcaaccgcctgaacttccaaataatgcaccatgatgcagggtccgccgcttccttcctgcggcggaccttacatccccggcacgtatgggatccatcatgaaacagaataagctttcctataaaatcggccagtttctgatgttcggtggtccggcgacgattcttttcttcgccgtggtgatcctaccgttcttctatggcctctatctgacacttaccagctgggacggcgtttcgacaacgaagccgttcgtcggtctcgaaaactacaaggcggctcttgccgacaccgcatattggcagtcgcttggacgcaccttcatctactccgtcatcgccgtcatcctcaccaacattgtcgcctttctgctggcctacctcgtgaccagcggcatcaagggccagaacttcttccgtgcgggcttcttcattccgaacctcatcggcggcatcgttctgggctacgtgtggaagttcgtcttcaaccgcgcattcgtggccgtcgccgaagtggcgacgcaaacagaccacgcatcgctgctctccacgccaaacggcgcaatgttctgcttgattctcgtttcggtctggcagtacgcaggctacatgatgctgatttacgtggcaggcttcatgagcgttgaccagagcctgaaggaagcggccatgatcgatggctgcaacaagggcaaggccatgtggcacgtggtcatcccgctgatgcgctcctccttcgtgcagtgcatcttcctgagcaccacccgttgcttcatggtgtacgacctgaacctttcgcttaccaagggcgaaccgttcaaccagtcggtgctcgcagcaatgcacgtctacaaccaggcattcgtttacaagaactatggcaccggtcaggcggaggcgttggtcctcttcatcgtctgcgcagtgatcggcatgctgcaggtgtacttcggcaagaagggtgaggtggcagcataatgaagggtcaaaccagcactcgcaccaaggttctgcatgcactgatgatcgtcgttctgacgattctgctgctgctgttcatcgcaccgttcattctggtcgtgatcaacgtcttcaagaccaaggcggacatcaacaccgctccgctggcactgatcggcaagcacgggttcaccctggagaacttccccagggcaatggacaagatgaacttcgtcaccgtgttcggcaactccgcggtcatcaccatcagcgcaaccatactgaccatcctgttctccgcgatgtgtgcatacgtgatcgtacgcaacccctcgtggaagttcggcggcatggtgttcgcgctcatggtggcctccatggtcattccgttccaggtgcttatggttccgctcgtctccgtctacggcggcctgcttgacgtgttgaacagccgtatcacgctgatcctcatgcacaccggcttctcggtttccctggcggtgttcatgttccacggcgcgatcaagacgaacattccgaacgagcttgaggaagccgccagcattgacggctgctccaagtggcgcaccttctggacgatcgtgttcccactgctcaagccgaccgtggccaccgtggccatcatcgacgccatggcgttctggaacgactatctgctgccgtccctggtcttgggtcgccgcgatctgtacaccatcccgatcgcaacccagatcttctacggcacatactccaacgacatcggcctgatcatggcggccctgctgctggccatgctgccgatccttatcctgtacctgttcctgcagcgctacatcgtcgaaggcgtcacctccggcgcagtcaagggctgatcgaacggtacggaatccgcaatcataactgaacagactcacacaaccggtccggatgcgaagcgataatcgcatccgggcttttcttatgcgatatcgattcttatgcgatatcgatattgagattgccatcgcatgtttctgctgtctgacaggacgtattgatatggttgatttcgccgaaagaatcgctcgaatgcactggtgcagtgcgtccgggcgattttcatatgtgctgaatatcgtgtgacatttcgaaacgagcgacgaaatagaagcaagaacgagaagcgacaatacaaaacaggaaaaacaggaatagaaacaagagatgactgaagacaatcaacataatgcaggtgagcagcagactccaatgcagccgcagccgctgccgggccaggtgttcgtacgccccggcatcgatgaccgtcccgattacgaaaaaacgctgaccgaagagaccaaagcggccctgaagcgcttggccgtacagcagaatccgcgcgtgcccgaggcttccaacgagcgtccggaagtgcagcagaccctcatcaacacggaaggcggctccccgctgaccgcgttcgcccatctcgacgccgccgtgccgaacctcgaatcgtcgttccttgacctgcgcgatccgatgaccgcgcccgacggcaccacgcccaccaaaccgcaggtgcatcgcctcaccgccggcttcgcgcttggtgcgctgctgttcaccgcgccgatggccgcgctcaactccgtgctcattccacagaccatcagccgtctttccggcaccgaccgcgtcaccgatctggcgctgctcagcgtcgtcggcacgctgttgacgttcctgatgaacgcgtggatttccgtcggatccgaccattcgtactgcccgctgggccgccgcaccccgtggatcatcgccggcacggtgctgaccgccacgtcggtggcgattctttccgcatgcgatttcatgccgttggtcatcgtgttctggctgtttacgctgatcggacatgcgatggtatcgatgccgctggcggccgctttcggtgagcgcgtgcctgacaagttccgtgatcgtgcggacgcgtggcgtggcgttggccaggcgttcggccaggtgttgggcattatcgcggccgtttcgattacgtgggctgccgacgattccggttgggatggcaccacgcgtttcgccatgatggtgtttgcgttgtgcctggtggtggctggtgtggctacgttgctggtgttgccgtttgagggttccagcagctatttgcctcgtgagggtgtgaagaagggcgattatttttcgcagtatcgtccgccgaagggcgctccgaagttcttcattgcgtttgccgcgcgcatgtttgccatcgcagccacttccggcattgcgatttaccagtggtatcttgcgcaggatggtttgggcgatgtttcgcaggtcaccatgtttggtttgtccggagcggctgcggttatgtcgatgatggccgttgccgcgttcgtcggctcgctgttggctgcgctgctgcttggccgcatcgcccgcgctttcaaagattcccgtattcccgcgattgccgcctgcttgttgtttgtggttgctgtggtgcttccgttgacgccgatcgatagtgctatggcggtcgcgctgtatgcgctgtttgcaggtttcgcgtatgtggtgtatgacggcgtgagccaagggttgaatcttgcgacgttgccggatatacgttccgttggtcgttcgttggctgcgttcagtttggcgaatacgttcggttcgttgattggcgctgtcgtttgcgcgattgcgattgcggcgactggcgagtatctgctgattttcgctgttgccgccggttgcatggctgttgcgggcgtgctgacgttgctgctgaaatgatttggatgacctgagataatccgaaaaacgaatatcaaattcaaaattgcgcgtccacatagtgaacctttagtagaaagggtctgtggacgcgcttatctttacggcttagttcgagcggataatccgccgaatacaagactttgcgaaaggaggttcgccacgatgaacggaatggttgcacgcgtactgctgtccgcacgaattattattccgctttcgttggcggactgattcgagcaatgcagcttcaatccctcgccaacggaggcagggtttgaggcgcgcaaaacacacacgttgatggccctgcatgctgcggggtctttttgttgccgcccacaaggcgtaaggcaacgaaatgaagactgcacacaagagaatagaagaaagacgttatcggcgcatgttgggagccggcaacgcatgacagacgtaacaggagtaatccaatgagtgcagtcgaagcagccgctggcaaagcgcaggcaatggtgcgcgattcggtgaaaaccgttatcgccgcttccatggtcggcaccgccattgagttctacgacttctacgcatacggcaccgccgctgcgaactatttcccgaaggtgttcttcggagacaccaccaatccgactgtcgcactgctggccagcctgctgaccttcgccatcgcgttcatcgcacgcccgctcggatccttggtgttcggccatttcggcgaccgcatgggccgcaagaccacgctggtggtttcgctgttgaccatgggcatcgccacgttcctgatcggctgcctgccgacttacagccagtggggcattgtggctgtcgccgcgctgtgcctgtgccgtttcgtgcagggcatcggtctgggcggcgaatggtcgggtgccgctttggtggccaccgagaacgctccggaagacaagcgcgcgctgtatggctccttcccggaattgggcgctccgatcggtttcttcctgtcgaacggtacctacttcctgttggaaacgttcaacgatgacgatgcgatgctggcatggggctggcgtgtgccgttcctgctgtcctcgattctggtgatcgtcggcctcgtcgtgcgagtgcagatggaggagactccgatcttccgcatggcccaggagcagaagaaggtcgtcaagtccccgttgaccgaagtgttcaagaagagctggaaggaagtcatccaagccacgttcctggtggccgtcacctacacgctgttctacacgctggcaacctggtccctcgcttggggcaccaaaaccgtcgagcagggcggcggagaccttggtttcaccaatcgtgaatacctgctcatgctgatgcttgccatctgcgtgttcgccgcgttcatcgtcatttcctgcgtgaacgccgataaattcggccgcaagcgcgtgatcgtcatctcgtcctgctgcctcgtggcattcgcgctgctcttcccgttcctgcttgatccgtcggtcgtcggccagcgtaacttcgccgccaacctgctgttcctatgcatcggcttcgcgttgatgggcaccgcattcggtccgatcggcgcgttcctgccggagctgttcgacgccaacgtgcgttattccggctccggcatcggctacaacctggccgccatcgtcggcgcggcattcgtgccgaccatcgccacttggctgtcccaccactggggtgtgcactccgtcggtctgtacctcggcgtgatggccgtgtgctgccttgttgcggtgctgagctgcaaggagactaaggatgttgatttcaccaagtgatcaatcgccaagtgccgtttgaccggctattcagcgacgtgtcaagatgacatcgacggaagccttactaaaaacgtttgacgcgaatataaccactatgtgaacgtcagcaaccaatataaagaaagcgggactaaaacagttccgcaggagaggcggggtggttcctcggacacaatccgggggagtaatctcctaggaaccatcgcccgctgtgaacaaccgaaacaagaattaaatatcgcgagtttgttcgggaatgcaagtcccgaatcgctataaaaagaaaaataaaggagcgcctattatggcagcaactatctggtacgagaaggatgccgatctgtccgtgttcgatggcaagaaggtggccatcctcggttacggttcccagggtcacgcccacgcgctgaacctgcgcgattccggtgtggatgtcgtcgtcggcctgcgtcctacctctaagtccgtggaatacgccaaggagcagggcctcgaggtcaagcctgttgccgaggccgttgccgaagccgacgttgtgatgatcctgctgcctgaccagtaccaggccgccgtgtacaagaaggacgttgagccgaacctgaagccgggcgctgctctggctttcgctcacggcttcaacatccactacggctacatcaagccgtccgaggatcatccggtgttcatggtcgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttcgctcacggcttcaacatccactacggctacatcaagccgtccgaggatcatccggtgttcatggtcgccccgaagggcccgggccacatcgttcgtcgtgagtacgccgccggccgtggcgttccggtcgttgtggctgtggagcaggatccggatggcaagacttggccgctgtgcctggcttacgccaaggctctgggcgctctgcgcgcaggcgccatcaagaccaccttcaccgaggagaccgaaaccgatctgttcggtgagcaggacgtgctcatgggtggcatcaaccacctgtgcgatatgggcttcgatgtgctgaccgaggctggctaccagccggagatcgcctacttcgaggtgttccacgagctgaagatgctggtggatctggccaacgagggtggtctgaacaaggctcgctggagctgctccgacaccgctcagtacggcgattacacctccaccgtcatcactgaagagaccaagaagcgcatgcagtaccagctcaagcgcattcaggacggctccttcgccaaggagttcatggatgatcaggccgctggcgctccgaagttcaaggagctgcaggaagagtacagccacccgcacctggagaccgttggtccgaagctgcgcgccatgttctcttggaacaaccagacggacgccgatgccgatatggccgagtccttcaacggcaagatcgctcgtacccaggttcagtgatttcgctgtagcggctgcatgttaagggccgctgaataacgtagtagcgcaatatgcgcgaaacgtgttggaagccaccgtctcaccgcggtggcttctttttgttgctgtgttgttttatgactgggatatttcgtatgcgggatcgcagtactgattgtcgggggaaccgcacggctaggcgttggcccactttgtggactcaatgcttatttaggaagggacgggagtaggatagaccccagtttgcaggacaaaatccatgcacaaaaacacgcgaattcatctgcgaatggtagaaacccgagcgccgggaggcgttcaccccactacataaaaaggagtgccaagtacaatggctgcacaaatctggtacgagaacgacggcgatctctcggtcttcgaaggtaagaaggttgccatcatcggttacggttcccagggtcacgctcatgcgttgaacctgcgcgattccggtgtggacgtcgtcgttggcctgcgtccgacctccaagtccgtcgagcacgccaaggagcagggtctggaagtcaagtccgttccggaagctgctgctgaggccgatatcatcatgattctggctccggatcagtaccagcgcaccatctgggccaatgacatcgagccgaacatcaagccgggcgcagctgttgctttcgctcacggcttcaacatccactacggctacatcaagccgtccgaggatcatccggtgttcatggtcgccccgaagggcccgggccacatcgtgcgtcgtgagtacgccaacggccgtggcgttccggtcgtcgtggccgtggagcaggatccgcgcggcgacgcttgggacatcaccctggcttacgccaaggctctgggcgctctgcgtgcaggcgccatcaagaccaccttcaccgaggagaccgaaaccgatctgttcggcgagcagaatgtgctcatgggcggcgtgaacaagcttgttgaaatgggcttcgaggtcctcaccgacgccggctaccagcctgaaatcgcctacttcgaggtctgccacgagttgaagatgctcgtcgacctcatgaacgagggcggtctgaacaaggctcgctggtcctgctccgacaccgcccagtacggcgactacaccaacacctgcatcgacgagcacgtgcgtgagcgcatgcagtaccacctgcagcgcatccaggacggctccttcgccaaggagttcatcgaggaccaggacgctggcgctccgaagttcaaggctctgcaggaagagtacggcaacgtccgcatcgagaccgtcggtccgaagctgcgcgccatgttctcctggaacaacggcaaggatgacgacgctgatatggccaccttcaccggcaagatcgcccgtggctgatgcggctcattcggctaatcgctgagtcttttacaagaccgctgcccttacgggtggcggtcttttttgtatgttctgtcgcatattgttctaggatagatatgtacggtttcttacggtttttctataggaagagatgtcatggtcactgcgactggtcccgcacctggttctgaaatgacaacgtcggctgaacctaccgaagaccgtagcacgtcaggagttctgcacgtcgccgcgattttcgcctcgcatatggtgttgcagcgtaacaagcccatcgccgtgttcggcgcgcttgatgccgattgcgccggacttgaggtttccgcggaaatccgcgatttcgatggttccgtgatcgtgcaggcgcatgcgtacgcctccaaagagatcaagaacggtttttcaccgtggcgcgtcatgctgccggcacagcccgaaggtggcccttacacgttgcgcgtcaccgcaggcaacgatttcatcgaatattatgacgtgcttatcggcgaagtatggctggccggcggtcaaagcaatatggaacttgaattgcgcaacagtgaagacgccgaggaagccctcgataactgtgccgatccgttactgcgcttctacaatgtgccgaaaaccggtgtgatcaatcgcaacgccgaacatgcggcaagctggcaggaatcatcgcctgaaaatagtggcgtaatgagtgcggtagcgtactattttgcgcgaaaactgcgtgatgaacttgattccgaccttccgatcggcattatcgactgttatatcgggggtacgtcgatcagttgctggacgagcgaagatgcactgaattccagcgaatccgggcgcggctatcttgcgcgctatgagcaggcgatcgcaggtaaaacgcaggaacagttcgatttggagtacggcgaatggcagtcgcgttctgatacgtggaatgcgtcgatcgcagccgcccgcgaagacgatcctgatgtgacgtgggatacgctgacccaacagtatggcgaatgcccgtggccgccgccgatgacgccgacctcgcagtggcgtccgtcaggcgcgttccatgccatgctggagcgcattgtgccttactccttggcgggattcctatggtatcagggcgaggaagacgagccgtattgcggatcctaccgtgagttgctgggcatgatgattggtgaatggcgtgcgctgtggagcgaaagcctgccgttcctgatcgtgcaattgccgcagtggattgacaagaaggtcgacgagggcgacggcgatccgatgctgtggccggtgttgcgcgaggcccagtgggatgccgcgcagtccatcgacaatgtgttcgccatctgcactatggattgcggcgaatacaacaacattcatccggttgataaacgtacactgggcgagcgtctaggcaattgtgcgcttcgccaagtgtatggtatgagccgtattccggtgtatgggccgactgtgctgggtttccgctgcgacgaaggcggccgcgtacgcctgttcttccggtacgcgcacggcctgcatttcagcggtactacgcccgacagttttggtgacgagttcgccaagagcctgccttcgctggttcgtctgccggaacgttccggtttcgagcttgccggtgccgatggtgtgttccatccggcctacgccgcgattttcgtggattgcgatattgacgatctggtcaacgcaaaggtcaacgtggtcgattacaacgccacggaattcggtattccgatcaacagccgcagtatcggcacgattacgttggccacgccggaagtgccagcgccggtgatgatgcgctacgcatggcgtagctggggtccggcaccgttgtttaatgacaataatctgcctgctcacccattcaagctggacctgaccgatcacaccgactctgatcacgctgaataatcacgttagatagttgcgttgaacggctgcgtcacatgattgtcgatagttgacgatgaatagcgtgcgattgctgtgcttatagtgtgctgcaatcgcacgctttatattgcgattgaagtcctgctgatcgcacgtcagccaaatacgaatcaaataccagtcaaataaaaaatcgttgaaaaatcaacgtttttgcgatttatgccaccaaaatcgcagaaacgaatcaaataaaatgcgctgcactgcgagcgcataggctattgccagaggtccgggccgaatgattccaggtatgcggtcagttcggcggccatctgttcgtcttccggaacgcgcggatggccatccgtgccgcaaccattgcgtgaatacaagaaatgttttacgtgaaactcgccctcagtgccgcggccgttgccgtggaagatggcgtggaacttaccgtcacagccaagagctacgtgcgcgacctgttctgcatggcagacaaggtcgacgcgaaggcttcggtggccgagggcatggtctcgctgcttccgggcgaaagcgtcgtgctgcatatcgccactgccgatgccgcagcgcttgccgctctgggtgcgttcgcagccgccaacgtgccgcgttccgccaacgatccgaagcgcgaatggtgagcttccgcgagtacgccgtttactgaagcggtagaagagtggatagaggactactgaaatttcagttgacgtgttcggttgagtaaaaacataagttgaagcgccgccaaccttaagaaacgaaagtgttgtgaacgctgacttttcaagaggttggtcggcgcttttactgtacgatgtagatgaaccgtttaagttgcgatttaagttaagaagaaggacacggacatgcctattcaaaaaagcaaggtgacgatttttgacgttgccaaggcttcgggagtctctagtagcgccgtttcgtatgcgctcaacggcaagtctggtgtttccgatgtgactcgagacaaagtgttgaaggtcgcacacgaactgggatggaagccgaatggcgcggcacaggcgctggccaaggcgaagacgcggcgcgtgggtctagtgttgggttacgacccgaagctgctttccgtcgaatcctacatgatggaacttatttccggtcttggcgccgagctggaaaaatacgattattctctgctggtacgcatggccgtgggtgaggacgcgaagctttcgatcatcgatgattggattgctactggcaacgtcgacgccatgctgctcgtcaatgtcgagcttggagacccttgcgttgccttgcttgaggagcatgaggagatgccggtgcttgccattgccgatgcctccgtggtcggcaatctgtcgagtctgtcaagcgccgacgccgatgccgtgcgccgagcggtgcgatacctgtatgatctcgggcatcgtcagatcgcccgcgtcggcggtcccgaatcgcttgcgcactcgtatattcgcgattccgcctttgcggacgtcgcttccgagctgggcatgcgttatcgttgcctgcacaccgactacacgccggaaaccggtcgcgaggccacgaagcgcctgctggcgttctctgagcatccgacggcgatcatctacgacaatgatgtgatggcgttggctggccttggcgtggcagcttcgcaaggcatcaaagtaccggaggaaatctccatcatgtcgtgggatgattccctcatgtgcaccgcggcgtatccgaacctgaccgccatgggccgtgacgtggtcgataccggtaggcaggccgccggattgctgctcaagctgatcggcggcgagcgtgtggggcatctgatggaagggccgtacgaattgcgtgcccgcgcttcgaccggtcccgctccggcagcggaataagatgcgatgatgagttaatgcgatgatgaattaaaaaattgcgattgcgcatttgctgcgccccgacaagggcaggatgaaagcgagcagcgagccgatcgcggcgatcgccgcaagggttacgccatacaggattgcgacggtgttgccggactgcttcgacaggtaccacaggtcgaacggcgcgagtccccagaacagcccgggaatcgcggattggaaatcaaaatctgaaatcgtaatctgaaatcaaaaagcgcccgtgcccctcgcttgaggcacgggcgcattgttgccctacgacttcaggcgcgtttctgtgtgatctgataggcggcgaacagcacgaccagccaaatcacgccggcgaccactgcgatgcgatagcttgcggagaagcacatcagcaccacgaccagcagcatgaacgcgatcaccacatacggcgtcaccttggcgaacggcagcttgaacgcaagtttgtcaagtgcttcctggcccttcaatcccttcaaatcattcggaccgtcgccggcggcgacaacgcgacggaacttaatttccgtaatcatgatcatgatccaattaatcgcagcggcaatcgtggcgatcgacatcaaataattgaacgcgaaatcaggccacacgaacaccaccaccacggcgatcgcaatgatgatggccgacgtgatcacacccccgaccggaacgccgcgcttgttcagacggcccagatacgcgggcgcattgccctgcttcgccaacgaatacagcatgcgcgagttcgcgtacaggccggagttgtacacgctcatcacggcggtcaggcacacgaaattcagaatgccggcggccgcatgcacgcccaccgagtcgaaaatctgcacgaacgggctggaattgccgtcgatcgtgctccacgggattacggccatgatcacgccgagcgcgcagatgtagaacacgagaatacgccagataatgccgttcgtggccttcggaatggtggtgcgcggattttcggtttcgcccgcggtgatgccgatgagctcggtgccgccgaagctgaacatcaccacgaccagcgccatcagcaggccggtccacgtgccgtccgcattgcgagacatcaggccatgcggcaggaatccaccgtcaacggtaaaccagttggcgaacgacgcgcgaatgcccgaagcggtcggcacattcgcgatgatcacatacaaaccgccgaaaatcatggcaagcacggccacgatcttgatgatggcgaaccagaattcaaattcgccgaacttgttcacgcccataagattcagcgccgcgatggccaccaggaacaccgccgccgacacccacttcggaatgttcgggaaccagtaattcacgaacgagccaaccacggccaactccaccatggccacgagcacgtagttgaaccagtaattccagccggaaataaagccggctcgcttcgaccagtactgcgtggcgtaatagctgaacgcgcccgccttcggatcctcgaccgccatttcggacagggcgcgcacgatcaggaaaatcgccaggccgccgatcagataggcgagcagaatggccgggcccgccagctgaatcgactcgctggaaccatagaacaggccggtgccgatcgcgccgcccaatgcgatcaattgaatatgacgattcttcaaagacttgcgcagcgtcggcggaaccggcacatcgtcggtttcgcgcggtttcttcgcaacggttgcgtcgctcatgaatgcttcctcttcttgggtgcctcggcaaattcggcaaattcggcaaaagtttgcgatcttggcgatgttgcgttcggcagtagtggtaggtgacgcgcctatggtttttggtatggcgcgtcttccccgattgtagctgtagcgcgtggattcggtttcatagtgttcaatagttcgatagttcaataaaatgaaggttttgggagcaatggttggtgctgcttgagcgctacgggctggaggtcgtcatggcattcatcaaagacatggtgcgtatgtggttgcatgcgtggaagcgattcatctccatcgcactgatctcgttgctgggcgtcgccgtgcttacgggcatttacgcgggttgccgagacgcttttcttgcgacggatcgttttttcgacacccaaggattgcacgacattcaggtgttgtcgacggccggattgaccgatgacgatattgccgcgctccgtaagatttccggtgttgcgaaagtgcagggcgaacgttcgcaaaccgtgaccgtcgatctgaacggcaaaaaaaccgtgaccatgcaggagatcggcacgaacggcattgaccagccgtatttgcaaagtggccgtatgcctgaaaagtccggtgagatcgcggtgacgcgcaaattcatcaaggattccggatgtaaaaagggcgaccatattacggtgacaccgcaggattcggcgtcttcttctgtgtccgattctgcagaatcggacaatcaaacgggcgaaaacgggtcccagatgtccgattctgcagaatcggacacgcaggatggcaaacgtgccgcacgggtgaccgattctggtgaatcggacaatcaggcaccgagcttccccaccgaactgactattgtgggcgtggtgcttgacccgcaggatctcaccaatccagacggctattcgggtacgaacgcattccgttcctccgccaccagcgactacacgttctttgcgccgtccgacggtgtgaccggcagcatgtacacggccgtcaccattctcgtgaaaggcgccgccgacaaggactcgttcagtgacgtgtacgacgacaccgtcagcgaagtagctgaccgcatcgacggcacggtgcgaaccaatcgccagaaagcgcgtcatcaggaactactcgacgctggaaccaaacaaatcgacgaggcgaaagcgcaaaccgacaaacagttcgccgcagcgcaacagcagatcgacagcaatcgcagccagctcaatcagcaaatcgaccaaatcgtcaatatgcaggcgggcgcggctgcaggatccctcgacgaaacaacccgtgaaacactacgtgaaacggtaattgccgcaagcccgcaattagcggaagccaaagcgcaactcgaccaggcgcaatcgaaattggaccagcagaaaaaagacaccgaacggacactgcaatccaagcaaaacgagctggaagacagcattccgcaagtgcgttggtatgtgcaggaccggtcgcaaatcggcggattcagctcgctgaaatctgatctggaatccatccaatcgctgggcaacgcattcccgatcgtgttcttgctcgtggcggtgatgatgagtctgaccgccatggcgcgcatggtcgaagaggatcgcgggctgatcggcacatacacagggctcggctacgggcgtcttgcggtcgcctcacgatacctgttgttcgcgctgttcgcctgcctgatcggcggtggactcggcctgatcgcaggcttccttggcattccggcgttcctgctcgtcgtattgcgaggcttgtatgtgatgccggacgtacgcttggcatacgactggctgtacggaacggccggagtcgcgctgttcgtggtcggcgtgcttgccgcaaccgtgtatgcgtgcgcgcaggaaatgcgacagaagccggccagtctcatgcgtccgaaagcgccgcgtgcaggatcgcgcattctactggagcgtatcaagccgttgtggaatcgcatgagcttcctcggcaaagtcacggcgcgcaacattttccgtttcaaatcgcgtctgatcatgacggtcggcggcgtggccggctgcaccgcgctgattgtgtgcggacttgcgatcaacgacaccgttgccgcattgggcgcgaaacagtatcaggacgtgtatcagtacgatttgatggtggtcgcgaacgatgatgacgctgatgcgatgcggcagaaagtcgcttcggatggtctcgtcacgtcgagcatggacgtgcgcgttgaatcgggtgatttgaccggcgattcggggagcgaaagcattcagctggttgccgtgcccgacagtgaacgcagcgagttcggcaagatggtcacgttgcagccggtgcgctccagttgggtggatggtgcggccgatacggtaagtctgggcgatgacggcgtgatcgtatcgcagtccgcggcaagcgcgatgggcgtcaaagcgggcggtatggtaacgctgaccaacggtgacgatatgcaggccgaagcgcatgtcagcgcggtgatccgcagtgtgatcggatcggacgtgtatgtgagcgaaacctattatcgccagctgttcgatactgctgcatccggcacgtcttccgcatcttccgcgtccgattctggagaatcggacaatcaaaacggcgaatccggtacctcgaatggcgcatcgtcaaacggccaacaattggtgtggaacgccatgtatgcgaagctcaaaggttcaggcgaatcccaggccgcctatgcggaaaagctggaagacgacgatgcggtcatgaaagccgtgagctgcgcgcacatggcggaaagcttcaaattcgatctgatgggtgcggtggtcgcgctgatcgtggcgctcgcgggcgggctcgcgctcgtggtgttgttcacgctcgccaacaccaacgtgtcagaacgtgaacgcgagatggccacgctcaaggtgctcggattcttcgacaaagaggttcaccactatgtgaaccgtgaaatgatggtgctcaccatgatgggcgtggtgctgggcttgcctctcggccgtttcgtcggcggattgctgacggctgcgttgaatatgcccgcactgtatttcgaagtggaatgcacgccgttgagttatgtgattgcggccggcgcgaccatggctttcgcgctgctcgtgcagttgttcgtgaatccggtgttggatcgtatcgacccgattagttcgctcaaatccgtcgaataggcgcatgtctgaatgtccgattctccagaatcggacaactagacgggtaaaagtgtgttacggttgtccgtttctccagaatcggacacttagagtgccggaaaggctcggattcgcgtttcagttcttcggataacggtagttgtgtggcagttgcgtggtgagctgcgggtccaggccgagttccttcaactgccggtcgatttcgcggcgcgcacgtttcacaagttcggctcgatattcatcgccatgtccggcattgctatgtgccgcatcgccatgtcccatcgttcccatcttctccagtgcgtccaatgtttccgccatacgcttgagccggtcctgatggtgcagcagcgcacgcacctgcgcatgttcgtgcacgatcgtccgccaatcggatggtgtgtgtgcaatctcccgaaccgcggtgaccggatgtacgtcggccacctgatatgtgatcgagccaagcagcggcattaggaacaccgtaatcgcgccggctgcgaccagtgttgacgcggtgtcgccttgcatggtgccgaccttcaccgccagtgacgtgacggcgacgatgatcggcagcgcggtcgtgcaatacagcgctacggtgacgcgatgatgcgatgacagcggattctcgcgtttgtcgagcgatagcgcaacatatacgggcaccgcgcgaatcagcatgagcattacgatgaacgcgacgagcagcgcgggtcggcctgccacggcgcgcacgttgatcgcggctcctgacaccacgaaaaacacaggaataaggaatccgtagccgacgccttccagcttcatttccagcgacttgctgccgtcggggatgatgtaacgcaggatgaagcctgcggcgaacgcgccgagcaccgcgtcaagttcgaacagtgcagaaatggtgacaaggaagatgagcaggaatgtggtcagtcgcatgagcgtttgcgatgacgtgttcgcgttttccgtaaggaaacggtacaggcgatggccggttttcagtgctttcgtgggtagcattgcgcacagtagacagatggtaaggaacgcgccgagcacgagcatggtctgccagccggttcgggtggatagcaggatggccatggcaaggattgggccgagttcgccccacgttccgtacgagatgatggcgtcgccgatgggggtgccttcgaggttgcgttccttgagaatcggcatgagtgtgccgagagcggtggtggtaagtgctattaccgtggcgatgccgttgatgccttgctttgcgaagaatggaagcagggtcacgacgagtccggcgagccccaaggtgatgatccatgtgacaaggccgactttgccttgatgtccggcgagtcgtttcgggtcgatttcatagccggcgagcaggaataggaacgccatgccgagctcgctcaagagtttcacggcgtcgttcacctcgattacgcccagtccgtacggaccgagtgcggctccggtgacgagcagcagcacagtttgtggaatgaaccttcctggaatcagctgcgtcacaatcgggctgacggccgccaccgccatgatgatagtcaatgaaacgagctcttgcgtcatgtttctagcctagtgagtctgcatgacggtgttcgaggacgtgatgccccatgatgagccaaagggcactctggggcaaggttaagtttttgtaaattttatgggggggggggggtaattctatgagcgttactatctgtgcaaaatggcggaactgttttgttttgaagatggaactccttcttttcattgggggaagggtgggctttattcgagggttttaacgagggtgccaatgggaaagctccgatacgattctgaaccaagctgtttaggcaatatagggggagggaagaatggttgatggaaaattcaccgcaaaggagcgcgcgtatttggccagccttcccgcagtggaaagcgtgagcgcgtcgcatatccggtatgccgacagtttccgcatcgaagtcatgtgcagatacaatgcgggcgaatcgccggccgccatcttccgcgaggcgggtctcgacccgaaactcatcggatacaaacgcattgagcggtgcattgcacgctggaaaaagcaggaggaacgagaccgccgcaacagcaagcgggtggaccgcgacgacctgcgcgtcattcggcatcatgatcttatgcgcgatgatgcgcaatcgtcggcaacggaatcgcaggatgcgctttcgcagctcgcccaagcgcaactcatcatcaaccaatgcgacgaattgatcgcgaaacaggcgttgcgcatcgacgaactggaacgtgtgctgcgaaagcttgtcgggtgacggcacggttgcgtgagatggaggaaacggcggaatggcatgacggtcgttggccgtcatccgaagaggctccgatgggtggtcgactttcgttggaaagtcgctttccgtcgttcgaagaggcgattgacgttgccgacgaaatgcgtcaacgacgtcacgctcgcggcaaaacgctggcgatgcgtgcgattgcggcgctgttgattgtcgctgcgatctgtattggcggttttccggcgatgttgcagtatcggtcggcgcgtgatctgtcgggaacgtcggtaagatccgcgcagacggttgcgggctggccgtatccgcaggcggatgacgcgttcgccgcggcccaggactataacaagcggcttgcgcagtccggacagccgattttaggtgaggcgaaggatccgttcgctgatgtgcgtggaggatcgcgtgccagtgtgtccgattctggtgaatcggacaatcagagtggtgcgggtacaggcgcggacgccggttccgcggacgctggttccgcaagcgccagttcggcggacgcggagtaccggagtctgttggattccggcggtggcgtgatgggtacgattcgcattccgaaaatttccgtgagactgccgatctaccatggcacctccgaatcggcgctcgcttcgggcgcgggccacctgtacggcagcagcctgccagtcggcggcaagagcacgcatgcggtgctcaccgggcatcgcggactggtcgaggcggccatgttcacgcggctcgatgaaatgcgtgtcggcgactacttctacatcgaagtgatgggtcgaacgctcggctatcaggtggaccgtatcacggtgatcgagccgaacgacacgtcgcagctgaaaatcgtgcctggtgaggatcgcgtgaccctgatgacctgcacgccgtatggcgtcaacacgcaccgtctgctggtttcggccacacgttccgccattccagatgagattcccgccgaaaacgacgcggtgaaggatgcccgcgcgattggtgcgatcacaggtattgcgactctcgtagtgggcgtgttgttggtttggttgcgacgcaagccgtggcatattcgcaggcatgctgcttggtggccgaagcgcggctgattcggttacatttgcgtgaataatcgcgcttttcgcacgtttttccttttgtgatgtcgggtgattgcgccgtaggaaatgtgttgcagggattttgttgttgcgctgttgccaaaccccgactttcccgcacgtagggtgtgcgcgcgattgtttgatttcctttagttttcagggttgaagcagtgtcggattgctccaggcgagtcagtggcgcgattcgatgagagacgtgaattaaggggatgcatatgagacatgtgcacaacgaggcaaagccgagggaaggctttgttcaacgcatggttgcggcgctcgctgcgattgccatgcttggcggcttgggttacgtcaccacgtcttccgccattgcggaagacgaccagaatccttccggtgacacttccaccttgcagcctgcgaatagtaaaagcattgccaaaatcgaaggtggagacggtgatcagtatgcgttgcatttgactgcgtccggcgatagttcgtcatccacggttacggccgcggtgcctgccgacattgtgctggtgcttgacaagtccggcagtatggaaaacagcaaccgtgacacgaatgcgaaaaacgctgccacggccttggcgagtaagcttctgacggccgcgaatgccgctcttccggctgagcagcaagtacagatggcggtggtgacgttcagcgacagggcgcgaaccacttcgaatttcacggcttctgccggcaacatcagcacggccgtcagtgcgtggccaaatggcggaaccaactgggaagacgctctgaaaacagcgaacgatctgtcgtcaggacgttccggtgtgcagaagcatatcgtcttcctgtctgacggcaatccgaccttcagaatcacatcctattccggatgcttcaagtggagttggctcggtcagggatgggaaagccatcctgaatacgggacacaggcggagtgcgaggctaacaataagtggttggaccagtcctaccagtggaaaaccgacccggacggctcggacggaaacatccacggcgagggcaatgacgatagctacggctacaactatgcggccgctctgtcggaagccaacaaacgcgggaacgcagccctgtatgtggtgaaggtttcggccgacgccaataagatgagcgacctagccaaagaagcgaacgccgtcaccggcaaggaatacgacggaacgtccgcggacaatctgacgaaggcattcgaacagatctacaacaccatcaccacaaccgcgaaaatcagagcgtattccatcaccgacaccctgtctcaatgggttgatccggtcgatttcgccgatgtggcaaacggcaccaatatcacgcaatatgtgacggcaaccaacaatggcgcaaccgtaagcggatatacagccgtctacaacgtcgacgacaacggcaatcgcacgattaccgtgacattcaacaatgggaacggcatgatcgtcgacaaaaacgaaactatcgacgtttccttcaaggtaaaaccaagcgacgccgcatatgcggattacgcaagcaagcagcaatacccggacacgggagaagccaataccggcaatgaatccgcaggaaagcaaggatacttctccaatgctggagcgcatctgaactactgcgtggtcacgtccgttaacgaccaggaatcggaatgcacccaacagacgctcgactatgccaaaccggtcgtgcaagtcagacttggccaaatcaccatcaacaaggtgtggtccgacggtgcgagcaagcatgcgagtgacgcggtgacggtccaattgcagcgcacgaagaccggggaagcggtcgcacaggctgaaaaagtaggcgatccaatcacgttgaacgcgtcgaataattggacggccacgatcggcagattgcagcccggatacacctacagcgtggctgaaacgtcggaagacagccgctacgcggtctcctaccagtatggcaatgctgcgagcaacgcgaccggcgtggacctcaccaaagccatggtctggcagagtgacggcaacggcggcaacatgacggccacattgaccaacacgttgaagagcgcgacgctatccaatgtgatcaccgtgcagaaaatcctagaggggcgcgactggaaggcaggcgattcgttcgatttcgaactgaccgcagacggcaacgcgccgctgccggccgattgcgcgcaacaggcgcaacagtcgtgcaaggtgacggtcgcctatgatgctgattccccggatagccagcattccgcaacgttcggtgacatcacctacaacgctggaaaagccgactacacgtacaccattacggaaggcaacggcaatatcgcagccttgtactattcgggcgcgaaataccagattgtggtcgccgttaccgaaacgaacggcgcatggacggcttcggtgaaatccgtgacgaaactgctcgacgacaacggcaagaacgtttccgaatcgcagaaaatcggcgatccgatcgcattcaccaatacgtatgtggcggtatcggcgttgccgttgacgggcggaaccacggatcgtcaatggctgctggttggcggctcgatcggcggactcgcagtactgctggttggcgcggctggcatctggaacagcaagaaacgtctcgtctgagatggttcctcgggctggactgccctaccaaccttcacagggcagtccagccgcacatcacaaatttgtggatccggagcatgttgggcttcagatcccgttagcaaaaacaaacacaacatcaacaacacaatgagaggggattctcatgaagatgaggaaacttttcgcaggcatcgccgccgctgcgacgttgctcggtggcatggccctgggcgcaaccagcgcacaggccgatggcgccggcactatcgttaccgatacagcgaatttcacgttcactgctcaggacgccaagcagctgaccaatcgtagtctgaacgcctacaagatcgccgattatgtgcagtacggcactggtgataatgcaacgtacggtgtgcagactgccgacggtgttaaccgcggtactcttaaggcggcacttgagtctgctactggcaagactgtctctgaaaccggcgatctgatggcttgggcgctcgccgaaggcgtgctgtctgtggacaattctgcagatggtgcatggaataatagcgcttcccgtaagttcgtggaatcgctgaagaccacgactgacaagcttggtaccgtacaaaaggttgatttgggtgctgtcgctaatggcacttccgctactgtgcagctccctgcaggcctgtacctgtttgtggacgcggattacttggttggcaccaatggggctgccactccgtctatcgcaatcctcgttggctccggcaacgttgagaatggcgtgctgaatccgctcactgcggcaactgtggacattaagaaccagaccaccactgtgagcaagacggtgagcgctgcaaccgcttccgtcggccagacggtgacttacaccattacgagcaaagttccgcagaacacgcagtactacagcgattacgcctacacctacacggataccccgtctgctggccagactgtgcatctcgattcccttaaagtgacggttggcggtagcgacctgaacaagggtaaggattacaccgtggccgagggcgagaatggaaagttcactgttaacatcacctccatcaagcagcagaacgcaggcgatgagatcgttgtgacctacgatgccgaggttaccgaagcggaagctactggccgcaaggccgtgaccaatacggttgtgctctccgacaacggtgctaaagccaccgacagcacctccatcaccaacggtcagttctccttcaccaagaccgatgcccagggcaatgctctggctggtgctgattttgagatcgaaggacagaacggtgcctcgactccgtccactgctactgcgacttccgattcaaatggaacggtgactttcaagggtcttgcggacggtacttacaaggtcactgagaccaatgttcctgcaggcttccagcagaatctcaaagctgcatttaccgttaccattgcgaacggtaaggccgtcaagtatgcaggtgccgatatctggggcttggctccgagcgctgaggtctccggtaactacacgtacaaggtcaagaacgtgaagaacgtcacccagctgccgctcaccggtgctgcgggcacgaccctcttcaccgtggtggcgctactcgtggcaggtgccggcgttgccgtcgcgctcaagtcgcgccagcgcatgcgctgatacgcgctcaatcgctgaaacaataagcgcataagcagccataagcgggcattcgcggaaaccatccgtggatgcccgcttttcatgtcttttcgtgcctttccatactttttaggggtgaaggttttgcacggggcaatacgggatcgaaacgggtgaaatccggtaccaaacggcgaaatccggcatgaaaaaggtatccgcaagtggcagttaggtggcaaaacagtcgttaaaaagcaatcatgcaggggttgcaggtgggggcatctcacgacaatggcaccctacaatcgcaagcacatccatgaaaacagtggaaaggcgggtgccatggcacgaggtgggggagcattcagcgacgaggaaatccaactattgcgcggactgccagcggtcgccaacgtaacgcgcaatcgcatcacctacgccgattcgttcaagcaagtgtgcaccatccgctacttgacaggcgaatcgccaaccaaaatcttccgggaagcgggacttccgccggatctcatcggatacaagcgcatcgaacggtgtgtggatcgttggaaaacgtcggccatcaaatccgtgactggcagcggcaacatgagcgacagcgagatcatcgcgcaactcgtcaaccggtatgagcatgcgttcgtgatgaggcgcaacctcgatagcatcaccaacaggacgatggaacatattcccgtcaaagcgcaaggcgacgacggcatcgacgtgggaaccgcgagcatcatcatcaaacagcaggcgcgccgtatcgacgaactggagcgcgcgaacgccgaactgcgcgggcaaatcgccgccaccgcctgacccagaccatcgttatgccgcgtaagtgtctgattctgcagaatcggacacttacacaggcaaaaacgggtctcagttgtccgtttctggtgaatcggacaagtaatgcggcgaaagtgcgttgcggatgtccgtttctccagaatcggacaactggagtactgaaagtgtgctgtggatgtccgtttttgcagaatcagacaagcgaggcgcgatttgtgtcggacagttgggcgtatctcacttatatggcagatttgctcatgcgtcatgagccatttcgcttatatatggcagtcagcctgcggaaatacgcccaaaacgtaccccctaagtggtgttttgccgtgagcaagtgccatatataagcgagaaagtagcggtcaacctcgtgaatctgccatatataggcgagatagggcggcaggggggtatggcgaggcgaaaatacgggaataaggtggtcggctgggcacggttgaccacaaacgggatgcgccagtgccgcaaaatctgcgtacgtgcccaaaaacaaagcttcggcgggcgcaatgtgcggttcgcggggtagggtagtgaacattatgacttccgagaacaccaattccgcgggctcaagcgccgcgcacatcaaatccgtcgaaagcctcgaccaaagcaacgaaatggagcgaggcctgaaaaaccgccacgtccagttcatcgccatcggaggcaccataggcaccggcctgttcctaggctccggcaagtcgatcgcactgaccggcccgagcatcattttcgtgtacatcggcgttggcctgattatgttcctgctgatgcgtgccatcggcgaaatgatgtacagcgatcctagccagcacacgttcatcaacttcatcacgcgctatctcggccgcgggtggggcaagttcgccggctggacgtattggatcgtgctcattctgaccggcatgaccgaaatcaccgccgtaagcacatatttcgtaacgttcttcggcacattcggcatagacctgaactcgtggaagtggttgatcgaactgtgcttcctcgtagcgctcaccggcatcaatctgattgcggtgaaagtgttcggcgaggcggaattctggttctccatgatcaagatcacgctgatcgtcggtctgatcgtcaccgccatcgtgatgctgatcatcggcttcagctaccccgccacgcacatcgaaggcgtggacggcacggtgtcgggtgccacggtgagccttacgaatatcaccgacggcttccagctcgcgccgaacggttggatgaacttcttcatgagcttccaaatggtgtttttcgcctaccagctcatcgaattcgtgggtgtcacggtgtcggaaacgcagaatccgcgcgaggtgctgccgaaggcggtgaacgagctgatcatgcgtattctgatcttctacgtgggcgcgctgatcgcgatcatggctattgtgccctggcgtaactttcacgagaattccgatggctcgttcggttcgccgttcatcatggtgttcaaatatgcgggtcttgattgggccgccgccctggtgttcttcgtggtgattacggctgccgcgtcggcgttgaattcgctgatttattcggccggtcgtcacttgtatcagcttgcttcggattccgagtcgcctgcgatggcgcgtttggctgaggtttccgaccacaaggtgcctgcgaaggcgatcgtcgcttcgggttgcatgattctgttctccccgatcatcaacgcgattccgggtatttccggcgcgttcgtgctattcgcttcggccgccagcgctgtggtgattttcatttacgtgctgacgatgctcgcccaccacaggtatcgtcagagcagcgattttctaccggacggtttcgtcatgcccgcttggcaggtgtttgattggattgcgatcacgttctttgtgctcgtgtatgtcacgttgttcctgtcgacggacacgattggttcagcgattgccggtctgatttggctggttgcgttcggcggatattgcctgctacacgaacgattccagaatcgcgatcttaaggaagccttgcagcagtaacgtttgcaggtaacgcaggatacaagtaaggggcgtttgccgaacgtgagtgcatcacgtacgttcggcaaacgcccctttcagcatggtctttgcgcgaatccccattacgggatccagcgcaaatcagccgatgtagtcggcctcgttcgtcgggctggacggcacggcatgatcttccgtaaccttgcccaagccagacaaatacgcttcacgacccgcttcgatcgccttcttgaacgcgcgtgccatcagcggaatattgccggcggaagcgatggccgtgtatgccatcaccgcgtccgcgcccatttccatggcttccgcagcctggctcggacggccaataccagcgtcgatgatcaccggaacattggagttcttgatgatcacttcaatgaaatcgcgtgcacgcagacccttattcgagccgatcatcgcgcccagcggcattacgcaagccgcacccgcgtcttcaagacgcttcgccgcaatcggatcggggaacatgtacggcatgaccacgaagccttcttttgccagctgtttcgtggctttgatggtttcctcattgtcgggcagcagatacttcgcctcatgttcgatctccaccttcacgaagtccgtctggcacacttcgcgggcgagacgtgcaatacgcaccgcttcctcggcattgcgtgcgccggacgtgttcggcagcatggtgatgcctttcggaatgtaatcgagcagattgttttcggtggtacggcagcgacgcaacgccatggtgacgatctgcgtgcccgcgttctcaatggtcgccttgatgaggttcagatcgtagcggccggaaccgaggatgaagcggctcgtgaacttgtgtccgccgaggatcaacggatcggcgtcgccggtggcgatttcgtcatacgcgtgcgcatccggttccggcagcagtgcggtgttcgtggtggtgccgaccagctcgtcgagcgtggcgttcggtgccgccgcgaagtctttttccgcggtggtgatcgtgttttcggtgctcatggttaatccttactatgcgattagtgttgtgtcattcgttgcgatttgcgattgcaattgcaattgcaattgcgtttgtgtttgcgtttcgctgtcaggcgtcttcttcgccgagaatcaagcgagtgatcatattggcttcatggcaggcgaccacacccacgcgcggtgccatcagaccagcgcccggcaccggagcggtttcgccgtcgccgcagaagtagaaattcttcgaaacgcgacgagtattcaccaaattggaactgcggaatcccgccattccagaagcgctcaccagcttcttgttcggcagattctcaagcacggcattcaccagcatcgtcttgttttccggcacgtcgaacgcttcgcaaataatatcctcattgccgaacagcgtcggcacgttctcgtcggtcactttcacggtatcaatggtgatatcgataaaaggattgatctgacgcaagttactgcgcaatgcttccgtcttgtactgcccaagatccttcaaaaaatactgctgacgattcagattcgtcatatccacgcgatcaaaatcaatcaaatgcaggtgaccgacgccaatgcgggtcaacgccaccgcaatggccgatccgaggccgccgcagccgcaaatggccacgtgcgccgcgtcgagcttgtcttgcgtggctgcggtatgacggtcgagcagggccgcacggatttcttcgtggctgacgagcgtggtcgggtcgggctggttgtcgaaagcgtgctggcgggcgtcgatctgcgcctgcgatgcggatggttcaaaagtcatggttgttctcgtattctcgtattctcgttttccgttcgtgcgttgtttttgccgggttggttgtgttttgtatgttcttgcgattgttacgcgtgcatcgtgccggtcgtaatcgcaagaaattttgaaagtggttcagccgccctgcacgaacgtgacgatttccaacgtatcggtgcccttgagctgcgtctgcgcacgctgggtgcgaggcacgatctcaccattgagctcgacagccacgcggtcggcgcgcaggcccttgctttcgatcagttcggccacggtgatcggcgtggcgatgttctcttccttaccgttgatgatcattgcggttcccttctgtgtctgtcgtgacacatgcttcctgcactccaaatgtccgtttctggtgaatcggacatccggaggttcattgttggtctttaaatgtccgattctgcagaatcggacacgcacggcatctatttcagtccacggatgtccgtttctggtgaatcggacacgtaggcgcttgttcgagccgcttgtgcgtccgtttctgcagaatcgggcactcgaggttggtacgaaaaaagggtcgccgaaggaaccgtaccctatgaggtggtgcgcccctccgtgaccctaatcacgcgatattcggttatcgcgaacggaagatgagatacgtcttgcggcgtgaacaacccgtctccttacggcggcattacccgcatcaagtcctcggtcgaagctctatgagctccctctcagcctttcggctcccgttcggttgtgccttcatcttcgcgcacgcgcccgacaagcttgcgccggttcacgttgggttagtcttgatgtgaacatgtgcgaatcggctgagtgcttgcaaggaaggggaagatgatgatggacggcgagttggcaggatttgcgattcctcggcttggtatgggaacgatggctttggcgattgaggggcgcccggatcgcgataccgcgattcgtacgattcatgccggtttggacgcgggtgttcgctatttggacacggcttggtcatattatctgccgagcgagcctggcaccggcactgcggaagaccttggctacggcgaaaagttggtgcgtgatgcgctcacttcgtggaatggcccccgagatgaagtgctggtcgccacgaaaaccggctatcgacgcaccatggaggtccccgcttttgttgctcctgtgtccgattctggagaatcggacaaacagggtgccggatttggggcacagatgtccgattcaccagaatcggacactcaggggcgggattctgagggatgcagccgtcggcctggcgaggaacgccagcatttgcaggcggcgggcagtcaatacgggtggatggcggattcgcgccccgaaaccatgattcgtgacgccaaggagtccgcgttgcacttgggcgtcgatacgctcgacctgttgtattcgcatggccccgatcccgcggtgccttacgaagaccaatgcggcgcgttgaagcagctgctcgacgaaggcgtgatcaaatatgcgggcatctcccgtgtgaataacgagcagatcgatcttgcgcgcggcattatcggcagcggcttggtcgccgtgcaaaaccagttctcgccgtcgcatcccgatccggaacatacgatggagcattgcgccgaattggggctcgctttcgtctgttggtcgccgctcggcggattcctcgatacgttcgatcagagcgcgtacgatccgttccgcacggttgccgcgcaacgtggttgctcctaccagcgtgtggtgctggcgtgggaattgacccgttacgaacgtctgttcaccattcccagcgctcgcaatccgcaggaaatcaacgattccttcgctgcaacgcaacttcagctcactcaagaagagcttgcgatgcttccttgctgattatcgtttccttttttgggcgttttcctgtacttgcacgttgcgatcgaaaaatgtttacagtaaaagatattatcgagacataactgatgggcatcgaataaggcgaggtgaagcgtgggcttcgagcgggagtcgtttgacaagctgatgaaagtggtctggggtaagaagtctcagatgcagcaggcgatgtcgcgtgattccaagggcgagccattcattattcgcgagcttgagttcaagggcgcgcaaacgccttcgcagttggctaccgcgttgaaggtcacgtcgggcaggatttccacgctgttggctgcgttggaaaaaaagggtctgatcgagcgtgaggtcgatcccaacgaccgacgcattgtgcatgtgaatcttaccgagcaggggcgggcgaaggccaagcagcagcgcgaggatatgcgcgacgccgtctgctgggtcttttcgcagatgggggagcgtcgcacgcgcgaattcgtggatcttaccgaggaatttgccacatacgtgaccatctgcatccctggccagccccgccccaccgccgaagaagtaaagcaagccttcgcaaaagccgaatctgaagatcctgcgtagggactgcctaccacgtaagcgtgcgcctcacatgtgccgttcgcgactgtaagcttggccaaacggcctcgagtgtgtcgcgaatggtatatgttggccgcgcgcgaccgagctgagaagaatcgctctcagcaaatacacagaaatatgagattgtcttacactgtaagtaattaaatatcgtaagacaattcaataggacttatgtaaatcattaatcgcaattcgatcaactcatgtagttgatccaaccaatccatcaatcgcaaaaacttcaaacgcaacacaagagaagggatccaagcatgttccgcattatgcgatacctctccaaagcggagataggccagatgctcattgcactggtcagcatcgtcgggcagatctggcttgacctgaccctgccggactacatgtccgacatcaccaccctcgtggaaacccccggcagtgaaatgcacgatatttggatcgccggcggcaaaatgctgcttatttcgcttggatcggcagcatgcgccatcatcaccggctatttcgcggcacgcatcggcgcatcgttcagccagcgtctgcgttccatggaattccgcaaggtagaatcgttcggaccggctgaaatgagccgattctccacagcctcgctgattacgcgttccacgaacgatattacgcagattcagatgttcatcaccatgggattgatgatgattgtcaaatcgccgattatggcggtttgggccgtctgcaagattgcgggagacggtctcgaatggacgctcgccaccggcatcgcggtagtggtgctgctggtctccatcacgatcctcatggttctcgtcatgccgaagttcaagtccatgcagcgactgaccgataacatcaaccttgtggcgcgcgagaacctcaccggcctgcgcgtggtgcgcgcctacaatgccgaggattaccaggaagccaagttcaccaaggccaacaaggaactcaccgacacccagctgttcaccaaccgtgccatggccttcatgatgccgttgatgaacaccatcatgaacggtcttatgcttgccgtgtactggatcggcgcctacctgatcgacgcggccgacgcggccgacaagctcaccaccttctccaacatggtggtgttctccagctactccgtgcaggtgatcatgagcttcctgctgatgagcatggtgttcgtgctgtggccgcgagcggacgtgtccgcacagcgcgtgctcgaagtgctcgacaccgaatcgctgatcaccgacggcacccgcagcgatgctggcgaagcaggcaagcagggcgaaatcgaattccgcaatgtttccttcacctacccggattcgcgtgaagccatgctcgaaggcatcaacttcactgccaagaagggcgaaacggtcgcgttcatcggctccaccggctccggcaaatcctcgctcatcaacctcgtgccgcgtttctatgacgcgacgcaaggcgaggtgctcgtcgacggcgtgaacgtgcgcgactacacgctcaaggcattacgagacaaaatcggatatgtgccgcaacaatccttcctgttcaaaggcacgatcgcatccaatgtcagctatggcgacaatccgctcgacaccaccgatgccggcatcgtcgacatgaccgatacctcgaccgcggccggcagaaagcgcgaaaaagagctgatcgcaacgcaaaacgagcatcgcacactcacttcggaacagcgcgccgacgtgcgcaacgcatgtgaagttgcacaggcgaccgaattcatcgcaaccaaggaaaagcagtacgattccgcgatttcgcagggtggatcgaacgtgtcgggcgggcagaaacagcgtctgtcgattgcacgtgccgtctatcgtcatccggaaatcctgattttcgacgattccttttccgcacttgatttcaaaaccgaccgtgccgtacgcgacgcgctcgccaaggaagcgaaagattctaccaaactgattgtcgcgcagcgcatcggcaccattatggacgccgaccgcatcgtggtgctcgacgacggcaaggtggtcggccaaggcacgcatagcgaactgctggaaaactgcgatgtgtaccgtcagattgcgcagtctcagctgagcgaagacgaattgaacgacggcaagtcgggcgaaagcaagctgccgggcgaaaccggcaaaccgattgaaaccggcaagccgtccgtcgaaagcgaattgaacgaaagcgagggtcgctgatatgccaggaggacctatgggacgcggccgcggggccgttgaaaaaccgcaggatttcggtggtgtgatgaagaaactggtgcatttctgccgccactacattcccgccatcattgtggcgctcgtattgggcgcgatcggcacggtatgccagatcgtcggtccggacaaactcaaggacatgaccaacgagatcgccaaaggcctgcctgcgctagtcaatggcaagccggtgctcggtgcgatcgacatggacgcggtcacgcacatcgcatggctgctggtggcgctgtatgtggggtacgcggtgctgtgctacgtgcaaagctggatgatggcgaacgtcacgcagcgcaccgcacaggagctgcgcgaagccatcagcgtgaagatcaacaagctgccgctcaagtatttcgacaaggtcagctacggcgatgtgctcagccgcatcaccaacgatgtggacgccatcggccagacgctcggccagtcggtcggctcgctgatcacgtcggtcacgctgttcgtgggcgcgctcatcatgatgttctacaacaatgtgattatgacggtgtgcgccatcgcttccagcctggttggcctgctcatcatgggcgcaatcatgaaggtttcgcagaagtacttctcccgtcagcagatcgcattgggcgatgtcaacggtcacgtcgaagagatgtacgccggccacaccgtggtcaaggcgtattgcggcgaggctgattcgattcgcgcgttcgaaaagtacaacggcgatttgtacgattcgggatggaagagccagttcctttccggcctgatgatgccgttgatgaatttcgtcggcaatttcggctacgtggttgtgtgcgtggttggcgctgtgcttgcgatggatggcaagatcgagtttggtgtgatcgttgcgttcatgatgtacattcgactgttcacccagccgctttcccagttcgcgcaggcattccagaacctgcagcgttgcgcggccgcttccgagcgcgtgttcagcttccttgaagagccggagatggccgacgaatccgacaagcaggcgctgctcggcgtgaacggcaaaccggtgcgcggtgacgttgagttcagtcatgtgaagttcggttacgatccgagcaagacgattatcaacgatttctccgcttcggtgaagtccggtcagaaggttgcgattgttggtccgaccggtgccggcaagaccacgatggtgaatctgctgatgcgtttctatgagatttcgggcggttcgattgcgattgatggtgtggatacgaagtccgtgccacgctggaacgtgcatgaccagttctccatggtattgcaggatacgtgggtgttccgtggaacagtgcgtgaaaacatcgcgtattcgaagccgggcgtcaccgacaagcagatcgaggacgcatgcaaggccgtggggctgcaccactacatcatgtcgctgccgaatggctatgacacagtgcttgacgacaaggccacgctttcgcagggtcagaagcagttgctcaccattgcgcgagccatggttgaggatgcgccgattctgattctcgacgaggccacctcttcggtcgatacgcgtacggaagagctgattcagaaggccatggacgcgctgaccgtggaccgtacgtcgttcgtgatcgcgcaccgtctgtccaccatccgcgatgcggacatgattttggtcatgaaccatggcgacatcgtggaaagcggtacgcatgaggagctgctcgccaagggcggcttctacgccgacatctacaacagccagttcgccctcaccgactgattcacggggtcgactggttcacggagccgcacgctccccaaaggcgtgcggtctttgtttatttcggctgttattcggctgttatgcggatcgcaggaaaagttcggccgggaagttgcggctggctgcgatttgacgggattcgttcaatgttgcgtatgcgaaatcgaacgtgcgctgcaattgcgttgcgtcggaaacgaacaaggctgtggccaggccgtccgcgacggcggcggggtagtcgcgcgcaatgtcgggagttgcgtttgccgacttatcggcagtatggtgcaacttgttgaaatgctgcggattgcagggaatgtatgcccagctggcttcggtctgctgtgctggcagtccgtcgatggcattgagcagatgatgaatggcgatttgggtgcgctcgttgacggctacgttccagtggcgtcggctgggtgcgctcgcgcacaatgcaccatttacgatgtgtgcaactccaatcgcacgagatgaatcttccggatcctcaagtgcgatggaaataggctgttccgcatgaatcagcaaatcaccccccgcatcaatcacaaactgtgtcgaccgcaacatgcgcccaagcaaatcgacaagatagcctttgccgcatgcgccgaaatccaactgcaccgggccgcgcgtgaccagtgttgttccgtgacgctccacatcctgcccccatgtggcgcgtccgcgcaatgcccccaaatgttcgggtgcatcctgcgtaaccgtgaaactcatcgacgcatcgtatccaagtcggatcaaatcctcgccgacgcatggatcaatcgcaccggaagtggcggaaaatagcgcatcatacaggtcgaacagcggcgcgcaccaatccggaaaatcgaaacttccgccatgctcggtcttgccaatcgttgcgatcagcgaattattgcggaatcgagacagcacgcgttcgtaatcttcaatgagcgattccattgcggaacgtgactcgtcaccgatcggcgaatccacggaaatcaccataccggtgccgagcgccctataaaacgccgtgacaaacggcatgcgttgcgtcaaagaatccatgcctccgatgctacccgcccatttcctccagctgctgggggaaatgggactttcgcgatggggcgcatggtacagttgccggcagggcgtcaacatggaggttgatatggggaacgtcgagaatgcaagtgcagccacgcgcacaacaaaaacggtgaagagcctgccgatgcccaaagtctgggctttcgccgtcggccaattcggctgggcgctactttccggcattatttcgaattggctcgtctacttctaccagcctgacagcgaaaccatctcgcaagggcaaaccgtgttcgtaccgcaaggtcttgccgtactcggcgtggtgaccgtagtcggcggcatcaccgcgttcgcccgcttcttcgacgcattcgtggatccggccgtggcaagtctttccgaccgttgcacatcaaaatccggtcgtcgcatgccgttcctcaaatttgcggcccttccgctcgccctcgtcaccgtgctggtgttttggagtccaatcaacgatacgagctggatcaacggcgcgttcctgttcgtcacggtgatcggctactacattgcgctcacgttctactgcacgccctacaacgcgctgatcgccgagcttggtcacgattccaaacagcagctcaccatctccaccgccatttcgttcacgtgggtggccggcaccgccattgcatacgtggcaccggtgatttgggctggtttcgtgccgggcttggggcgtgtgaacgccattcgtttgacgttcaccatcatggcggccatcgcattcgtgtgcatgctggttccgccgctcaccatcaaggaacgcgattacgtcaactcgcagcccacgtccgaatcgaccatcgaatcgttgaagcagacgttcggcgacggcgaattccgcaagttcgtctgctccgacgtggtctattgggttgcgatcactacattccagactggtttgccgttcttcgtgacaagcctgctcaaacttcccgagaccacgaccaccatctatttcgtgctcatgaccgcagtgtcggtgctgttctacatgccggtgaatgtattggcgaatcgtgttggcaagaagcggattctgctggtcgctttcgtgattttcacatgtgcgttcgcgtttgcgggcgcgcttggctccggtctgctcgctgcgattccgccgatggcgcagggcttgattctctcgattgtcggcgcgattccgatggctgcgttcggcattcttccgcaggcgattgttgcgaatattgccgacgcgagctcgaaaacgaccggtcaggatcgtcagggcatgttctatgcggctcgcacgtttgcgatgaagatgggtcagtcggtggcgatgctgctgtttaccggcgtgagcacgattggcatggcgtcgggcgccggctatcgcattgcggctgtttgcgccgcggtattgtgcggcatcggcggtgtggtgttcgcgttctacaacgaacgcaaggtgcttgacgtgctcgaatcctgattccgtccatgcgcccgctggcctcacgattttgtttttcgttgctttttcggaatcgtgaggtcaccagggcggaatcgtgaggtcagaaagtccagctccatcccaaatcccccaattcccgaatcttccaatcgcacgaatatgcatggagaggaacggcgaaagcgcctcaaaaaatcactatgtgagacgactcgcgcggattacagaaaagaagaatggcggaattccgccattttaaaggtttctacaacaaaactgccaaaaaatcaagactgttctttcgatttttttcgttttatcttgtgaagtcggtgcgcactgtgcgtatggcaaaggtggcgcactcgtgaatcggattgtgaatggctgagagaggaagcggtcttatgtcatcctgcgatacgcagcgggctacaagtgtgtccggtcgccttgtcgcgttcattgcggcattgatgatcgcgttgaccacgcttttcgcgactaccgcagttccgcagccggcaattgccgccgatgacggtcaaacgaattttgattcctggactgccgctgcgaagaacatcgaagaccagcttgcgactgccgaaaaagactacaatgacggcaattacggtcaggctggcaccgatttccagactgcgcattggatcggttacgacgcatccaacttctcgaaagtcgtcaacgacaccatcagtgccgacaagcagaaggaactgctgcagcaattcaccgatcttgaaggtcttgcctaccagcaggaccaaggcgacgccatcgcagccaaaatcgacgcgctgaccgccgaaatcaacgcaaccgcgcaaacgcttgacgcgaacgccgacctcgccaatcctaaggaatatgcgaagcagcgtgccgcgcaaaccgcggaagagcgcaagaagctcgacgcggccaagaagaattcatccaaaggcaaaggcgaccgcacgtggagtgaggttgccagcgaaatgaccgtcattctcgaccaggcatacgaggctgccgctgccggcaagggcgacgaaggtgccacgctggtcaacaacgcctactaccagtactacgagaagctcggcttcgaaaagaacgtgatgaacgtgatttccggcgatcgtgtttcgcaggtcgaataccagttcaagatgactcgtaagatcatgcgcgacggcggttccgacaaggaaatcaagcagcatgtcgacgatttgaaaagctggcttgtgaaagacgcggccaccctggacggtggcgcgtccggcaatgtcaacggcttcaccaaactcgtcaccagctccgccggccaggcgttcctcattctgatccgtgagggtctcgaagcgctgctggtggtggccgcagtgatcgcctacctggtgaagtccggcaacaagcgtttcgccaagtggatctaccttggtgtggtcgcaggtctggccggctccggtctggtcgccgtgctcttcacgttcctgttcggcggttccggcccgattcaggagatttccgaaggcgtgtgcgcgctgatcgccaccctcatgctgctgtggaccagcaactggatgctcaacaagagctccgtggaagcgtggaacaactacatcaggaacaagaccgaagcggctgtggccggcgcgcaaagcaaggtcgaatccggtcagagactgggcttgggcatgatcgcctcgcttgccatgctgagcttcctcgccgtattccgtgagggcgccgaaacggtgatcttctacgagtccatctactccatgagccaggatgcgcacggcatgtgggttggcggtctggccgccgccgcggtgctgatcgttatcttcctgattctgcgattcacttcggtgaagattccgatcggcccgttcttcctcgtcacttcgattgtgatggccgtgctggttgtcattttcgcgggtggcggcatccatgcgctcatcgagggtgatcttattgaaggcacctacttgagcagcgtgccaactaacgattggatcggcttgtatccgtacgtcgaaacgattacggcgcaggtgattgccgcgatcgcggtggttgtgctgttcgtggtcggtttcatcaagaaacacaggatgaagttggccgcgcaggcggaacaggctaagtaagcgccaatcaataatcacaagtaaagatttagagatttccataagtttccaacgttcctcaaggaaccaaagaaaaggaagagaacacaatgaagaataagaagatcgccgccctgctcggcatcctgttggcaggctccatggccttctccctgtccgcatgcggcaattccaacgattccgcatccgatgccaagtccgacacctccacttcggacaccaccgacaaatccagcgattccagcgctgatgacagcaacggcgccggcttcgaagagattcaggtcgacgagaagcactccgatcaggatgttgacgctctgaccgtcaacgccgtgtacttccagccgatcgatatggaaccgtccggtatgggcctgaaggctgccgacgcttccttccacctggaagccgacatccatgccaacgagaagggcaccgagctcggctatggcaagggcgacttcgtgccggatctgaccgtgaactacgagatcatcaacaacgcgaacaacgagaccgttggttccggtaccttcatgcagatgaacgcttccgacggcccgcactacggcgccaacgtcaagctcgacgaggctggctcctacaagctcgtgctgaagatcgaatctccggagaagaagggttggatgctgcatgttgatccggaaaccggcgttaagggccgcttctggaccgagccgctcgaggtcactttcccggagtggaactacaccccgcaggagtggtgatctgaaacgtgagttccggcacatgccaagcgaaatggtttggatgtaagcctgaattcatgttgagattcaactcgtggttaacgccgttcacgtatcgcgaaacgtatgcaagtagcgcgaatatgggtacggcgttcgcggttgcctggatagtcgttcgacgcactcaaggccgtttggccgagcctacggtcgaacaaccatccaagcaaccgctctcttgcgtttgaggggatgcgcttttgggagataacgcgcttttgggggaatcttggtaagggggttccttttgcgtgccgaattcactaggctttgacagggatatacaacgaaaggtgtgagatgctgacgcagtacgtcacggtgttgcagggaacgctggcaccggctttgctgattatggcgctgaacgtgatgctcacggtcggtgaggggcgtgacaggccgttgagcgcgtactggcgtcttgcgggcttcattattggattcgcgggtgccattgtgttcgccgcgttgcgtgcatccgcgatgatcaatcagcgtacgttcgtcaattaccccacgttgtggtgttgtgtgattttcgatatcgcagtgttcgttgttgtgctgttcgcacgtcgcatcactacgaattggcatgatcatcgcgcgttgctcgatattgcgaatgcgattggcgctcttgcgattgcctccaccaccttccgtgcgttgcctgatgttattttgcgtttgacgatttttgtggagccaggagatccgatcttcacttcggatatgctgcttcgtgcgcttggtttcgtattgggtgcggccactgcgattgttgcagcgttgattttccgtacgatgcgttccactgcgattcgttggtcgttcaccacggccgtgctgctgctgattgcgctgctgtttgtctcgcatttcactgatcttgcgcagattctgcagtccaagcgcatcgttcatttccctacggaagcgttcctggcgttggtgtggtgcatcaatcatcagcgtcatatggtcattgccatggtgttggtgttcatcattccggtggtcgccagcattgtgatgggcttcaaaatcaagccggaaggagcaaacgaggccattgtgcgatcgcatatcgcgttccgtcgccgtgcgaaggcggccggcgcatggagtcttgttgcgatgatcggcatcacgttcgcgctcacgtatggtgtggcgcaaacgaagaaggtcattacgctgtctccgcctgaggattattcgctgagcgacggcgtggccaccatcaaattcagtcagatcaacgacggtcacctgcatcgcttccaatacaaggcgaaagatggcacggtaatgcgtttcatcatcatcaaaaagaatggtggagcgtacggtgtcggtcttgacgcatgcgataactgcggtgacgcgggctattacgagaaggatggcaagatcatctgcaagaagtgcgatgtcgccatcaacctcgccactatcggattcaagggcggctgcaatcctgtgccgttcgattatcaggttgaatccggcaaaatcgtaattcaaacttcgacgctcgacgcattgtcgacgcatttccagtgagcggaaagaggtagtcatgttcttttttcgaatgattttccgctcgttcagcaggcagttcaaacgcagactgctgatcgcggtcaccgtgtgcctgtcggccacggtcagcgtggccatgctgggtgtggtgttcgacgttggagacaagctgaacgcggaactgtcgacgtacggttccaacatcaccgtgcagcccaaggccgatgccgtcgtcaacgacctgtacaacacggggggtgacgcgaatagcagcgcttccggcacttccgaatccgatccgaccacatttctgaaggaatcggacgcaccgaagatcaaaaccatcttctgggcgttcaacatcacgaattttgcccccgaacttaatatccatgctgacgtgaactgcgcgtccgaatcggtggattccagctcctgcaaggcttccggcgtgccgatcgtgggcacatggttcgccaagaccctgcatatggattccggtgaatccacggtggcgggcatgaacggcatgcgttcgtggtggaagcttgacggctcctggccgaaagacgatagcgcgcaaggcctgatcggcaccacgctcgcatccaaactcggcgtgaccacgggagataccgtaaccctctacaaaaccaccgccgacggcagccgcaacaagcagcggatcaccatcaccggcatttacgattccggcgatagcgacaacaatgcgatgtacattccgtcatccaccgcgcaggtgcttgcgaatctgcctgattccatcgacaagatcgaagtcaaggctctgaccacgccagacaatgatttggcgcgtaaggcgtcgaagaatccgaatgcgctcacgcaagatgagtgggaaacatggtattgcaccgcgtacccttcgtccatcgcctatcagatcgaagaggtcattcccggttccgtagccaagcaggtgcgtcaggtggccgcattgcagggcgatgtgctgcagaaaacgcaggcggtgatggtgctgatgaccgtgctttcgctggttgcggccgctattgcagtggcgaatctgatggccgcctcgattggtgagcgcggttcagaattggcgttgctgaaggcgattggtgccaccgatggtgcggtttctcgcctgatgctcgctgagacggctgtgatttcgttggttggtgcgattgtcggtgcgctgttgggttccggtgttgcgcagattgtgggacatgtggtattcggttccggcattacgatgcgtccgatggtgtttgtgctggtgtttgtgctgctgacgcttaccgtgctgatcgcctcgttctcgtcgatccgttcgattctgggactcaaacctgcggaggtcttgcatggccgctgatgtcaacttgggttccgtaaactcggccgcggctgcggcctcggtcacgaacggcacactgtgctgttcgtctgcggaggtgttgcatggtaggtgagttcaagacagtccgtaaggggcatgagatgactaatcgcaagatgttcttcaccatgctgtggggcgcggtgttccgccgtcgttcgcgggccgttatggccgtgatcgcctccatggtgggcgctgccacgctgttctgccttgcggcgacgtgtattgccgttccacagcagatgaacgaggaaatgcgtgcgtatggtgcgaatcttatcgtcacgccgtccgaatcagccgaaaagtcccacggcatcgacaccgataccgtcaaagcgttgaaccagatggtgaaaggctcgtacagcgcccgttccgccgcttaccggtatgaaagcgtgcgcatcaattctgcgccgtacacgctggctggcatcacaaccaaagacgtgaaggcgctcaaccatcattggaacgtgactggcgattggcctagcgaaggcaacgtgatgctcggccgtgacgtggcagacgcgctcggtgtctccatcggttcgaccgtaaccatcggctaccgcgcatccgacgatgcgcaggattccggcgctcttagccaaaccgaagcgcaagccaaagaaaacggccgcgtttcgtccgacattatggagaacaccggcactgaattccgtgtcggaggcatcgtcgatacgggcggcagcgaagacgaaatcgtctacgcggtcaacgctgacgtggccaaactggccggtttcaaacgcggagcggacgtgatcgaatattccgtcaatgcggtaggcagcgaactcaacgatgtcgtcaaatcgatcaatgcgaatccgtcaaccggcgtgaaagcgcagaccgtcaccaaaatcacctcatccgacactcgtatcatcgccatgctgcaaaccctgttctggatcgtgtcgctggtcgtgctcgtgctgacgtttgtgggcgtgggcaccaccatcagttccatcgtgtctcagcgacgcaacgaaatcggcttgcgcaaggcgttaggcgcatcctcgcgcgccatcggcatcgaattctatgtggaatccgccatctacggactgattggcggcctgatcggcactgccatcggctacctgctggcccgcgtgctgtgcgtatccgtattcgaacgtgccattggcttcaactggctattgggcgtcgcttcgctgctgttgagcgtgctcatcgccgtcatcgcatccatcccgccggttcgccgcgcaacccgtatcgaccccgccatcgttttgagggaggaataatcatgagttccgaacatacgttgaatacgttgcttgaattggatcatatttccaagatttacggcgatttgcgtgccgtcgacgatttgactttgaccgttccgcaaggtgaatggcttgcgattgtcggttcgtcgggttccggcaaaaccacgctgatgaacatgattggctgcatggacacgccttcaaagggttccgtcatgctggaaggccgcaagttggaggatttgaacgccaagcagcttgccgacgtgcgtaagaacatgatcggattggtgttccagaagttctatctggtaccgcatctgacggctgtggaaaacgtgatggtggcacagtactaccattccgtagtcaacgagcagcaggcgttggaagcattggagcgcgtcggtctgaaggagcgtgcccaccatctgcccggacagctttccggcggcgaacagcagcgtgtgtgcatcgcacgtgcgctcatcaactgtccgaaactgattcttgcggacgaaccgaccggcaatttggatgagaagaacgagaaaatcgtgcttgacctgttccgtcagctgcacgagcagggcactaccatcatcgtcgtgacccatgatgcgctcgtcgcatcctgcgcccagcgcgagatcatgctcaaccatggcgtgctcgtcggtgagaagtggaatgatgaggccgcacggaaggtctatgagcaggcgggtggcaagccggcatacaccggttccactacggaaggcgcacagaacggcgagacggccatcagcttcgccgatccgaccaaagccgcgaaaaccggcggtgaggaataagctgaaatcagccgaacaatccaagccatagcactgacgaatcgtacggagcgaacatgagcaacgaatcatcgaatgcgatcaaagtgatcgcactgtctgcggcaagccttgcgctgctgtcggcatgcggcgaacccacggcgacaccgatggacgatgaatatgccggaaattccggcgaaagcgtgcaatcgcaggaagaaaattcgaagaacagcggtagcgccaccgactccggcgattctgcggatacggacgtcaaaaaccatgccgacgatccgaacagcactacatccgacaagcaagacaccggcaactacgccgacggtacctactcgatcaacggccagtacgggccggtgggcgaagacaccatcgacgtgcatgtgacggtcaaagaccagaccgtcaccaatgtggaggttatcgggcatccgttcacgtccatctccaaaaagcaccagaatgcgttcgccgaagccatcaacggcgtggtggacggcaagccgctcaaagacctcaaggtagacaaggtggccggtgccagctggacgtcggaagcgttcaacaaggcgttggacgtggcccgtcaggaagcgtcgatccagtaggtccagtagcggcgaaaagtctgcaaacgtacaatgagcgccccggctacagcctcactcaaagagtgattaaaggccgtagcggggacgctcatgagtttcagatactactacgtgcaactctgctctgcaatgcctttcaggcggccataacgggccacagaacagccgtcatgttctcaggccaaggaatactcgcgtcgccatgcaacgccttacaggcgagcatggagccgagtatcgtgctgaacaggaattgcggatccaatccattacggaacactccggccttcatgccgcgctcaacaaactcagaaaaacgcttttccgcgggaacgagcacttgatcggcaatcgcattcaacgaaggattatcggaagaaagcaccacaccgacggctttcaaaccaagctcactgtcgaaaaaacagccctgaatgcgttgcagtatcgtcagcagaccgtttttcgacaactcgacatcgctgaaatccggcaatcccgcaacttccagctgcacgcggcgcaacagatcgtccgcattcttatagcgacggtaaatcgtggttttcgcaacaccggaacgacgggcgacctcttcaatggtcaccgcaccgacaccatcggaaatcacaatcgcaagcgtggccttcatgatcttatgatcggtctgctcgcgaagctgctcgcggcggctctgcgccttgcgaacggcctcatgcacgtcactgaccgcgtcggaaaccacatcggaaacggcttcggaaaccgcctcatgcactccggtaatcatgcgaccaccttggtgctttccaccttcgccacataccacttattgaatttgaccagcggaatacgcagcagcaagccaatcagcagcagcggaatcaggaacagcaacagcgaaccgatcgcatgccaataatcattgttgtaaataccggcaatggccgcacgcaatgccgtaatcgcatgcgtggccggcaggaacgggctgatatcgccgatgatcttcggcagcacggcaagcggatacgcgccgttcgcgccggaaatctgcaacaccagcgtcagcacgccaatggccttgcccacgttgccgaagctcgccaccatcgtgtaggtgaagaacgagaacacgagggaggccacccagccggtcaacatgaacagccacgggtgcactgcctgaatgtgcaggaacagcaggccgccgcccagcgagaacgtgctctgcaacagtgcgatcacggcgaacacgccataatggccgaggaacagctgatgcggcttcggattgtcgagctcctcacgattcttgcgcgacaccgtggtcttgagtgttacggccataagcagcgatcccacgaacaacggcagaatcgtgtagaacggagccaattgcgagccgaaattctccacagggaacacggccgtgcgcttcacttggacgggggccgcaagagccgccgccagcgaatcggtgttgttgccgagcacgtccttgacggtgtccatattgccgctgttcagcgcgtcggaaagcgtgccattgaacgaagacagcgcggtgcccgccttagtgaggctttcggcggtggaatccaacaccgtgcgaatattggtcagctgcttgcctgccgacttcgtggtgctgttgagatctcccaacgcgcccttcagatcggtggccgtgctgctcagtgcggtggccgtgctgctgatcgaatcggaaatgtcgttgagctgcggcttgagctggctgtcgaaatcggttttgatgccgtcgatggaggccttcgcctgctgggcaagttggctcacgcgctcgcggtcggctgtggtgtcgctcactttcgcgtcgatattgtcggcgctggtgttgagtgagttcgctagatcgttgagttgcgtaatggtcgcgcccacgttggttttgagatgattgatggcgcttttcgcgacttccggcaccagattgttgttgctgagctcgtcgagggcatcgtagatgttctgatagccttgcgcctgcttagatacgttcgcagcctgattgcgcagggcggtggccgtattgccggcttgggtgcccgcattgttgaatacgctgtcaatatcggtggagacagcgccgaagctgttcgacgagctgctcaacgcggtgctgagcgcattcgtgctggttttgacggctccggtcagatcgttgatgccgttcttcgactgtttgagctcgttgacggcgttcttcgcgctgccgctcacgttggaaagcaggctgttggagctgtcgagcaggttctgcgcgctcaacgtcagcgagctgaacgtggtcaacgcggatgacgtgtcgttcagcgtgttcgcgaagttgttcatattgttgctgaagttggtgagcgtggcctgcgatttcggtttgtcaagctcatcggccagctgcgaggcgatgttgagcgcggtgctcgtcaacgttgcggagaacatttcgttgatctgtgctgccacggtgtcggctccctggccggtgatcttcggagcgagtgcgttcttcttctcgttgttgtagtaggtgagtgtggcatggtcgccgtccgcggtgaagaatgtcatcatgcgggtgctgaaatccttcggaatcaccactgctgcatagtatttgccggatttggtgccgtcgatggcctcttttttggtggtgaaggtccagtccatctggtcgttggcgcgcaaggtgttgaccacctgatcgccgatactgatcttcacgggaatgagatcggacttgtagccttcatcgtcgttggcgacggcgaatttcagattgccggtgttggcgaatggatcccagcttgcgctcacgttgaaccaggagaacaggccaggaattaccaccagtccgatgacgatgatgatggagacgatgttgctggtcaggcgtcgaacgtcgccgacgaacagtttccagatgtttttcatgcgttgctcctttcgctgttaccgttgggattggtgttgctcgctgtgccggtgttgccggtcgcgttcatggcctgtaccagtgttgcgatgccgtcggcatcggcttggctggtgtctgcgacgttggcgatcgcctgtttggtttcgtgttttcttcgttgtgccttgcgcatcagcttgtctcgcctgatttgttgcgcacgcttcttgcggcgcagccttgcagcttggcgttccaccagttgttcgcgaatcgcttcgtcgctgaggctgccgagttccacctggcgttgcaggctgaaacgcatatattcgatgaccatcaggaatccgatgatgagcagcacccagatgatccaggtggcaagcaccacgatcttctcgccgttggtgaaggagaagatcagcaccagaatcaccggcacaatgaaaccggcaaccagcgcgccacgcttgagcttcggatacagttcggcgaagcggctcgcacgttcctcgatcgcctcacggtagccgcccttatcggcgagcacttgaatggcctgggacacgttgtagccgcgttccggaagctgtacctcctcgccgatgatcatgtcgctttccttgatctgacgggcgaacaggcggttgagattgaccagcagcgggcgaatcgcaagtccgatgaagaacgcgaccacggcgaacatcagtagcgcgccaatcgacttgagccaatgcccgtcgtagaagccggcaatcgtctcacggaacgcgtcaatcgaataactgaatggtacgaacgggtagaccatgcggaagaatttcggcatcatctcaatcggatacaggccggaagcgcccggaatctgcacgatgatcagcgcgacgcacagtcccttgccaatatgcatgaacgaggtcgacagcgcgaaggtgatgctcagatataccagcgacgtgatgacgccggtaagtatgtacagcggcgcgttcaccgtctgcacgccgatgatgaggttgccgatggtggtgatcgcgccttggatggcgcccatgatgccgagcagcatgtagcgggcgaaatatttttcggaagtggtcaagtcgaggtcttcgaggccttcatcgtcgacctccaccttgaagatcactacgaaggcgaacgcgcccacccacagggccaggttggtcatgagcggagccatgccggaaccgtaggagttcatcggatacacgtttttcgtgtcgatcaccgtgggggactgcatgaacgaggcgattttctccgtgttgagggagctgtcgccggtcaggcttttcagcatgtcaacgctgccgagcgctttcaggtcggtgctgacggtgatgagcttgttctccacctgctcgagctgcttgtcggtgttctgcagcgtggtgcgggtgtcgttcgccacctggtcgagttggtcgagcacggcggaggtctggttgaccacggtggtctggctggttacggtgccggacagtgtgccggcggtcatggcgagcgagctcagaccggagttgagctgggggagcgcaccggaattcaacgtgttgcgggcatctcccatgcttttcagcgaattttgcgtgctggtgttgaagtcggtggcgagtttggacacgctgtcggacgtggattgtgtgttctcgctcaacgttttgaggtcgttgagcgtgccagcggccgtgttgttggtgtcttcgagcttcttgatgatgtcttggtactgtgcgttgtcgctgacgttcttgagcttctcgatgagccgggcgttgccgtcggtcacgctttgcatgttgctaacggcctgctgtgcggtgccgcttgcggacgagacggccgtggtcaccttgttgatgctggtggtggtgtcgctggcggcctgcgaaatcaggccggaaccgttctccaaagcggtgttggcgttggacgtgaaggtattgaggccgttttgtgcggtgccgatggcggtggcggtgttcgccaggcccttgcccgcgcttgctgcggccagctgcacgtcgttcattgcctgacgggcggattgcgtttgttgcggcacgttggcgagctgtgcgtcaagatcttcgatggtggagcggatgaggcttacgttcttctgggttttgtcgagttctgctgtggtttcgttgacgaaggagttggttttgccgttgatggtgtcattcgcggagttcacggctttagtgagtacttcgctgacggtggagacgaaggtgttgttgacggtacgatcaacggtggtcgcgccttgatcggtgattttcggggagatcgggctcgatttttcgttgacatagtattccagcgtcggccggttcttgctgtcggtcacgacgttggcgagatcctcgctgaaatcggaggggatgatgatcgccgcatagcagtcgccggactgtaccgcttccatcgcttcggccttgcccatgaatttccagccaagctggtcgttgtctttcagcgtgtcttcgatctggtcgccgaggttcattttgccgagcagggcgttgtcggtgcctttgtcgacgttggccacggcaactttgatgccttgggtattgccatacggattccagaatccgtagatgttgaaccatgcgtacagcggcggaatgatggttataccgatcatgatgacccaggcggcaggtacggtgacgagtcgtttgaggtcacgacgcagaatctgcagtacgttgcgcattgtctccccagtccaatggatgttcgaccgtgttcgcgcgtagcgatacgttattcgtagcgctacgcctcccgtatcgtaatacccgctctcggacaaatttgggcacaggcgtaaatgcgctccgtccatgactgaaataaacacgacaaaccgcggcaggactgtgaatcttgctgttggagaccgcgcaacttgccttctgtgtctgcgcaagtcgagtctgctgtctgcgcatcttgtgattgcgggatgacatgtgacttgcgcaggcagaaatcgcaggttgtgcgcgttgcgcgcaaacaatcatctcgtgtagcgcactgcgattgggttttggtagcgttgttctgggaaggacgaacaagcatgagcaagattgaagatgtgagcgaggccatcgccgacgaaaccgaaatcgcagcaatcgaagaggccggcatcattgcgcaatcgcaatcggcggaagatgacggcaatcctgctgaccgcaggctgccgctgattgcacgtatttacggcatcgtcatgttgatcgaaggcgtggtgacgttgccgatcatcgtgatttcctgcctgtatgcaatccacgccgcgctttccggcaaactggcgtttggcgcgctgaatctcaccactattctgtcggttattcatgctgcagtgctgctggtctccaccgcatgccttgcgattttcggcatgctgctgattctcaacaagcgtcggcatatcgcgcaatggacgtatctgatgattccgctcacgcttgcggaaggcctattgtcgttgtcgttgcagggtttgggtgtgaatctgatcagtccgaccgtgcagctgcttgtattggttgcgttgcatatcacggctgatccgtcgctgcgcgaggagcgacgtttgcagttcgcgcttcgtcgtttggatgcgcgcagcgagtatgagacggctgtttcgaagggtatggccggccgtgatctgaccggcaagggctatatttcgcttgatttcttcaacctgttttggctgtttgtggtcggatgcgtgttcggtctggtagtggagacgctataccactatgtgctgttcggcgaatggcaggatcgcgccggatttttgtgggggccgttctcgccgatctacggctttggcgcggtgatcctgacggtattgctcaaccacttgtggcggtcgaattggatgctgatcttctgcgccagcgcggtgattggcggcgcgttcgaatatttcaccagctggttcatggaggttgcgttcggtattcgcgcgtgggattacacgggtcaatggctgtcgattgatgggcgcacatccggcaaatacatgtttttctggggaatactcggcttggtgtgggtgaagctgattctgccgcatttgcttgcgatgattcagcgtattccgtggaagattcgctatacgttgacggcggtgtgtttcgcgctgattttcgttgacggcgtgatgacgttgatggcgctggattcctggtattcgcgtatggcgggtattgcgcaggattcgcccgtttcgcaattcttcgccacgtatttcgacgacgacttcatggccaatcggttccagaccatgacgctcgacccgtccacggccagccgcatgtagtgtctgactgttttatggatgactgctttatgggctagatggcgaagctttgtgaaagaacgtgtatggtgcgtccgctattggttgcgccgtgcgcggctgcatgtgacctgtgcccgcactgcctttgtggactcggtgccctgcgacttctacgcgcttaggcggcgaagctttgcgcgagctggcggatgagatccggcctatgtccactccatgaggagttcggtgagatgacgaccggaatctgcttgaagccagcgtttttgatctgttcgaaggtggatgggttcttcgtcagatcaacggtgtcgtaacgcacgcccagctttgcgagctcttgttcggtggcttcgcattgcgggttgctcggattggtgaagacggtcacggtcattcgatttcctccctatgcaaaaatggcttccgtcgtttgcgaaagccgtgtcggccacgttcttcggttatgctcgcatacgcaagccactatctagcatacacactacaggtagtggtgtgtcgtgagtttcctcactgtatatagtggggaattccccagaattccccaaaatacgaacgtttgttcgaatatgtacagtgtaccccaaaccacggaattcacgtccgcgcgcatgtcgtgcgtgttttatggagagggttgtatatagggggggtggcttggtgacgtcaatgcctgcctgatggcacggcgaaaactgtttattcatatgtaaaacaccggtaatataccgcaaatgacctcagttgtcaccccccctaaaatgataagtatgcgtagcgcgaatttgcgtgggcgtgttgaacaaccttgatgattccgatttgcctactgtcttaaggactgttgggctgacaggaaattctgagggggctgtgagcatattcgcgggaattggctctacggtatgctgaggttcggcggttttccgctgaatacaggaaacccctggaaatcgtacgattcccaggggtggatggttggtcgctggctagggcagcgcatcagggtgaagaagtgttttcgaaggctcttcctcacctatcaactgcgtttgaggtatagccctcgccggcagccagccaagtcttatcttatacacccttagctatgtcggcgaccttattgcagggtgtgttcaatgaagccataacgtgccattaaatacggcaatttggctccgcgcaagtactccaggggaagtcgttgcacggagccaaattaatcgctttcaggcgaatgccaccttgactgagttagactcaggcgcgcttgcggagcacggtgatgccggcgaagccgagcagggcgatcacggcgaacaccgcaacgccaccaacggtagcgccggtgttgccgagaacggccttcttgatcttctgggcaacggtcttcttggtgttgcccttggtgtcattcttcttggtggtgtcggccggcttgctgtcatccttcttggagtcgtcggtcggagcgtccttgtacatggcgtacacggcccagttgccggtcacgaccatgtctggatcgaccggaacgtcgccgtcgttggaggcgaagccccatccggtgaagatcttgccctcgacggccggtgcctggatgcccagcgcgtactgggagaacttgaccttgtccttggcgtagtagccgacggtctggatgagctggtcggtgcctgcgtagaaggagaccacgttctgggtggtgtcatcctcggtcggagcgtccttgtacatggcgtacactgcccagttgccggtcacttctgcgtccgggtcgactgcgacgtcgccgtcgttggaggcgaagccccatccggtgaagatcttgccctcgacggccggtgcctggatgcctgcggcgtaggtggagaacttgacgtggtccttggcgtagtagccgacggtctggatgagcttgtcggtgcctgcgtagaaggagaccacgttctgggtggtgtcatccttcttttcagcgttcttgtacatcgggtagacggcccagttgccggtcacgaccgtgttcgggtcgactgcgacgtcgccgtcgttggaggcgaagccccagccggtgaaggtcttgccctcgacggccggtgcctggatgcctgcggcgtaggtggagaacttgacgtggtccttggcgtagtagctgacggtctggatcagctcgttcttggtgttgtagaaggagaccgtgttcagagtcttatcttccgaagtcggagtgtccttgtacatcgggtagacggcccagttgccggtcacttctgagtccgggttgactgcgacgttgccgtcgttggaggcgaagccccagccggtgaaggtcttgccttcgacggccggtgcctggatgccgagtgcgtactgggagaactttgccttgtccttggcgtagtagctgacggtctggatgagctggtcggcgcctgcgtagaaggagacggtgtactgggtgttgtcatcctgtgtcggggtatccgcgtacgtcgcgtatacggcgatgtccgcgaacacctgatcggtgtccttgagcatggtgccctcggagtaagcccagccggtgaaggtcttgccctcgatggtcggtgcctggatgccgagtgcgtactgggagaaggcggtgcctttctgccaggtgactccctggatgctgtgtccgtcagcggtgtagaacgtcaccgtggcgtattcttctttagcctgcgaggaagttgcagaattctgattctgggcagtatcagccattgctactgccggtgccaaggcggccagagtcgctacagctgcaacgcccgcaataatctttttgccaaaagacatttggggaaaccctttcttagttacgtaactagttgccccaaagcgatgccttcgaaataccgccctgaatgcgtggagttccccctcataagaattccgagggaccatgatagctgccccctagcgactttttaagagtctagggcgtgttcgttggaattgcaatcttttctcgatttcccactttcctattgccgctgtattggcggaagccttgtggaatcggcaaggcgccatcccggcaaggcgtcttgcctgtaagggtgaggaatccgatgatggcgacggcagggtgtttaccggcgcggatgatgatgtgacaatccgtgtttgggacgcgaacaatgtgagtgcgactaatcgcgtctggagccaaaaaatcgcgggaatcgaaaaacccttggaagctaatgtttccaagggtttcgcggtgccccccgtgggattcgaacccacaacccacgacttaaaaggacgctgctctaaccgttgagctagaggggcaacagagagacagtatacagcatatttacgcaaaacgccacacaaatcagttgtaagtaacgaaaaacgtggattatcaccaagtcattgccgaatcatcatcgaattcccgcgaatcgcaatatcatttctgcatatctgctcgtacagtggaacgcatgtcatgtaccacgattcttgtaggcaagaaagccagctacgacggctccaccatcatcgcacgcgacgatgattccggttccggacgttacgatcccaagaaattcattgcggtagcaccgcaagaccagccgagacattaccgcagtgtgctcagtcatgtcgaaattgaccttccagacaatccatgccgatacagcattgtgccgaacgtgctgccgaaccgcggaattcttgcggaagcgggcgtcaacgagcgcaatgtggcgatgagcgccaccgaaaccatcgcggtcaacgagcgcgtgctagccgctgatccgctcgttgaactgcaaccggcgaacgaagccgctgatacccctgaaattccgggcggaatcggagaggaagacatcatcacccttgtgctgccttacgtaaccacggcgcgcgaaggcgtcgcacgtctcgccgaactgcttgaaacatacggcacctacgaatcgaacggcatcatcatttccgacgtaaacgaaatctggtacgtcgaaacaatcggcgggcaccattggatcgcccgccgcgtgccggacgactgctatgcgaccatccccaaccagctcggcatcgacgatttcgacttcgacgacgccttcaacgcccaacgcgaattcatgtgcagtgccgatctgcgcgaattcatggacgcgcaccaccttgaccgcactatgagcgcggcagcaagtggcggcttcggattccagtcgacgagcgctttcggaaacggcggcatgaacggtggcggcaatagcagtagcggcgcggcgctgggccacaaccatttcaatccgcgcacagccttcggtaccgccaccaccaaagaccatatctacaacacgccgcgcgcctggtacatgcagcgctacctcaatccaagcgaggattgggattcgccggccgcccgttacacgcccgcgtccgacgatattccgtggtgtcgtgtgcctgagaacgctgtgacgctcgaagacgtcgacttcctgatgagtgcacacttcgaggggaccccttacgatccgtacggtacgctcgggacgccggaaagccgccatcgctaccgtccgatcggcatcaaccgcaccgggcatatggtggccatgcagattcgtccgtacgcgccggaggcaagccgttcgatcatgtggatctcatacggttccggccccttcaccgcggccacgccgttctacgcgaacgtcgacgatacgcccgcctacctgcgtgacaccacgccggaagtctcgaccggcaacctgtactgggcgaaccgtttgatcgccgcgctcgccgacgcgcatttctacgaaaccagcaatgcgatcgaaggatttgcggaatcggcccgcgcttacggccatcgtctggtggaacgtactgatgccgaattgcgtgagatgtccgcgcaaacgagcgtgtccgaatcgcaggagcgtgcaggggccgcggagattacggaaaacgcaagtattgcaaccatcgccagactgcagcagtccaacgaagaaatggcggaatatttgcgcactcacgttacgaaactgctcaacgacgtgctctacacgtccagcaatctcatgcataacagtttcgccatgtccgaccgctggaactaagcataaagccccgaaattcggcaaaacccgtcccaatgggccaagtttccgcgctcggggaggttccgcatgaacgtaggctgttggaagtgtcagtgctgctcccgacagcctcacgactgcatccgcattctcgtacgtcagtttttgcccatatctcgcttatatatggcagatttcgagagctgacacgaggcatttcgcttatatatatatggcactcgtgcttgtaggcaaggcgatttcgggggtaaaatataccctctaagtcaccttgctatcaagggcatctgccatatataaggcagatagtgctatctagaccgtcgattgaccatcaaatcgtcggaaatcgcgatcagttgaacccgacgacgtgttccgccacgaaataccccttgcgaatcacgaaacgaccgatcgacccgcgcaaattcaacgcacgagacatggccttcttgcgcacatccttgtaaatagtgggggagtacgccttaatgtcgtcccacatatcctttttcttctcataattttccggatcgcgagacaaaatcatgaacacacttgccacggaactttcaatcgccaggaagtggatcatataacggtacaggccgtccggcaccgtgccgcgttccggagttgcacgcaccatgcactggttgacgaggcgcagctggtcgacgcggcggatcatcacgtcggtctgcacgctctggccgtcgcgaccgatgaaatagtggtagaacggcgtatccaaatacttcatggtcttcacccacgggaatggctgatacgcgtaaatgaagtccacgtagaacgtgtgctccggcagctgcatgccggactctcgcaccacggcggtgcggtacgtcagcgcgtgcatgagaatgtattcagccaagccgaaatgcccaagatcgttccaggtcaggcgctcgccggccttcatggcatggcggaagttcaccacatgcttgttgcgtttgccaaccttgtcatacacataattagtgacgagcatgtcgatcggctcggtggaatcggcctcttcgcgcagcacggccatgacctgttcgagcgattcggggccaacccaatcgtcggcgtcaacaaccttcacgtacatgccgcttgccgccgcgatgccggtgttgacggctccgccatgccccttgttctcttggtggatggcgcgcacgatgcctggatagcgggcttcgaatttctgtgccatttccagcgtgccgtcggacgagccgtcatccacgatcagcacttcgatgtcgtcgttgcgcttcgctgcgattaacgacatgacgcatcgttccaaatattcggtcatgttgtacgcgggcaccacgaaggtgagcgtcttcttctcctgcatagtcttccttggtcggccgaggtgacctgccgcgcgcggcgcgtggtcactgcgtaacgaaactaacgtagcaccttgttcgcttcaggggaacggtttgtacgcaataggcaccctgaatagcgcaatctgcacctgaaatttcccttaagggtaccgttgttgacaatttgtaagttttcgtcgatgcttgttggcttgtgcgatgcttgcgattcccctgttgctggtactgttcgattcctgcgtctgacgcctgttggcgttggctgcgatgcttacgatgactgggggcggctgggttttacgactgctgttcggcttgcgtgccttggcttccggctgcgccttgttcggtattctgttcagcgttctgctcggctgggctttccgtattgttttgtgattgtgcctcttttgcggccttgcgctcgcgtttcgcgatttccttgatttcgcgcctttcctgcttttccgcctcttttgtggctttgtcgctttcgaaacgcagttccggcttggcttccatgcggctcaagccatgccaggccagattcacgatgtgcgcggcaatctgctctttactgagtttgcgctggtccgcccaatactggcaggtatatacggtcatgccgatgagcatctgcgcgtagtatggcacgcccttggccggcaggtgctggcgtttgaacgcttcggcgagaatgtcttccacgcgcagggcgatgtctcccaaaagcgaattgaacgagctggccggatcggttttcggcgaatcgcgggtgagcactcggaatccttcagcattctcctcaacataggtgagcagtgccagcgccgtgcgttccacgatttgacgggggtgcgcttgtgggtcggagagcgcgttgacgagcgtgtcggtaagcgcgcgcatctcacggtccaccaccacagcgtacaggccctctttgcctccgaaatgctcgtacacaatgggtttcgacactttcgcggtggcggcgatctcctccacgctcactgcttcgaaccccttcgacgcgaacagcgaacgaccgatttcgatgagctgctcgcgccgctgatacgacgtcattctggatgtattggccatgccgtccagtttttcatgccccgtggatagtctgtccgattctggtgaatcggacacttgggctcggtatttggacggttcgttgtccgattctgcagaatcggacattcgtggtgcgtccgcggggcggagccggtgtgtccgttgcgctttttaggctggagtcatggatacgaatgtgattattgcgattgtcgccgttgtcgttatcgcggcaattctggtgattggcggttggtggctcggtaagacccgcaagaacgccgtcgataagtccacggaggatgcgaaagccaaggctgacgcccgtcttgccgcggaagcaaagtcggctgcggctgattcttccacggtgaagccgtccgttgattccaatgttgatgcagctgaaaaagctccggctgaaagtcagcagaagtcctcagctcaagcttcctcttccgaaacggcagctcctgcaccagccaccgaagccaagcccgaaccggttcatgaaacccccgaatccgccggcacgcgcatgcagcgtcttaaggcgcgcctgtcgaaatccggcaatccgttcggcaaggctctgttcaacattcttgcgaaggatcagctttccgaagccgactgggaagacgtcgaagacaccctcctgcttgccgacgtgggcgcggaagccagcgaacagctcgtcgaggaactgcgcaacgacgcccgaatcgcaggccagtccgatccggccgaagtgcgtgccgcgctgaaggacaagctgttgaagctcgtaggcactgacacggatcgccgcctcaatgccaataaggagggtgccaacaaaccaagcgtcatcatcatggtcggcgtgaacggcacgggcaaaaccaccactgcgggcaagctttcccgcctgcttgtttccgaaggcaagcaggtcatgttgggcgctgccgataccttccgcgcggcggccgccgaccagttggaaacttggggtgccaaggtcggtgtcccggtcgtgcgttccgacaaggacggcgccgatccggcgtccgtcgcattcgaggccagtgccaaggccaaggaagagaacgccgacgtgctcatcatcgacactgcgggccgcctgcagaacaaggcgaacctcatggacgagctcggcaagatccgccgcgttaccgaaaagaaccttccggtcgacgaggtgctgctcgtgctcgacgccaccaccggccagaatggcatgacccaggccaaggtgttcgccgaagccatcggcattaccggtgtggtgctctccaagctcgacggctccgcaaagggtggcattgtgatttccgtgcagaaggagcttggcgtgcccgtcaagctcgtcggccttggcgaaggtccggacgatctcgccccgttcgatccggaaggcttcgtcgacggcatcctcgcctgagctgattgcgctcccgagaaagcctccccgcgtgggaggctttctttttacccccgaccagtcctatttcgcctatatatggcagatttgccggttcgtccgctggtttctcgcttatatatggcagatgcttttggagaaagtcgacttagaaggtatatgtttacccccgaaagcacctttttgcgagtgagagtgccatatatgggcgaaatgtctcgtgtcagtcctccaaatctgtcatacataaggcagatacgctgaaaaatgggctgatagtggtttggcctgagagcggtgcgcaatctgaaacaaaacgtgccagccgctttattccgccgttttcggttgacgtaatggcgagatggcgttaccttgctgtaacacgtcgtaacgttttcaaaacgcgggcggcgttccataccgttttgtcagccccatacgatggggccggaaatgtgaactcaaaatgaaagaaagaggagggtgacatgggtcagcttgattctggaaatgccgcgtggattttgacgtccgcgtcccttgtgttcctcatgacgccgggtgtggcgttcttctacggtggcatggtccgcgcaaaggccgtgctgaacatgatgattatggaggcggccgctctgtccgtcacaatggtgatctgggtgctgtggggctggtccatcgcctacgcaggcacttcggtcggcggtgtcttcggtgatccggccacaggcttcctgctgaaggattccatggtttccgacggcggtgtcttcacgtcggcttcgctgaactccaacaactacccggtcagcgtcgacgtggcgttccagtccgcattcgccatgattaccgtcgctctgatttgcggcgctatcgctgaacgtgtcaagtactccacgtggatgattttcgtcgcgctgtggattaccttcgattacgctccgctcgcccacatggtgtggaatggcggtctgctgagcgctgacggcgcgatctcccaggctatcggcgctgccgcccacgatttcgcaggtggtacggtcgtgcacatcaatgctgcagtcgccgctctggtgatcgtgttgatcatcggcaagcgcaagggcttcggcacccagccgttccgtccgcacaatgttccgttcgtgatgcttggcgctttcctgctgtggttcggatggttcggcttcaacgctggttccgcgtttgccgccaatggcaccgcaggctacgcttgggtttccacttccgctgcaaccgccgccgcaatgctctcttggggcttcactgagaagatccgcaccggccactacaccgccatgggtgccgcttccggcatcgtcgcaggtctggttgccatcactccggccgccgatgtggtttccccgctgtgggccatcgtgctcggtgccatcgccggcgtgctcacctgcctcgcttgcggcctgaagttcaagctcggctacgatgattctctcgacgttgtcggcgtccacggcgtcggcggcttcaccggcactgtgcttatcggcttcttcggcgaaggtaccggtctgttcgcgggcggcgactggaagcagctggttgtgcagctcatcgttgccctcgttgccatcatctggtccgctgttgtcaccggcatcatcgccttcgctctggagaagacgattggttggcgtgtcaccgaagctcaggaagtcggcggtatcgatcttgccgatcagggcgaacgtgcttacgattttgctggtaccgccagctctgttctcaaggaggtgaagtgagatgaagctcattaccgctatcattcagccgcataagcttgacgatgtcaaggaagccctcgctgccgcaggtgttcacggtctgaccgtgtctgaggctaacggttacggccgccagcgtggccacaccgaggtttaccgtggcgccgaatacaccgtggatctcattccgaagattcgcgtcgaggtgctgtccgatgacgccgatgccgagactctggtcggtgtgatcgtcaagtccgccggctccggcaccatcggcgacggcaaggtctgggttgccccgcttgattcggtgacccgcgtgcgcaccggcgagaccggctctgccgctatctgataattcattcggatagatattaagggccccgggcttaggttcgggttatcaatagacagatccccgtacgtgcttcgcgccgtgcggggattttcatacgattttcgcgtcagattgtctgcttcggatttccccgctttcgcttttatctgctcagatttgcttgcttttgcgaagattcataaggatttgttatgacttcagcggttgatggtcttaaacaacgtttcatggatatgagtcagccggatgccgacggcgtgtaccgcaatggtgcggcgaaacgtaaggctcgtacggatctggccatggattgcctcaaacaattgtggcaggaggcttgccagacggtgtcttttgacgttccacaagctggtattggtcttggcgcggtcggttcgttggcccgcggtcaggtgggcccgagctccgatcttgacttggtggtcatttatgagcctcacgcgctcaccgaccagcagctcaacgagcttgccaacaaattgtggtatccgatttgggattctggtcttgatcttgaccagtcggtgcgtacccgcgcgcagtgcgaggcggtgaccgaccatgatttgcctgctgcgatgggctggctggatgtggtgccgatcgcgggcgatacgcagctgattgaatccacggctgtctccattttggagcgttggcgtagggccgcccgtaagcgcttgcccgaattgttgggttccgccaagtctcgtttggatgagttcggccgtatggcgtatagcaatcagcctgatattaaggagtctcgcggtggtttgcgcgattccgtgctggtctccgcgcttgccgcttcttggcttgccgaccgcccgcacggccagtatgacgatgccgtcgaacggttgttggatgtgcgcgattgcattcatttggtggccaataaagacacgaatatgttgctcgctccttatcaggcgaaggtttcggcgatgctgggtttggctgatccgacgttgccgagcggcgagcgtgaggcgaagtcgattgatgatttgcagacgttgcttgcgcgtgttggtcgccagatcgcgttttcgcttgattccacggcttcccgcgctgagcattcgttgactcatgagaagcctcgttttgcgtttttccaggtgttccagcctcgtggcggcggtaagcgtcaggcgcctacttttgatgtgattgcgcccggtatcgccaagcatgaggaggagatcgtgcttgcgccgggtgccgatccgaagtccgatccgtgccttgcgttgcgggctgctgttgctgcggctgagtttggtctgccgatcgcgcccggcacgttgcagaatctgaagtcgtgtccgatcgatgatcgcacgtggaatgatgagtcgcgtagtctgttcttgcgtttgcttgcgagcggtcccgcgttgttgcaggtgtgggaggagattgattttgtcgatattccgggtcggctgattccggaatggttggcgattcgtaatcgcccgagtgcttcggctgcgcatcggtatacgattgaccgtcattcggttgaggtggtcacgcggcttggtcgtgaaacacctcgtggaaatcgatatgatgatcggcattatcaggcgttgctgttggctggtattttgcatgatgtcggtaagcgtccgggggttttcgatcatgcggcggagggtgcgcgtcatgcgtccatggtgttgaagcgcatgggttttgatcgtgacattatttggtgggtcacgttgttggtgcgtgagcatcttacgttgtcggagtttgcgactggtcagaatccgaatgatcctaatgttggtgacgagttggcgtctcgtcttgatcatgatccgctgctgcttgacatgctgttcgatctgactcgtgctgacggttcgtcgttgggtgccacggccggcgagaccatttccaaacagtacggctggagtaaatggcgcgaaacccttgtccgaaccatgtacaacgccacccgctaccacatgtgaggccgcgtaggctgtgagcgaatgcccggcaaagcgacatggctgccgatgcggtacccgccgcgtcggcggaaacccatcgtttaagaaaaagtggggaacatatcaccttcggttcacttaagcaagtcaaaaccaggggaatgggcacccgtacggaagatgtccccaagttgtccacttggttatccccatttggtggataactcggtatgttttccacatagttatccccagtatgtggataactcgggttttttcggctttcttatccacagcgaaccgattcgcgcgtgtcgggtgattccgatcctgccaatgcggagattcctccagaatctcatcgcaacatcattcgtgaagtggcacaggtattatggtttttcccggtacaccacacatcgaagagctggagaagcatggcggagagcaattcttggaacaatggcctggatcaagggcaaaaccgcggtttttcaggcaatggcagcatttccggcgcgtcgggaacggctattcgcgacgccatcttcgaccgtgtgccgccacatgacgacgccgccgaaatggcggtgctcggcggcatgctcatgagcaaagacgccatcggcgaagtctcgcagatgattgacatcaccgacttctaccagccgcgcaaccaaaccgtgtacgaagccatcatcaacctgttctccgcatcgcagcccgtcgacgcggtgctggtggccaaccagctgctcaaagacggcgacctcgaaaaagtggggggatccgactatctgcacagcctcgtcgcatccgtgccgaccgcagccaacgcaaccttctatgccgacatcatccaccagcgtgccatcctgcgcaatgtgatcgcagccggcaccaaaatcgcacagctcggctacaccgccgaaggatcccaagccgaagacgtcgtcaacctggcacaggccgaagtctacgaaatgtcgaccggcaaagtgaggcaggattacgcgccgatcggcaccgtcatcaccgacaccctcgaccaaatcgaccgactgcaaaacggcgaggtttccaaaggcgtgccaaccggattccgtgacatcgacgacgtgacgcaaggcctgcagccgggccagatgatcgtcgttgcaggccgaccggccatgggtaagtccacgcttggcgttgatttcgcgcgagctgcggcgctgcaccacaatatgacgtccgtgatcttcagcttggaaatgagcaaaaccgaacttgcgcaacgaatcatttcggcggaagcgaatattccgctgtcagccatgcgccgagcggaagaaatcacgcaggaacgttggaatatcctcaataatctgcaggataaactgcagaacgcaccattattcatcgacgatagtccgaacatgagtttgatggagatccgtgcgaaatgccgccgattgaagcagacgaacgatctgaaattagtggtgatcgattacctgcagctcatgacttccggcaaggccgtggaaagccgccagcaggaagtgtctgatttctcgcgtgcattgaagctgcttgccaaggaattggaagtgccggtggtggcgctgagccagctgaaccgtggccccgaaatgcgtcaggataaaaagccgcagctttcggatttgcgcgaatccggttctatcgaacaggacgccgacgtggtgttcctcgtgcacaggccggacgcctacgacaaggaagatcgcccgggcgaggccgatatcatcatggcgaagcatcgtaacggtccgacgcagacgttcaatctcgcgttccttggcgcatactccaagttcaaagatatgccgcaggactaccagagccaacaggaggtatagcatggcgtggaactcattcgcaacgccgttgatcggcaaggccgtgcgtgcggcctcccgcctggcacatggcggcggcagcgcgttccccggcaaaatcgtggaacggatcgacccgcaattcctcgcacgcaccctgcagcagctaccgcttggcgtggtgctcgtgtctggcacgaacggcaaaaccaccaccacgcgcatggtggcaagcatgctggaatcgttgggattgaaggtattcaccaatccgaccggatcgaatttcacccgcggcgtggtctcgtcgctgctggccgaagtctcgctcggcggcaaactggacgccgacatcgccgtactggaactcgacgaagcgtacgcggtgcatttcgtcaaacaagtgcaacccgactactgcctgctgctcaacgtgatgcgcgaccagctcgaccgtttcggcgaaatcgacaataccgcacgactgctgagcaaagccgccgaagcgaccaccggaaccgtagtgctcaatcgtgaggatccacgcatcgcacgacttgctgacgtcgcacatactgaagatggtgtggaagtgcgctatttcggtcttgacgggtcgttgcgcagcttcttcccgtccgacgacgacatgcgcacgacagtcgatactgcatcgtccgcaaatattgagattgacgatgctgcagtgattgcgaaaactggggaaaatgcagaaaaatcggaagatgcggcaattgcggaacagctaccagctgacgtgaccttgcttgccgtgggcgaccatcgtgccagtttcggcatcgacggtgaaacgtacgaaaccggtgtgagactggaaggcgtgtacaacctgtacaacgcggcggccgcgctggccgtcgtgcgagcggtcgtggccgatgcgcaggcaatgttcctgccgttcgagcagaacgtaaccgacgaactattgcgacaagtgggaatctcacagcgcatgatcgacttcgcgcattccaccacgcaagccatgatcgacgcggcagccgaagtcactccggcgttcggacgcggcgaggtcatcgacgtgaacggctcgccggtggagctgctgctcgtcaaaaaccccatgggattccgtctgtcgctcgcatccttcacccctgaaggctgcgacaccatgatcgccatcaacgacgaatacgccgacgggcgtgacatgagctggctgtgggacgtggacttctcctcgctgcgagacaccggtgtggccatggtttcgggcgtgcgtgcctgggacatggcgttgcgcctcgaatacgatcaggtgccggtgaatagcgtcaacacggaacttgaagaggccgtctcaacgttcgtgaacgcgaatccgggcacccccaagcacatttactgcacatacacggcaatgctcaaaacgcgagccgcgctcggcaaaatcgccgaagtcgccgacgctggcgtgggcaaataacagcgtgaatccgcgcaacgcatgaaaacgcatgaagaacgtatgaaccgcatgagggagacgatatgagccaggtaatcgacatcgtgtcgctatatccgaaagacatgaacatttacggcgactccggcaacgtgctcaccatccagcgccgtctcgccctatacggctacgagccgcgcgtgcacgcctacaatcagggcgacgcgtggcccgaacacgtcgacatgattctgggcggcggcggccaagacaccggccagaagaaaatcatcgacgacttcttcaaacgcgccgacctgctgcgatcgctggccgccgacggcacccccatgctcatgatttgcggtctgtaccagctgttcggcgaatatttcgaaacggtggatggctcccggctcgacggcatcggcgtgatcggcgcgtacacggtcggtcaggaagtgcgcatgatcggcaatctgaccgagcattccgccgatttcggtgacatcatcggctacgaaaaccattccggccaaaccttcctgcgcgaaggcgtgcagccgctcggcaccgtcgacgcggatagcaccggcaataatggcgaggatcatacggaaggcgcccgcgtcaacaatgtgatcggcacatacatgcacggctcgctgctgccgaaaaaccccgcgatcgccgattttctgatccgcaccgccgcagaacgccggtatggttcgttcgatccggccgctgcagggcagacggaagcgcagcgtgcggaacttgatcgcatcaacacgattgccagcaacgcgcgtcgcgtggccatgtcacgcccgcgctgattgttttcgcgctgtttcgtagttttcgcgttttcgtacgctgtgagcatacggcagcgagtcttccgcagaattgtaacgattgactagtttcgttgacgttatttgtgaagaaaatgcgatagagtgggtaccaccatcacctaaggaggtaatcatggctgattttgattttggtgacggcctgcgtaaggtcttcctcgccggcgttggcgctttggcgaccacggttgagaagagccaggaaatcgttgacgatctcgtcaagaagggcgagctgaccgtcgaacagggcaaggccctcaacgccgaactcaagcacaaggtcgcggaggtcaaggaatcctctgaagccaaggctgcagaggaaaccaaggaagccgaacctgaagccaaagccgagtaacgttcaatcgttcacatcgccgtctgctcgtcgcatcacgttcagacggcgatttgttatgcggaacttgcgaaacatgcgaacggccgtgtgcggaacgtaagaaacgtgcgaaacatgcgaatcgcatgaaatacgcgggacgcaagtctcctcatgaatcccactcatcgtaatccgaccaacgtttgcgagcagcgatatgtctttgaattctccgatcgagccggatgcggcccgccccgaaagcgtggagccggtcacactttccgaccgagtcaacgcggtgatcaatccgacggcgaacccctcgtccgacgcggctgcggcaacggcagccaaatccgcgggaaaaacgggaatcccgcaatcgcaaggcaagcagaacgacgcaacctttacgcaatccgaaaccatcggactgttcggcccgcgtaaagactcattctcgcagcgctaccacctgactcgtcgaggcaaactgaagcgacttgcgcaaatcgcgcaaatcgtcaaccaattcgacattgtgcacggcctgacccccgtcaaaatgcggctcatgttcgaagcgcttggcccaactttcgtgaaagtcgggcagatcctgtccatgcgctccgaaatcctgccccaatcgttctgcgacgaactcgccaaactgcgcgccgacgccgaccccatgccgtacggcaccgtcctgcaagtgctggaagacgaatacggacgcccggcaggcgaaatcttcgaccatatcgacgccacaccgctcggatcggcaagcctcgcgcaagtgcatcgtgcgaaactcactaccggagaagatgtggccgtcaaagtgcaacgcccgggcgtgcgcgaaaccatggcacaggatgtgtccatcatgcgcaccatcgcacgaatagccgccaaaaccatgcccagcgcccaagtggtcgatctctccggcgtggtcgaagaactgtgggacaccttcgaagccgaaaccgacttcatgatcgaagcgcgaaatctggcggaattcaaacgattctgcgaacactacaaatacatggactgcccgaagccatactccgacctgtgcaccgaacacgtggtggtcatggactacgtcgaaggcatttccgtctcgcatcctgatgagctcatcgaagcgggctacgatctgaaggaaatcggcaccaaactggtcgacaattacgccacgcaagtgcttgacgaaggcttcttccacgcggatccgcacccgggcaacatcatggtgcgcggcgggcagatcgtgctgctcgacctaggcatgacgggccggcttaatgccaaaacccgttccgtcttgaaagacatgattttcgcggtcgccaaacaggattcgcccgcgcttgccgacggtctgctgcgtttcgccggtgccgaggccgatccggaggattatccggcgttattggccgacttggatgtgatcgtcaaggaattcggcacagtggatttggccgagctggatatcgccgccatgcttaccgcgttgacgcaaatggcgcaacgacacggcattgaagtgccgagcaccgtcaccaccgtcgggcgtgcgctggtcactttggaaggcctgctcgacgagttcattccagacgtgaatatgattcagatcatctccgaccatatcgccgcaagcacgtcgaagaaggatttcgccaaggatgaggcgaaatcgctggttatcgaaggtcatcaggcgctgcacagcctgctcgctgccgccaatgagctgaaagtggcctcccgtatgcttacgcgcggccagttgcgcgtgaatatggagatggtcggttcgcaggaaccgatccatctgcttgccaacatggtgaacaggcttacgatggcgctgatcgtcgtcggattgttcatcggctcgtcgatcgtgtactatgcgggcatcaaaccggtgattttcggtattccaatcgttggtttcctcggctatgtgatcgcgttcgttttgtccgtctggatcgtgttcgacatttacttcaagggacgttccaacaaaaaacgatgacgctaggctagggggagggtggattctcgttggatgaggcggcaggggagatattccgtgccgtggtggggctggccgttgatggcgtccatcaggtagcgggcggctttgcggccgatgagttccgtttcattgtcgatgctggtcagcggcgggcgggagctcttggtgagcacgtcccaattatcgtggccgatcaccgccacatcctcaggaatgcgtagatgctgcgacttcaacgcgtcaatgcatcctcgtgccagctgatcgctctggcataccacggcgtcgaacttcacgccttggtcgagcagcagtctggtggcggcacgcccccaattctcgtcccaacggccatagcgaatcgggccagccggttccaaaccaacctcggccaacgcttccaacgcgcccttggtgcggtcggtggaggccgtatacgtttcatcgccgccaataatggcgatacggttgcgtccgcacgaaatcagatgattcacggccatgcgcccggcgtccacattgtcacacgtcaccgaacaatcgttggtgtcggtggaaggaccatacacatacaccagcggcacgccccaatcacgccccagcgacgggcgcggattcgtctcgcactgcacaatcagcaggccgtccactttcagcgacagcagtttctctacatggctgcgttccagcgcatcgtcaccgcgagcattggcgagtagtaccgatgtcgattgtgcgcgcagctcgttttcggcgccaataagaataggcgtggagaaacggccttgcagatcggaagtgaccaaaccgatggttccgcttctgccgcttgccaacgattgcgccagcttgttcggggaatagttgagttgccgcgctgcctccatcacgcgctcgcgggtgtcttcgctgacgcgcggtttgccatgcagcgcctttgaagccgttgccaaagacacgttggccagcgctgctacatcttcaagccttgctgttgagtgagtatctgcagttgccatgatgttccccttttttacggtgtgacgaaaacgttggctgcgcgtcgatgcgcttcgccgcccttgtattgcgtaatattatacgacaaaactgcgaaagttttcgcatcgtgtcaaaaagtggacaaaacggctttatatagccgattgctgacattttcacttgcaaattgcgaaactttcgcatttgtgaaaatgaacacatttttctttcgcattttctgcatctcacgtcattttttgctgtcataaacgattcttaaaatgctaagaatcgtttatttataacggttttatcgacatgaatacctttgcattctgatgtgcgaaagcgattttgcaaaatctggaaaaaaccatatactgagaaaaggctttcgcactacggttcaatcgaaggagaacaaccggaaatcgtgaaggcagacggcggaaggcccgccggatggctcaaagctgagcgatacatagagaaagaagtagacatggtgtctttcaacaaggtcactcgcgttattgccggcatcgcggcaaccgcgttgcttattccgatggctgcatgcggcggtggttccagcagtggtggatccgcggctccggccgatattccggcagccggcactgatgacggcactgagatcactctgtggacccgttctccgctggagcgtcaggccaagaacgcggtgaaggcctacaacgcctcccacaagaaccaggtcaagctggaaatcattccgaacgacgatatggaaggcaaggttggtggtgcttcccagaccgattcccttccggacattctcgccggtgacgtggtgcgtattccgtactgggcttctgaaggcatcttcaccgacatcaccaagcagatcgacggactcgacaacaagtccgacctgcagcagggccacattgaagccggtaccgtggatggcaaggaatacacgctgccgttcatcaccgacgtttccgtgatggtatggaacaaggatctgtacaaggaagcaggccttgacccggagaagggcccgagcagcatcgacgagttcgttgagcaggccaaggcggtcgcggccctcaacaaggacggcgtggcaggctcctacttggccggccagtccggtggcgctctcgtgttcgacctgttcccgtccgtgtgggctgacggcgaatccgtgatgaacgcagatggcaccgaagccaccctcgacaacgattccatgaaggccgtgctcgacgcctacaaggaactcgccaacaccaccaacggcttgggcgcaggctccaaggaagaaaccggtgccacttggaccgctccgttcgccaacggcaacatcggtgtgatgccgtatccgaacacctcctccaccgcactgttcgaagctgagaaggacggcggcttcgaagtgggtgtcaccccgatcccgggcaccaaggaaggcaagacctccacgttcctcggcggcgatgccatgggcatctccaaggactgcaagcacgtcgctcaggcttggaacttcctcgcatggctcatgagcgatgatgcccagaaggaagtcttcgcagccaacggcgacaccgcatccaacatccagaccctgaagaccgcctacgacgatgccgatcctcgcgtccagaccatcaactccgtaatcatcgacggcaatggccagaccccgaagtccgcagctttcaatgaggccttcaacgcagccggttccccgtggcagctgctcatccagaacgcagtctggggcgatggcgatctcaaggccgacaaccaggccatcaccgacgtgctgggtcagtgaggtgagccactgaaaacaaacttctcctcctttttctcctttccccgatttacataacttaagaacaactgaatatcgaataactgaatatcgaaaacaaaaatcgacagaccacagttgtggtctgccatggagatcgacaatacttcaaaaacaatgtcggtcttcatggcggatttcaacggccgcacgagacggaatcgcacttccaaacgcatatccaatcgcttggccatttatgtcgaaaaccccgaacgattcaagagagagtcgccaaaagtgttccaaggagggaatatgactactgtttccaagaacgctgcgccagtgaagacgcatcgttccaaggccaaggcggaggcaacccgtcgtggcctgctgtatgcgctgcctgattggctgatgatcatcatgctgttcttcgtgccaatcgtactgctcgtcatcatggccggttcccgctggtcgttgatgggcggtaaccgtggttggaatttccctgagaatttcgtcaaggttttcgaaaataaactgctcggacagtcggtgttgttcacacttgaatacaccgtgatcgtcacgattttcctgctggtgctcggccttggcctggcgctgatcgtgcaggaaagcaccaagtggaacaatatgctgcgcacgtgcttcctgctgccgtccgcaaccggtctcgcctccgcttcgctgctgttctacgcgctgtactccccgcaggtgggccctgtcaccaagatcctgagcttcttcggattgatggatgagggcggctccgtgctcgccaccggccagagcgcgctgtgggccaccattattgtgatcgtctggcgtttctccggctactacatgctgctcatgatgatcggcctgcaggccattccgggcgacctgtatgaggccgcgcgcatggacggtgctggcacgtggcgcattttccgttccatcaccctgccgctgatgaagccgaccatcgtgatgtgcctgatctactgcgtcaccggttccatcctcgcgttcgaccagttcttcattctgaccaagggcggtccgaacaattccaccatgaccgtggtgcagctcatctacaacttcgcattcgattccaagaaggatctgggcatggcggccgcactgtcgctgatcgtgcttgcggccctcgtggtgatcaattccatccagatgcgcggtatgcgcgacaacaccaagtgagcaaggggagggaactcacatgactactccattgtggaagcgcgtaatcgtctatattctcgaaggtctgctggctctggtcttcatttcgccgctgatctgggtggtggtctgctcgttcagtccgcagcctggttccgcacaatccaagggctggggtgtgaacaactatctgacgttgttcggctaccaggaaggcctgccgaagtacctgttcaactcggtggtggtgacgttggtcgccgtggtgttctccgtggtggtgtgcacgctcgcaggctattcgttctcccgtttcgactatccgggccgcaatctcggattcatggtgacgctgtccattttgatggtgccgtatgcgtctctgctgattccgctgatggtgtggtacaaggatattggtctgaacgattccttgctgggtgtcgctttggttattaccttgttccagctgccgatgagcacgttcatcatgcgtaatgctttcgatgcgattccgaaggatatggaagaggccgccatggtcgatggctgcaactccctgcagtcgttgattaagattctggtgccggtcgtcaagccgtcgatggtcactgtcggtctgcttgctttccttgaggcttggaacaatttcatgattccgctgtacctgtcgagttcgtcgaacgccacgctgccgctcgctttggtgaacatgcgtcagcagactatgggcgtcattgattacggtgccaccgaagctggcgtcgtaattctgatgatccccgcagccatcctcttcctagccctccagaagtactacgtcaaagggtttatggctggagccgtcaagggctgacacctggcgatgtcagcccttgggagacagcccagtggactgtttccaggctccggcctgagcagaaccgaaggcggagtagccaagagccgtcaagggctggcgaagtccttaatcttaaggaaatatcatgaatgtaactattacttctcctttctggaagcagcgtcgcgaccagatcgttgaatccgtcattccttatcagtggggtgtgatgaatgatgagattgccactgaagttccggatgatccggctggcaatcagcttgccgataataaaagtcatgccgtggagaatctgcgtatcgcagccggtgatgaggccggtgaatttcatggcatggtcttccaggattctgacatatataagtggttggaggaagcggcttacgcactgtcgtatcatcctgatccgcaattgcgggaactgtgcgataaaaccgtcgacctcatcgcacgtgcgcaacaatcggacggatatttggacactccgtaccaaatcaaaaccggtgaatgggcgcatcgtgagcgtttcacactgattcagcaaagccatgaaatgtatgtcatgggccactatattgaggctgctgtcgcctatcatgaggtgaccggtaaccagcaggcgcttgacgtggcgtgccgtatggcggattgcatcgatgccaatttcggcccggaggacggcaagatccacggtgctgatggacatccggaaatcgaattggcgttggcgaagctgtatgatgcgaccggtgaggagcgctatctgaatctggcgcggtatctcatcgacgtgcgtggtcaggatccgcagttctacgccaagcagatcgccgctgtcgacaacgactacattttccgggatctgggattctacaagcccacgtacttccaagccgcgcagccggtgcgcgagcagcagaccgctgacggccatgctgtgcgcgtggcctatttatgcactggaatcgcacatgtggcgcgtattaccggcgatcagggcttgctggatgcggcgcatcgtttttggaacaacatcgtgtcgaaacgcatgtatgtaacgggtgcgatcggttccacacatgtgggggagtcgttcacgtacgattacgatctgccgaacgacaccatgtatggcgaaacgtgcgcttctgtggcgatgagcatgtttgcccgccaaatgcttctgttggaaccgaatggtgaatatgccgacgtgcttgagcgtgagctgttcaatggtgccatcgcgggcatcagccttgatggcaagcagtattactatgtgaatgcgttggagacttcgccggacggtttggacaatccggatcggcatcatgtgctttcgcatcgtgtcgattggtttggctgcgcatgctgcccagctaatgtcgcgcgattgatcgcgtcggtggaccgttatgtgtataccgaacgtgacggcggtcgcacggtgctcgctcaccagttcattgcgaatcaggcaagttttgattccgggttgcatgtggagcagcgttccgattttccgtggaacggtcatattgagtacatggtggaattgcccgctgaggcggctgattcggtacgtttcggcgtgcgtattcccacatggtcggctgattcctatgcgctgacatgcgatggtgttgctgtgaagacggctccggaaaacggtttcgtatatttcgcagttgctccgggaactgcattgcatgtggtgctggatcttgatatggcagtgcgattggtgcgtgccaactctcatgtgcgttgcgatgcaggtcgtgttgcggtgatgcgcggtccgctcgtctattgcgcggagcaagccgataatgccggcgatctgtggacgtaccgtcttgctgatggcgtggatgtcgcggatgccacggttactttcgagagtgatttgcttggaggtgttgacgcggtgacgttgcctgccgttcgtgaggctgcggatgccgtggacgccccgttgtacatgtccgctcagcgtgacgcctcagatgagcggacgtcgctcaagctggtgccctactacgcatgggccaaccgcgaactcggccaaatgaacgtgtggttgcgcagctaaacaaaagaaagacttgctacccggcgctatgagtgccatggtgccgggaagcgggtgagcgcggcgtgatcgattggagccgaatgcgccgcgctgactggaatgagagaccggctgccccttatggggtggccggttttgtcatagcccctagtataagacgggaaaatgcgaaaactttccttttcgcataaaagccatcgtatggcagttcacttagaaagcattggagaaaactgaaagaaaatttgcgaaaccgtattcgcgtcatgtattcttgaaatgtcggtggacgctccaatctcatgtccatcgcacgactctcattcctacagaaagaaagttggatgccagggaacgagccttggcaaccaagggccaacgatggtccatgtaggaggaattgatgacaccatcaacaaggaagaaagggattgtcacgtcattgggcgtgctgacggcagtggccacactgttgtctggcggtgtgacgaccgcatacgccaatgacgcgctggccaatccgaactctgccatggggtatccgagtttcaagggggccgccgacccgattccgggcaccggcgtcgctttcgatccctcgacaagctacctcaagcaggtgttcgatgcggatgttgccaacggtgccggaaccgacaccgcacacgacttctggatcgacaagatgctgacgcgcacaggcaccgcaccaaacggtaccggcaccaacgatgctggcgactacaactatgcgggcgcagacaagaacgaatacctgttctcacgtggccgtgccgcattcatgtacacgcatacgccggaagcacttggtttcgtaggagatgtcgcatactgggatcagaccggcaacgacggctttaccgttgaggtaagcattggcggttccaagcagaccctgcgcgagaacaccgacaagcgcaagcagacgccaagctacttcaccacggaattcaccaacggcgacaagaccattaccgtcaccgaagtcaagtacatcacctacaccaatgtgatggtcgcgaatttcaccatcaccagcaccaccggcggtgacgtaacgctgacagcagcctcgccattcgcacaagacggcaatgacggcgacactgaactgaccggtcgcttcaatgtgaagaacgatctgaccaccatctatccacggttctccggcaacggtttcaccgtaaaggacggcaaactcgcttccaccctcaccttggaagcgaacgtgccacaaaccaccaagctgcagcttggcctgatcgccaacgagttgccggactccaccgcggaatacgaagcccgattcaacggcgatctcaccgatccggccgcttcctacaaggattccgtgaccacctacaaccagtggtgggtcgataacattccttacgtggaaacccaggaacacaatatcgacaaaaccgtgttctaccgctggtggctgagccgtttcaacatgttggacgccaatatgccgggcaatacgttccagtatccgacctccatcgaaggcgtgctcggatacaacaaccagatcgtgctgacatccggcatgttcatcaacgacaccaagtggttccgtaacgccgaatactcgtacggcacttgggtgtcggccgggcagacagccaagaaaggccagtccgggtattactactaccacgacaatccgggcgatccagccaattggaaccacagctacacgcagtacatcaccaaggccggttgggactcctacaaggtgcacggcggcccgtcatcattggctgaagcgttgggtgattacggttccgaagatgtcaaaggtctgctcaattcgcaaagcgagccagacagcaacgacaaccagaatagcaacggcaacaagctgatcgactggtcgtggtggtccatgaccggcaacgatgccgacgcggtgtcgttctccgaacccggtcgttccggccagcgtatggaccgtgccgacggttccgccaacatgtgggccaacgccaatgccgccgcgcaagcatacaaggctgccggagacaccgaaaaagccgctgaaatgcagcagatcgccgacgccatcaagcaggatgtgctcgacaacctgtgggattccgacagcaaactgctgctgcacaagtggctgaacgacggtcaattcgcgaaatacaaggaactcaacaactactatccgtattccgaaggtctgatgccgatcggcaatgatgattacgatagtgcgttgcgcttgttcgaagatgccgacgaattcccgattttcccgttcttcaccgcgaatcaggcagacaagaaggcgctgaatttcccaggatcaaacaatttctccattatcaatgcaactccgctgctgcaaatctattctgcgggaatccgtgattataatgctgcagacaacggatatatcacgaacgaatcgttcaagaaactgctgtattgggtggcgttctcgcattatcagggaggcgacaaccagtatccggaccagaacgaattctggaatatggataataattccgcaggaagcacgattccggagaagaacgccgacgccagcaagaacggtggaaagatcacctaccgttcctggattcaccacacccagcttggcaccaccaactggacgattgtggaagacgtggcaggtatggttccgcgtgaagacaacaagattgaactcaatccgatcgagattcccggttggaaccacttcaccgtcaacaacctgagctaccacgggcaggatctgtcgatcgtatggaacaacgacggcacctacaacgttccgaagggatataccctgtatgtggacggcaacgccgtgttcacctccgataagctcgcccacctcatctacgatccggccagtggaaccgttgaggttgccgatgattccggagcggtgatcaccggcgcgaccaccgccaccatgccgaacgccaacgaagtgacctacgcatcgaacagcagggttacgcagatcttcgcgcagtccggacagaacgtggacgaagcgtccaagagccaggccaacgtggccaaggacgccgatgtggaagccacttacgaaaccaagggatacccggcaaccaatgcagtggacggcaagaacgtgatggaatccttctggggcaccaagggatccaagaacgccaaggattcgctgaccgtaacgttcaagaacggcgtgcagaacatcgacgacgtgcgtttgtacttctaccagacctcgtccagccagacgattgccggctacagtgagccgtcggtgtacacgcttgaatatcaggatgaggccggcgcatggcatgtcctgccgaaccaggtgcgtacgcctacttacgcgggagccaactacaaccgcgtgcagttctccaaggtcgtggccaaagccattcgtgccaccttcactccgcaagcaggtcaggccattggcttgaaggagattcaggcctacgaaaccgacattgtgccggaaggcgaacctacgaaccaggcgccaagcgttgacgcctacattgccagcagcacctcgtccggtgcgcagctggtgggcacggtgaaggacgacggcctgccgtctgacacgctcaccaccacatgggagcaggtgtctggccctgaaaacggcgaagcgaagttcgtcgacgcaaccgctgccaacactacggtcacgttcaaccgtgagggtgactatgtgctcaaactcaccgcattcgacggtgagaagaccggtttcaaggaagtcaccgttcacggcattccttccgacggcacggtgaatgtggcttcacagtccactgcgagcgccagcttcaccaatccatatcaggcgaaggacaatgccaagaaggttatcgacggtcaggtgttgtataccaatactccgaatgagacctggaataattggggtgacaataccggtaccgagccgtggctgcagcttgcctgggatggcactgttccgttgaagaaggcgaagctgttcttctggactgacggtggcggtgtgccgatggtcaagtcgtggaagttgcagtatgcggatgagaatggcgattggcaggatgtgaagcttgccgccggccagtcttataccacgatgcagggtgaaggcaatgaggttcgttttgccgaaacggtggagacgaacaagttgcgtgtgctgttcccgaagggtgccattgttggtgctaccgaatttgaggcgtatgcgcttgatccggtgagcgtggatggcgtgaatcgtatggtgcagactggcagcaaggctgccgatgtgaatctgccgaagacggtgagtgccagctatacggacggttcccgtcgtgacttgagtgttgcgtgggatgccatcactgacgatcagcttgcttccgatagcgagtttgcggtttccggaacggttgttggcgcgctcgctggaaccaaggccactattggcgtgcgttccgacgcgcagtctcagactgctggtgcggctcagccgatcgaacagacggtgtaccagaattccaagtcggtggctttgccgtctgtggttccggtgcgattccccaacggcatgcttgacgatcgcacggttatgtgggatgaggcaagtgttgccggcgtcaagttggacaccatcggcgattatgaggtgtccggcacggctgagggttcaagctcgcaggccaagattacagtgcatgtggtcgccgatccgaatggtggtgccgatcctgatcctgagccgacgccggatcccaagccggagcccgatactccgttgactggttggattgaaggcagggccattgacaccacggtgagtgccgaggcgagctggtctccggcttccggcaagctcaacgatggtgtgctggttgacgatacgtggccgtctgatgatgacgccgatgtgaatggccgcgtgtggggcagctggggtcaagcttccgctggcatgtacgcgcagtacacctggagcaaggaagccaccgtcgattccagccgtgtgcagttctgggccaacttcgcggagcgtaatgatgccaagggcggtttggatgttccggacagctggaagattcagtacttggcttctgatggtatatggaaggatgtggagaatgcgcaatactccaccgtgcgtaattccccggcctcacgtgcctctgacgatgctcaaggctggagcgtggccacgttcactccgctgaagaccacgtcgttgcgcttggtgcttgatccgccgaccgccgagggcgtcaccttcggtctggcggttgccgagtggggcgtgcatgctgcggaaagcactcctgatccagaaccgactcctgacccggatccaacccctgatccggaaccaagcgtggacaagagcaggctcgaatccaccatcaacgcagccggttccgtgcaacaagctaatttcacgccgaacagctggaaggcattctccgaagccatgggtaacgctcaaaaggtgtatgcggacgagagcgccacccaggatcaggtggatgcggccatcaagcagcttgaagaagcccagcagacactggtgaagaaagccgacaccactgagttgaagacggttcttgaccaggcacagggcgtcagcggtgacctctacaccgaagccagcgccaagaagttggctgaagcagtggatgccgcctccaaggtgttgaacgatgagaacgccacccaagctgatgcggatgccgcagtcaagcagctgaccgaggccatcgccggacttgaactcaagccagcaccgaagccggacgacgacaagaccgaccccaagccgaatgccaagcctggaaacaagccggtttccaagtctgaagtcagtgccgcaatcagcagcaccggcagcaatgtcatcggcatcgccgtcgtaggaatgatcgtcctgctgacgggagccgccatcatgctgacgcgccgcaaccgcgactagcgctagcaattgctcaagtcctcttacggatcgcacgaggaataccaacgtaacctaagcaatccgtaagaggacttttcaatatccaatcgtgaaaacaggaatattcatgagcttttcgcacatctcacatgcgtcgatgaagacgctggtggcaggcatcgcagccgcagccaccttatgcacgggagcaatcgcaaccatgcagacagccaacgcggccgacgcaagtaccgcgcccagcgtcgccggacacgcctacaacgatctgccggtcggcaatcccgacgtcaccgtcacgcaaatcgacaacagtgcgttgccggcaacccttcgcaaccccatcgggcagaacgaaggaaccaatacccccaacgacctgtcgcaaaactactattccgcagacgcatccacccttgaatacgatggcaaactcttcgtattcacaggacacgacgaggccgaaccaacctacgggtccttcaatatgaaagactggggcgtctacgtaaccgacaatccggaatccggcaaatggacgcactacaagaccatcgccaaagccgacctgttcgactgggcaaccggcgacggagcctacgcaggacaagtagtagtcgacgatgctggcaccgcagacacggccgacgactggttttactactacgtgccagtcaaagacaagaacgcagccgcgggagccgacccgttctccatcggcgtggccaaatcaaaaagccccctcggaccatgggtcgacgccatcggagcgccgttgctgactaccatgcagacgcaaatcgaaaccatcgatcccgcattcttcgtggacaatgacggtaccggatatctgcacttcggcaccttcaacagcgaactcgccgtaaaaatgcagcgggacgccaacactggccgcacctcatatgttgccgtggaaaccatggacggaacggcggacggagcgccgaaaatctacaatatgcgtgacgccgacgcgctcgccaacatacccgactacgatgccagcaaagacgtgcttggcagcgactatgcgaaccaagtgaacgcgtcgctgaccttgggcaacaacggcggcgcttatgccaacgggcccaaaggcttctttgaggcggcatgggtgttccgtgaaggagacacctactacaacgtgtacgacggtggcaaacccgggtcgggagtggcgacctgcgtggaatccaactatcaggcgtgcgtgcaatactccacgtcggcaagccctcttgggccgtggacgtaccaaggcgtaatcgtcgaatcgggatcgtccaccaccatgcatccgtcgattcaacgattcggcggcaaatggtgggtcacctaccacactggagacaagactggtggtactgacttccgccgtacagtctgcatcgatgaagtgacgtggaatggcgggcgcatgaacgccgtttcgcatccgaccaaagccgaacggttgcaaccctcacgcaacgtggccccctatgcgtcagtggacgcgacctacaccgaaacacccgcctacaagggttccgtgaacgacgggcgagtgctggaaactgctgtagtaccgccgaaccattggacgaactatcgaaagatgccacaaacacaatcctccgattcactgatctaccagtggaatggcgctgtacgtgtgaatggatcgaaagtctggttcgataccgatgcgaacgcattgcgtgcccctgcctcatggaaactgcaatatcttgacgcagacggttcctggaaggacgtgcccaattccagcgaatacggcgtggatacaggcaagaacgcgcctaatgaagtgacattcgacgcagtgaccaccactgcgctcaaacttgacatgaccgcgcaagccgttgacgggggctatgcttccgtcggcgttcctgaatgggaagtatacgcgcaacagggagcagttgtggctgaacagccagccgacgtctacgccaagaccggagacgcgccggaattgtcgaacacggtgaaagtcgcgtacggctcggaaacagtggaaactccggttttgtggcgcacggtgtctgcttcttcgtatgcacaggcgggtgagttcaccgtgcaaggtgtggttgctggcattgaaaccaagcagcaggctgatgatctggcagccggcaacgtagccgtgaccgtacatgtttccgacgattacgtaaaaccggctgataccattgctcctgccgtgcgtgtggcattggctggcacggctggcaatgatggttggctggtcacttcaccgatcgctcttattacggcttccgacaatgcggctgcgccgatggcaaaactcgaacttgcggtcggggatggcgcatgggtgaccgtcggaacgaatgtgaacactgcggtaaaggctgtgactggcgagggtatagtgagtgtgcgtgcgcgtgccactgatgcggccggcaatgtgagcgaaatcgctgctgcggaagcgcgtgtggatgctacggctcctacggtaaccgcctcggtagatacggtttcccgcactatgacattgaccgcctcagatggtgctggatccggtgtgaaaacggtggaataccgggttggaaacggcgaatggcagcaatatgaagaaggcgcggcgattactgcttcttcgtcgaagcgcgaaacggtgagctatcgggcttcggacattgctggcaatatgtcggctgcgggcgtcaaagatattccatccgatacgtcggtgccgttggccggctatatcgagcaagatgccgttgctactgacgtggacaaaaaagcgtcttcttggacagctggtgttgccgcgcttaacgacggcaaaaccattccgggcgattgcacggttgataacgcctgcatttggggtacgtggccgaataccggtgaaatgaagctcgactacgaatgggatcgcgaagtcaccatcgattccagccgtgtgcaattcacctccgatggagggggcttgggaatgccggcgtcgtggaaactgcagtattgggatgctggaacgaatgcgtttgtggatattcccgatgccacatatacattggtcaccaatgctcccggcgcttacggtaccgataacggcggatggagcgaggcaacctggactgacgcggtgaagaccactaagctgcgcatggtgattcaatccggcagtgcatcgccggctgccgccgaatggcaggttcatgcacctgaaccgactccggacccgacccccgatccgacgcctgagcccgagccggaaccaacgccaactccaaagccgactccggatatcgataacaacggcaagcaggacggtaataatgtcaagccttctgcgaaaccgcaatcatcgcagcaatctcagtctcaacgtaagaagaagctaagctctacaggcgtcgctactacggcaatcgtcattgccatgacggtgctggccacggcggggtgctgcatcttcgtagccaagcggggcaagctgcgtaactgaatccaacataaaagtggtaagttctcagcctcggcctctggactgaatatgtgtgcttgacgcactcaaggtaccgttacgcggtcttcgcggcaagccgctcacttcgcctgaggaaaacccactgggctttcctcttcacggctcagtggccaagcctacgatcaagcacacgtattcagccgccgacctttggggtccgacccctacgtttgtgtgaactcggacgtcatcggaccccattttgctcataactcgcctatgtatggcagatttgcgggtctgtcaggaagcatctcgcctatatatggcagaagacttcgctaaaaagccatatagggggtatgaaaacgcatgttttctgactccagtctgccatatataagcgagatgcctcgtgacgagactcaaaatctgccatatatagtcgagatatggctcggctgttggtggcttgagacggcgacatacgatcgcggatcgcgtaggtggtcgccgtttttgtgatttatgggctaatctcagaagagacagattcgatggccgcgaacggtgagaaccaacgcgagagaatgcgcgagcggccgcgtaagggaggaaagcccatgtccaaatcattcgtcaacaaggcgctgctcggcggcgcagtcgctgcaggcgccgcagtgtgggcgatcgcgccgcgtaccttctccgataagcgccgcaactatgtgccgtccattcccgacgtgtggtacgcgcatcgtggcctgcatgacgcgggttccggtctgaccgcgcagtatgccaacgagagcggcgagtatgtggcgctggcacgtcgcatggccatgaaggccggctatggcagccccagcgtgactggtgcgatcgctccggagaactcgcttgcggcattcgcagcggcttgcgaagccggctatggcatcgagcttgacctgcagatgaccgccgacggcgaaatcgtggtggtgcatgacggcgatctgatgcgcgtcgccggagatccacgccgtatcgccgatctcacgtacgatgagctgacccgcatcccgctgttcccgaccgacgcccccggtgccgccgtggcagcgccgttgccgggttcgcttgaaaatccgccgctggtcaccacacctgacagcgctccggaagggtatttccagcatgtgccactgttcgccgacgtgctcaaggtagtggcgggtcgtgtgccgctgatcgtcgaatacaagttcgacgacaattccaagtggggttcgcgcgatgtcgagctcatggaaaagggcgacgcgctgctgcaggcctattccggcgcgtatgtgatcgaatcgttcaatccggctgccgtcaactggtataaggagaaccgtccggaagtgtgccgtggccagctttcctggtggccgcagggggaggagaagccgtctgatcctgctgcgctcgccaaggaatatgcggccggtgcgctgattttcgactggatttcccgccctgatttcgtcgcctacgattggcatggcggcaacagtccgcaggtacggttggcccgtttcatgggtgccgttcccgtgtcgtggacggtgcgcagccgcgacgagctcgcccagtgcgatgactggttcgaccatcatattttcgaggcgttcgtccccgacgagcagtagaggttttacatatgatttcggcctgccgccgcatgatttgcgttgtggcaggccgtttttattcgatttacttgattgactgattgggttgattcggttgagctctgatgcggtcagtcgatcacgccatatagacggtcgccggcatcgcccaagcctggcacgatgtagcacttgtcgttaagcttctcgtcgacggcgcacagcaccagcttgaacttaatggatgggtcgaggttctcctcaacgaacttcaggccttccggagcgcccagaatgcacacggcggtaacatcctttgcgccgcgctcggccaggtaatgtgttgctgcgaccagcgtgccgccagtggcgagcatcgggtcgatcaggaagcactgacggccgctcagatcgtcgggcagacggttcgcgtacgtgatctgctgggttgggttctcctcgtcgcgcttcatgccaaggaagccgacctcagcggacgggatcatcttggtcatgccgtcaagcatgcccaggccagcgcgcagcacaggcacaatgatcggcgccggggaagcgatgtgcttgcctaccatcggagcgacgggggtctcgatcggcttgtccacgacttcgacgtcgcgggtggcctcgtaggcctcaagcatcacgagttcggaaacgagctcgcggaacgtggaggacggggtgttcttgtcgcgaagaacggtgagcttgtggtccaccagcgggtggttcaaaacatgaatatccatgtcttctaagcgtagtccataatcgcgaggaaaagcgcgggaactgggaaaggagccaagaaagaaactgaaaatcgtatgaaaaaagcaacgaaacttaagaagagggaaagcgccgaaccacgaaagcgcctgtcggcgcaaaggccgctcgcagcggcaaaaaatggagcccggggctatgcatggcccgacgcggattcctattctacagatgctgcagaccgtacgctacgtcgtgtcgcgaattgatggtgcgagcgccgtaaaacacttccggtagcggtacagaggtgggtgcagaggcaggtgcaggggacaggtacggaacgcgcgttactccagttttccgcgacgccacagattcgccccatggcgaaaatccttggccgtgacgaacagattgccggccgtgtgcatcaaacgggacgatttcgtacgtacctgcttttccatggcggaaatgccggaatcgctgctatcggaaccttccgcagctttcaatcgtgcgatcatattgcgtgcctcgatgcgcaatcccaacgcaaccacgtcggtgaacgcggccgcacgttccagcgcaaccgcaaaatcgccggtgaacgcgcctgcgagaatcgaatcggcaatatgcgcaatgtcatcttccgtgggcgcctgatcgacgccggcaatcgccgaggcggtagtggcaaccggctctccagcgcgccacaaccgcgcgatcgactcgcgattcttccgcatccacgtgcgcagcagatacagccgccacagaatgcccggcagcgaatccggctcggcgctgctccacagttcggcgatcacgtcaacgccctcgcggtccaccagcgtgagcacgcgctccaccagttcggcatcctgcgtatgatgcacgcggtccaacagtgcggccgccgaagcgtggctcatctcgttgatttgcgccggatcggcacctcccgcgatattgtcggccatcatctggtcgagttgccccgggcgggccggacgcggcgatccggtgttggtgaaaccggcggaacggcttggtacaaccgatccggaaccgtaatgcatgctagtagacaatgggcgaaaccttttgaatatcgataatgctgggaccttgcggcgtatcgattataaacagcgctacggcggtgccggtaggcatgaacggcgttttggcgatgagctgcttggagagcgctttgcgggcgcatagtccgcgcaagtgatcgaacatgcctccgataaccggtcggtgcatgcagatcgccgtggtttcgcgggtctcgagcgtgagctggatctgcttgaagaacgccagccatgcgatggtcgggtgctcggcgaaggcgtcttccgtgagcgcgtcgatgtgttccatcgggcgttcggtctgccagctaagcacctgcagtgtttcctggcagcgcagccatggtgaggttgcgaggcgggttgggttgtagcaggcgagttcgcggttgagtgcgaatgccgcggccgcgcctttcggagtgatcggccggttcgcgtcggtgcctttccaggatttgcgcgattcggccttggcatgacgcacgatcatcagattctgcgcggtcgcggcaccctcctgtacgcggtccacaaaaatggcgagggtgtctttatcggtggaatgcgtgaggattttacgtgcttcacgtacggaaacccacacgatatcgttgatttcgcctacatccgcgcgatgcacggggccgaatgcgtcaagcagatgttccgcatcatctccggaaatcggttgcgccatccaatacaacgtgtgcttggtgtcgacggcgcgatcgtgtgaatgccgggttttcttgccttcttcggacagtggatattcgacttcgcacagatacgggccgagtgcgatggaaacgcctgtctcctcgccgatttctcgcactgcggcatgacgatgcgattcgccctgctcgagtttgcctttcggccagctccagtcatcgtactttggtcgatgcacgatgcacacttcaatgctgttgagttgttcctttggagttttctgcgctgcgattgctggattttccgcgatttcgctaccggttttccaccgccatacaatacccccggcggcttctacgacacgtctcatgctctcgctcatatctttcattgtaagtggttgggcacgggtttccccatgattgcgcgacggcaatcgtgccatccgagttttcctgcgttttcccacgatggtgatcgcgtatgccgcaacataggaaatggccgattctgcaacagcagaatcggccatttcctacggtttagtgccttgccggtcggcgcgtatgcttcttgatgagatattcctgggaatcgaccagcgggcgaccctcctcatccttcgcatgacgcacgtaggttccgtcggctgccatatgccacgaggtggtggaatcggccatttgcagatccacgtacttgatcagctcgtcgatctgctccggagcggtgatgcgtaccagcgcttcgactcgacggtcgagattgcggtgcatcagatcggcggaaccgatccacacttccggacctgcggccggaccttcaccgatctgcgggccatcggagttcgcgaatgcgtagatacggctgtgctcgaggaaacgacccagaatggaacgcacgcgaatgttctcggaaagtcctggaacacccggcttgagcgcgcagatgccgcgttccacgatgtcgatcttcacgccggcctggcttgcacggtatagcgcgtcgatggtcttctcgtccacgatggagttgaccttgatcttaatccatgcttccttgcctgcgcgtgccgcatcctcttcgcggcggatgcgctgaatcagaccggaacgtacggtacgcggcgctaccagcagacggtggaagctcgacttcggcgcataaccggacagctggttgaacaggcgggtcatatcctggccgaccaccggatcgcaggtcagcaggccgagatcggtgtagatgcgggcggtcttcggattgtagttaccggtgcccacatggcagtagcggcgcaggccgtcggcttcctgacgcaccacaaggctcagcttgcagtgagtcttcaggcccacgatgccgtacaccacgtgcacgccggcgcgttccagcttgcgtgcccatgcgatgttggcgtcttcgtcgaagcgtgccttgatttcgaccagtgccagcacctgcttgcccgcatgcgccgcgtcgatgagcgcgtcgatgatcggggagttgctggacgtacggtacaacgtctgcttgatggcgagcaccttcggatccgccgcagcctgcgctaggaacgcctgaacggaggtagagaacgaatcgtacgggtgatgcaggaggatatcgcgttcgcgaatcgctgcaaaaatgtcttgcgcgcgggacgactccacctcggcaatctgacgattggtggtcggcacgaacgaacggtacttcaagtccggacggtcgatgccgccaagttcgaagagcacggtcgcatcgagcggtgccggcaggcggtacacctcatcggcgctgacgcgcaactggtcggcgagcagctgggaaaggaacgggctggtttcgtcggaaatctcaagacggatcggcggtccgaaacgacggcgcagcagctccttctccatggcgttgagcaggttctctgcatcatcctcttccacgtcgatatcctcgttacgggtaacgcggaaggatcgcgcttccttgatgatcatgcccgggaacagggattccaggtgcgcgatgatcaggttctccatggtgatgaagccgtagcgcacgttggtggcatcgtcgtcggtcatgtcgtcgacgggcacgagacggttcaggtttccaggaatcttcacgcgagcgaagtgggacttgccggaagccgggttctccaccagcacggcgaggttgatggaaccgccggaaatgtacgggaacgggtgggccggatccacggcgagcggcgtcagaacagggaacacctgctgacggtagtagcgagacaggcgctcctgttcggcggcggtgagcttgtcccagctcagcagcacgatctgttccttcgccaggtcgggaagaatgtgatcgatcatgtagtgcgcgtgctcgtcctgcaggcggtgcgcctgctcgctgatggcgcgcagctgctgccttgggctcaatccggaggcggccgtcacggcgatgccggtgtcgatgcggcgcttcagacctgcgacgcgaaccatgaagaactcgtcgaggttgttcgcgaagatcgcggcgaagcttgcgcgttcgatgatcggcagatcttcgtcttgggcaagttcgaggactcgcttgttgaacttcagccagctcaactcgcggtcgaagaagcggtcgttcggcaacggctcttcgccggcctgaagctcacgcttgtcgtttttatcggtctcggcgatatgctcagctatctggctgcgcaagatcgccttcgagggtgcgtcaaaaatctgtgccatactttcctactttatccttaagtagctggaaatgctgtaaaaagccggcaaaatttagctggagttaacattcgttcgctcattgtgcaaattagggtgtcgacacgccgtgtttttgtcgcaaacgcacgcaaacgaacaaacacgccttgcgtttcgcacacgatggagcatttttatgattcttgcgatcgtaaagcaacagttgcgacaaatacggaacatcagccggtttcggtttgcgattgccggattgctgagcataattacgaagtacaagaacaacttaaagagcagagcccacaaagagtgtatggccaagataggtcgttacgttgaacgggcattggatagacttaccgttacgacgatgttgttgtgcagagattctgcccttaaggttcttgcaaggaaggcccgctcggcgggccttcctttttgtttgcctgttctcagggagtttttcgggaaaacgacggacgccgattatcgtcgttgtgtggataacggtgcataacacgccggggtcgtggataactcgcgtcctccgaccacagggccggttcagcttgcaatggtgctcgccgaagcttttcaatcgacggtatgagtaatgcaacgtctttttcgaatgttcctccggtgccgctgccgtcgggcgggctgttgccggtcgccggcgcgatcgcgccgcaagcgtcaccgccgacacaacgcagaaccgtctctgcgcaacggttctatacgccgccgggatcgaatcgcggtggaacgcaactggttggcgctgtgcctggaacgtatggcatggttgcgcaatgcggtcgcgcatcggtggaggaaccctgcgatatgggcaatgtggtggttatcgactccgtggtggcaggagtgggcacgagcactctggccgccttactggcccgcgagctgagcgaacgcggcctcaaatgtgtgctcgtcgacgccgatctgcaaggaggtgggctggatgtgcttcttggcgtggaaaacgaggacggctcacgcttcggggaaatcagcgctccgcttggcaatatcgacggcaaagcgctactgcgggagctgccaatctgggatggtgtgccattgctggcatgcgatccttggaaaaccgaaaatccgcaatcgtgggaagtgcaagcgtgcattcatgcgctatcgcaggtgcgaagcgtggtcgtcgtcgatatggggcaatggaacggactgcaggatttgacggaactgcgcaaggccatccgcattaccgtggtcgaactgacggtacttggtcttgcgcgggccaaagcgaatctgcgggcgcatcacggttcaatcggagaacacgatgccgcaacgcaggaacgggagtttctcgtaggcgtgcaaccgcgcggaaccgtacgcgaccatggcacgacggcaatcgaggaagcggcggaatacctcgactgcgatatcaccgcggtcatcaaaccggatgccaagctttgcagcgaactcttggaagggcttggactgcgcaaacccaatcgtacgaacgcgaaagccatcgcaacgttggcggatctcattcaggaagcgttgggagaaaagagcatcagtcatggaactcgggccacttagcgacatcgcatccgagccgggcgtcaccgacatcgcggtaacctgcgacggaacggtgtgggtggatcgcggccaaggtatgcggccacatacattgcgcgtgccattcagcggtccccaagccatccgcgatttcgctgtgaggctgtgctcgcagcttggcagaaggctcgacgacgcctgcccgatagccgacgcctccaccgtggaaggcgtgcgcgtgcacgcggttatcgcaccgctcgttccgcaaggcgccgccatcagcatacgattgccggacgttgttgtgcccagtctggaatctttggcggaaaacggcatgtttccaagcggatggatgcccttgctggaaggattcgtggaacgaagggccagcgtgctcgtgaccggcggaaccggagcaggcaaaaccacgctgctcaaagcaatgcttatgcgatgcgcgccgggggagcgcgtcatcaccgtggaggaggtgcgcgaacttggcatgctcaaccatgccaaccacgtgtcgctggtgacgcgcggcgccaacatggaaggcaaaggcgccatagggctgtcgcagctgatatgcgcgacgttgcgtatgcggccggaccgcattgtggtgggcgaatgcaggggcggcgaaatcgtggatctgctgcgcgcgctgaattccgggcatcgcggaggcatgaccaccttgcatgccaatcaggtgacggcggttccctcacgcttggtggccttgggattgctctccgggctgaatccgcaagccaccgcggcgctcgcgcaagacgcgttcgacgtagtgctgcatgtgggccgagtgggaggcaggcggcgcatcgcgcaaataggacggcttgaattcgcagagggaaaactgcggggaaacctattggccgggtggaacggcaaccaaatgcgggcttcgcaacagtggcctgatttcgtgcgcgtatggagtcgttgaatcgaggtgggcagatggaaagtctcagcattatttgcgcggtactgtgcggactggccgtatggctgtggcctcgccgaaacgtatgcgatgtgggcgaacgggcgggaaacgtagtggggcgcgcaggcgaaagccttgatgaaaaacctgacggaggattcgatgggcggtctgacggaatcgaagaggcgaacatgccgtcgaaaccattgcccgccatcggatgtgtggcgtgcgtggcttccctccgcgcatccgtgcgcagcggagccacattggtgcaggcgttcgaagaattgggtggaacgccgttcgccatacccgaacttaccaggcttcgcataaccatggtgatccgcagccgatgcccgtccaaagagcaatgcggccaagtcgaacggttgagcggcgagttgcatgcggcctgccggttaagtctgacgctcggatgcgaaaccggccgatgcctgcaggcggtggctgaatcgttgaagcgacaacgattattggatgatctgcgtgccaacgcgttcgccatgcccaaagcgacggtgaaacttctgatggcgctgccgcagctcaccgtacttttaggggaaggcatgggagcgcatccgttgaccttcctcttttcaggggtcaggggttgggcatgccttggattcgcttgtgtctgctacgggttcggactcgtatggatacgcgcgttgatgaggcaagacgatatggacggcaagacggcatgaatggtatgacgatatgaaaggaattatgtaatgactggcatatggacgctgacggcggcggtgtgcgcggctgaggcgatgtggctgaagcagtggaggccggtccgtgtgccagccgaccttgcgcccgccggacgagtgcgggaacttccgctgccgctggtattggagatgctcagcgtcgccatacggcagggatcctccattccacgcgcgctgattgccgtgggcgatatcgctgcgggagatttcggtgcgggactgcggtcggccggagaacagttgaacaaaggtgtttcctgggatgatgcgtggccggatgatggcgatcttgcggtggtgcgcgatgcgttcgcctcgtcatggcacagtggcgcctcgccggtggaacgtttggaaacagcggtcgaacaattggattgggatgagcgctcgcagatcgaacaggctgcagcgaaattgtcggttcgtttgttgctgccgactggattgtgctttcttcccgcatttgttgcggttggaatcattccgtccgtcatgtcgtttgtgcaatgacggcgtgtgcgcaacgacaacggaaaagcggggaatgttgggagacgataattcacggagttttgtggataaatgtggatgacacgccgtggttgtggataacccacgtcctccgaccacaaccctgaaaaaacgttccgacgggcacgatgatgcgcaacactgggtgcactcggccatctggccgaggttgttcgaacgaaaggaacgccatgaacaacgaaacgccaatcaacgtcgatggctcgccagacctgatgggcaaggcagggcagctgctgcatgccatgcgtgaacgggccggcaaagcggtatgcctgctggacgcacgtatgcgcacgctgaccgtcgaaccggaggaaggcgctgccactgccgaatatgcggtggttttggttgccgccaccggattcgccgccgttttggtgggcattatgaaatccgatgccatcaaaacgctgctgaccaacatcatcaagaaagcgctgagcgtcgggtgattcatgctgaggcaatggtggaaacgccataccgatgatgccgatgagggagcggccaccgcggaattcgcggtggtgctcccctgcgtggcggcggtggcgattttggtgttgtgcttggggcgtgcgtctgtggtgtccatgaattgccaggatgcggcggcggccggtgccagggctttcgcggttgatgatacgggcggcgaatcgaaggcgaggaccgcggtcatggcggctgcgggaggttcggcgacggtacggttcgagcgtggggcggacttcgtcaccgtcacggtgcaatgccctgtggtgccggatccgaccggtgtgctgcccactcgagttaccggcaaggcgacccgctacttctagcgttgctccgaagcgtgctggtctctgcgcagtgagatgcgggattgttggttgtggcctgtgcatggaggtctgtgaggtttggagcttgcgacatacgacgtgtgaaacatgttgtgaaacactattggcaaccatttgatggatgcgggtcggaaaggaatgggtaatgtgaaacgccttgtgaaacattggtttgcttggattcgcgggtccgatgagggttcggggaccatatccggtgtggctttgatcgcagtggccgccatcatgctgggcgcggccgcgtcggcgggcaatctgctgctgtgcttgcatcgcgcgcagaatgcggccgacctggcgtcggtagcggcggccaatgcgttgtattcgggatcgtccgatccttgttccgtggcggaacgcactatatccggcaataatgcgacgatcggatcctgcacgatagaaggcgaggatgtgctggtcgaagcgcaggtcggcacgcaaatgccattcgtatcgcatgtcggcaaacagtcacgggcggggccgattgtctgcgaataagcgtggtgcggaacggtacattgtgcgggaaatcgcgcttcgtaaaaagggatctttctacgtaaaggaacattcgttccacaaaacgcggccatttgtatggaaagccgttcgcatgtggcgtgtggagcgaatcgcggttatcgtactgaagtatgagcgaaacgtcatgtgtgaatgcgaccgttgccgttgtcggcaatccgacgtcaaacaaaggcaagggtgccgaggtcggcaagcaggtggttgagctgctgcaagaggccgggcgcaagcatggcttcaacgtgatcgacgtgaccggcgagagcttcgacgattccttggcgaatgccaggaatcgcaggaacgaatacgactacctggtggcggtcggcggcgacggcatgattgcgcttggagccaatgccgtgggctgttccggtaaaccgttgggcattgtggcgacgggttccggcaatgatttcgcccgcggtcttgagctgccggtcaatcgcgtggaaaccgctgtcgacggcatcgtcggcgcgattgtgcgcggcacgcatattgacgttgatatgggtttggccacgtcgttgcagggcgggtatgccgtcgattccagtaccggcgatgatctggtcggcgattcggacgtgccattgcgcccggcggtcaaccgcttctacgcgggcatgctgtcgtgtggtttggatgcgagtatcaacgaccgtgccaaccattcccgcttgcccaacggttcggtgcgctatttcgtggcagcgattgtggaattgacgcatatgaagcggtacggataccacatcaaagccacgttggccgatggaacggtggaagaaagagacattatttcaccgttgcttacggtggccaattcacggcatattggcggtggcattgagatttcgccatattcacgattctcggatgggctgcttgacctggtatggctcgaccacgtgcccaatgtcgccgaatgcgtggatgcggtgtctcacgcgtatagcggcaagatcctcgggtgcaaggtgtttgggtggaagcgtgtgcgcgatatcgaaatcacccgcgcgcaagagggtgatgagccgccggtcttgatggcggacggtgaatatgttggtcgcctgcctgtcaaggtcgtagttcaagaccgtgcgttgcgtgtgctggtgccgccggccgtggcggaaagccaagctgccaacaccgaagagaaagtgctggaagccatcaagcgtgatcaccgtgatcctgtcaccggcaaaaccgacacctactacgcgaagcgctcgcggtagtgcgtgcacatgccggtcaaaccgcaacattgcatatcgaagatggcacgtatgcaactgattgcgtgatcggcaatcgtaagcaatcgcaaataatttcgcgatactaacgaaaaatccagtacccgcaagatctttatcttacgaataccggattttctgtaactagcgaacgccgtaactatcgaacacggattgcggtcaggcggcgacttcctggcgggcgatggcctgctcgtagtcgcgggtgcccttgaagacttcctgcagccacgggttgacgtgctgcttcttcgcgcggtacatgatgtagccgagtgcgagcacgttggccacgagcgcgatgatcgacacggtcaggttcacgttcggattgttcaccgactgcacggcgaacttggactcatcctggaacgtggggaacacctgcgcgaacatgcaccagatggcgagcgtgttggcgcggttctgaatccagccgcccttgttccagaagaagttcgccacggtcggggcgagcagcagcgcgaggccgcaataccaggagtgggtcggcaggcagttgtaggtgtagcagaagttccaaatatcgtatgcgacgatgaatacccaagtcatgtcaggccacagcatgtcctgcttcttctttgacacgtaaatgccgaaccagccggtcatgcaggcgatgttgatcaggccggcaacgccgttgaacacattgtgccagccgccatacagcgtcacgccttcggtggaaacccatgtggtgccccaagcgcgaatggccgattcgaagtcggaggccacggcgataagaatgttgatggccacgatcacgaacgggaagcacttgaaccattcggatttgccgatcttgccccacttgtatttgagtgccatgaagccgatgcagcctgcggtggccgcatatagcttggcatagtggaaccagctggtcatatgcacgtaggtcggattgctgagcgcccattcggcacccatcgcggcggccacgtaaatggtgatgaagtagatggtcagaatggccggcacgatcaggaacgcgatcacgccaccggtcttggtgcgacgggccagctcattggcgccgatcaggcagcagaatacgaggatccatccgatccactggtatatggcggtgtcgccatagacttggaacaacatcgctcttcctttctctcaacacgtatgcgcgcggggtgagctgcgtttacatgtattcgttcaggtgcagcgtctgtgccgcgacctgtctgatgacggtgtcttcaatgtcgggatgcagtctgatcagcgaaatcaggccaacgatgagcgtatagaacgtctcatgctcgttggtgatgggcatgccatgcaatttctcgaaatcgcgcactgtcgaattgcagatgtattccgcaatgcgatcggccacgcggtcgatgaatttgatgtacagtcccgcgttgccgtcttcgatcatgcgttggctgaacgggccctcatcggcgatgagggaacgggtcagtcgcaccacgtcatcgagcgctttcgagatgttgccgacttctcgattggcgttccactcctccaattgcgagatgacttcgtcgatgacgtcgtcgagcacggcgtccgcaacttggtctttgtcttggaaatagtggtagaagagagatctggtcatgcctacgcgacctgcgatatcgctgatcgtgattttcgaaaagcccttttccaggcagattgcgcgggctgcatgcacgatttgcgcgcggcgtgcatctccgactgttgttgcgggggcgttgtgctgtccgtccatggctttctctccttcgttcgagtggcgtctctcacctgcgcgacacgttgacactctgtcaatttcttgactgccctcagtctaaaccgtacattgacacaatgtcaatttcgtagtgtcgatgtcgtcactcccagcttaaacgttgccgcggcgcttgtctttggggacacgcgcttcaccgttacgggcaggctgtgcggccggtctttgagaaaaacgtgtcgtaattaatcggtagcctagtgacaccacagcggaaggaattgcgatggcactggcactctatagaaggtatcgtcccgacacgttcgacggcgtgatcgggcaggatcaggtcacgattccgctgatgcgagcgcttgatgagaacaaacttacgcacgcttacctgttttccggtccgcgcggctgcggcaaaaccagttccgcacgcattctcgcgcgttgcgtcaactgcgcgaaaggcccgacctcgcacccgtgcggcgaatgcgaaagctgcaaggacctcgccacaggcggccccggttccatcgacgtggtggaaatcgacgccgcttcgcacaacggtgtggacgatgcccgcgaactgcgcgaacgtgccggattcgcccccgcccgcgaccgctacaagattttcattctcgacgaagcccacatggtcacgccgcaaggcttcaacgcgctgctgaaaatcgtggaggagccgccggagcatgtgatgttcatcttcgccaccaccgagccagacaaggtgatcggcaccatccgttcgcgcacccaccattacccgttccgcctagtgccgcaggaggttatgggcccgtacctcgagcggatctgcgaagacgagcatatcgaagccgagccgggcgtgctgcgccttgccatgcgtgccggcggcggttccgtgcgagacaccctttccgtgcttgaccagctcatggtcggtgcggtcgatggcagcatcgcatacgactccgcggttgcgttgcttggcttcacgcctgacgctctgatcggcgaggccgtcgacgccgttgtcgacaaaaatggcgaagcactgtatggcgtgattcagaaggtcgtggtcggtggtttcgatccccgtcgatttgttgaggatttgcttgcccgcgtacgcgatttgctggtgctcacgttgggtggagagcgtgcggaaagcgtgctttccgacgatgcggccgccgagaacatggatgatttgcgtcgtcaggcttccgctttgggattgtctgcgctgacgcagatggctgacacgatcaatgcgacgcttgccaatatgaccggtgcgatttcgccgcgcatgcgattggaattgcttgccgcgcgcttgttggccgggcgtgaggaagggatggctgtcgttgcgtcatcttccggtgtacctgattttgccggcgatgccggaacttccgcggctgccgaatcgtcgcgtggatccatggccggctctcgtcgccgtgcggcacgacatgccgcaggaaatgtgcgggcgcaggattctgcgcctgtgatcgataccccttccgcgcctgtgcagccgtccgtggcgccgacgaatcctgccgatgccgtcgcatccggcgtggcttccgtgcttgctgacgtgcagcaggcgatgaatgcgacgacttccgtcgcttccgctgcgcctgccgcaacttccgtaccagctcccattcatgacgatcgcacccccgaccagaagtgggatgcgctggtcgcagcccttccggaagacgtgcaacgttacgtaagccgtgaaaaagtgcctcgcgtgctactgagcggcgaccgtctgtggatcaaattcgacaaggcgctcagcaaatacgcgtttgccaaagcggtggcaaaggaatcggtggacggcaataccgaagtggtgaaaatcgtccgcgccgaagtgcataaggcgttcggaccgagcgtcacgctcgcgcctgccaaaaagctggcggacgggtccgaatcggtgccgtggagcaaactcagcccggaagagcagagcaagatcaatgcgcaactcgtgcaggaacagcttaaagcggccacgctgctgacggccaatcttggtactgctgcaggtctcgaatcctccggcaaggagccggccggcacaagcgcgaagagcgccgaagacggtggcaatgccggagattccggcgatgaggagggccatcgagctgctgccggtggagccgaggaagtcgatccatgggcggccccgacgcaggaagtccatcatccggaacggcctgttccggatgatgacccttgggttgcatctgcacagccgatgcaaccgcaatcggtggtcgcaagcggcgtcaacgatgtgaaagcgccggaacaacatgcgaaacatgtggctgttcccgatgtcagcgataacgttgatccttgggcggcaccgatgcctgtaccgcagcaagcgccggtggacgacgatccttggggtaaccccatgccgattcaggcaggaccggtggatcccatgcctgctccaacggaacctgaggtggctccgaagcacgccaatcaccagcatcgcgcactgcggcaggacgcggcaccgcagcaaggccagccgaatgccgatccgtggagccagcagttctccgcgccggcgcagccaatgccgcaggtcgccgcggaagatgacgaatattccatgagcgacgagtcgatcggggcgtcaaccgcgttaagcgtggacgacctgacccgactgttcgaggtgaaaaaagtcgaggatttcgggccggacgatgcaaaaaacccgcgcaacatgcagcagaagaagaatctcgacgactgatggcggtgcagtcgcaagcaaaaatgcgaaaccgagcaaaatcgacgaatcaacgcaatcgtaagcactgcataatcgcgaatcttatggaaaccaaggagaggtgaaccatggcactggcctatgacggcgccatccaacgattgatcgacgcgttcgcgcacctgcccggcatcgggccgaaaggcgcgcaacgcatcgccttctacctgctcaacgcatccgacgaggaatcacaggggctgatcgacgccatcgccgaagtcaaagagaaaatacgattctgtgacatttgcggcaacgtgtgcgaaaccagcccatgcccggtctgcgccgatccgcgtcgcgaccacagcgtgatctgcgtggtcgaagagccgaaagacgtgatgagcatcgagcgcacgcgcgaataccgcggcctgtaccacgtgctcggcggcgtcatcaacccgatggccaacgtgcagcccagcgacctcaacatcgccaaacttatcgaacggctcaaagacagcgaagtcaccgaagtgatcctcgcgctcaacccgaatgtggaaggcgaagcgaccaccagcttcctgtcgcagctgctttcgcaaaccgacattaaagtcacgcgattggcgagcggcctgccggtcggtggcgaccttgaatatgccgacgaaatcacgctcgggcgtgcgctggccgggcgtcgtgcggtctgacatcatatttgccacatccgttacattgccggcatatgctgacgattgcgcaaacgttgcgcgggcgatcatggaagacccgtgcggaacgtatgtacgaaaaaacgcgcggaggatttgcgaggatcccatatattgttccgcatgttgggcgtgcaggggcttgacaaatcggatttttcctataattgaccagcctgcttagtatgttggcgggcaacacattgaagaagattggataagttgtggctctcatcgtgcagaaatttggcggctcttccgtagccgacccagaatcgatcaagcgcgtggcccgacgcatcatcgaaacgaagaacgccggcaatgacgtggccgtggtggtctccgcaatgggagacaccaccgacgacttgatcgatcaggcgctcagcatcgactctaacccgccggcgcgcgagatggacatgctgatgaccgcaggcgagcgtatttcgatgagtttgctcgcaatggcaattcatgcggccggctctcacgcctactccttcaccggctcccaggctggtttcatgaccgacgcccagttcggtaccgcgcatatcaaggccgtgaagcctgaccgcgtgcgtcgtgcgctcgacaagggttccgtggccatcgtggccggcttccagggcgtgaatgagggtggcgacgccaccacgctcggacgaggtggatccgatacctccgcagtggctttggcagtggcgctggacgccgacgtatgcgagatttacaccgacgtcgatggcgtgttcaccgccgatccgcgcattgtgccgactgcacgccgtatccccgtcatcgactacgagtcgatgctggaaatgtcttcctgcggctccaaggtgcttgccctgcgttgcgtggaatacgcgcagcgattcgacatgccgttgcatgtgcgcagctccttctcccaccgtcgcggcacgctgatcgtgccggaagacgtcgatccgcgcacattgccgaacatctgagatatctgagattcgcattcggcaatcgcgagacatcgcaggcaatcgcaagaaaaccaagactttacgaacaaaggtaagaacatgagcgaaaacaacaaccagtccttgggagatctgttccccgatctggggccggaagtcccgatcatttccggcgtcgcgcacgacaacaccgaatcgctggccaccgtgcgccgcgtgccgaacgagccgggcatggccgccaaggtgttcacgctgctggccgaggccggcgtgaacgtcgatatgatcgtgcaggcttccgcttccaccggcaccgccgatatttccttcaccgtgccgggttccgccgctgccaaggtgcgggatgtgttgcaggagaagcaggacgagctgggctaccagtccttcgacatcgacgccaacgtgggcaaggtggccgtggtgggcgtgggtatgaagacccactccggcttggctgccaagttcttcaacgcgctgagcgacgagggcgtgaatgtgctgatgatctccacgtccgaaatccgcatcgccgcgctggtcccgctcgagcagctgcaggacgccgtccgcgcgctgcacactgcctacggcttggatgccgagcaggtggaagccgtggtgtatggcggtactggtcgctgacgcaataccgcgcaataacaatcgaaaaaagacttgactggattgcttgaggcgtctcagccaagtcttttttattcccatatctgttttacagatatttttttcagataatctgcaaatgaaaaagcggaggattgctgaataatcaacaatcctccgcaatattatgttctgcagaaatcagatatcaccatgtgcaatcatgcatgatcatgcgtaactgcagaacatatgcagatcgttatcacttcttggtgatgtagccgagtgccttcagcatttcggcgctttccaaagcgccgccggcagcgccgcgcaaagtgttgtgagcgagccccacgaacttccaatcgaaaatggaatcctcgcgcagacggccgatggaaacacccatgccaccctcgtagtccacgtccttcttgacctgcgggcgatcgtcgtcggtcaggtactggatgaactgcttcggcgcatgcggcaatccaagctcggaagccttgctcgtgtagttgaccaggcgatcgacgagctcttccttggtcgggttcttgccgaagttgatgaacacggtggcagtgtggccgttgagcacaggcacgcgaatacactgcgaggtgatcttcagcgggccgtcgaacggcacgatctcgcccttttcctcatcgacgcggccgaacaccttcagcggttccttctcggacttctcctcttcgccggagatgaacggaatgatgttgcccaccatttccggccagtcgttgaacgtcttgcccgcgccggagatggcctgataggtgctcacgataacctcgcgcggctcgaattccttccaagcggcgagcgccggggtgtaggcctggatggagcagttcggcttgacggcgatgaagccgtgcgtggtgccgaggcgcttgcgctggtgttcaatcacctcataatgctccgggttgatctccggcacgaccatcggcacgtccggagtccaacggtgggcgctgttgttcgacacgaccggcgtttcggtcttcgcgtattcctcttcgatggtgcgaatctcagccttcggcatgttcactgcggagaacacgaaatcgacgtttttgaccacgtcttccacgtcggccacgttcttgacgaccatgttcttcacgaattccggcatcggcgtttccatcttccagcgaccgccgatggcctcttcgtaggtcttgccggcgctgtgcgcggatgcggcaagggtgaccaattcgaaccacggatggttttcgagcagcgtgacgaagcgctgtccgaccatgcccgtagctccgagaatgccgaccttaatcttttcggacataacaacctctcgcttatgctggaacggtttcgtatgatttcacgcttgaggtcgaccagccggccccaaacgacttcgtggacggccacatgcgttgtttaatcttacgaaatccgcggaacaagcatgttctcctatccgtatgctggtctgcgccaagtatgcgtttggcgattgttgtgtgtggcagaatgacgtgcactattggtatggctgcagtaacgagtaacaggacatcgcggttggcctgattgtctgtgctgatgcgtcgtctgcacaagtcccggtgtgcgggctgtgaggcttttcgcactttggacgtatcgctcgcgtacactggaagccatgtcgaaggcatcagaagaagcgcaaaagcagttggaccgtatcgtggcgttgggctatccggatgtggccgatatgtcggccgccgcgttccgtgctttggcacgcccgatcatccgtgcgctggaggattccgatttgggcacgcagattctgttggtgcctacgcgcgaactggtgtctcctgaatccctgattgcccgtacttccatcaaccgtatggcaggattcaccaccatgccgccgcgcgatatcgccagtttccttccgcaggatggtttcgaacctccggaaggcccgttctacctggtggtcgaaccgcataccggcacctgctacatcaatcgcgagcccgatgtagcgcgcaagttgatcgattccgacgagcgtttgccgcttacgttggaagagggacttgcgattgccacgcagcatccggagtggttgttggagaagaacggtttcaatttgttgggatcgcgttccgcggatggtcgcgtcccaagtatttggatgagccagaacgcgccacgattgggtgcggtatggccgaattcccgtcatacttggcttggcaacgcgttttgcgtgtctcgtcgcggcgtcagtttgttccactgacgttctgctgatatttcgcagattttccacagattttccgtattccacagattggcgattgtccgactgttgcgacggccacgccttgcgtcgccgcacctagcgcttgaatagtttggcgatggcgtggccggctgcggcgcacattaccgatccgatgcccagcagtgtggcggtgacctgcgggcggcgcaattcgttgcggatgccgatcagatcggtcacgcaatggtcttcgaagaacacgcgcaattcgttgctggagtagcgcccgatcaagtcgccccacgtgagcatgcgcgtcacgtagctgaccggattgttttcgcggaattcgaacagccggatgcctcgcagccgcgatttcggaccatagcattcaaagccgcaggtcggcgcgtagccaagatcaatgtcatgcacgtgcccgacgaacgcgttcttatggtcatgcccgcagaacagcgcgaaatagccgcccgcatcgcgcaatgcctgcacttcgccaacgttctcatccgcacagccgatcgcctcgccaagcctcgagccaggtctgcacacgtcacgattcaacacatagcaatgccctgcgaacgttcgcgcaccctccaccgcattcggcgtgtatgcgggcacctcgcgcaggcaatcgtagaactcctgcggcggaatatgctggaacgcgatcgccggaaccgccaaaccgtcgccattgcgctcgcccaactcgcgttgcacttgcttcagccattcgatcgcttccggcgaaggcgtgccatagccgtcggaatcggccaaatcccatccgcgcgaattcgacgcgtattttgcgtaggatgtcagcgattcccgttctcctgcagcattgccaacagtattgccggatttaccagtatccccagcatgctcgcgatcgccggaattactgcgatcgccgtcaaacgcattatccgcataatcgccggaattcaccatcatcacgctcatcgcaatgcgcccagacccgtcggaagcctcgatcggaatcgcaaacgtgcctggttcgagcgccaaaggagacgacccggcaacgggattcatgcaaccggaaaactctcggtagatgtcatcctgttcgtcggcgagaatgccgcactggaaatcgtggttgccgtaggttgcggcaaaggggattcgcgcttccaatgcaggtccaaggaatgctgcgaacgtgtctcgtactttctgccgcgtgctgtcgagtatggtcgcggcggtcgcgcgattgatggattgcgcccatgattcaagcttgttggcggatccgttgcgcccgtcgcgtttgttgcgtttcacgagtttcggcgagtcggtgccgatgccgtcaatcatccaattatcgtcggtcgggggctgtgcgcgcaacgctttggtgagcggatggcgtttgatgccgcggattttcgcttcgatttcggtgaccgctcgtatgtgcgtgcccggctgctctccgcgacggcgcaggaacgtgtcgatgtacgcggggtcgtatccgcgaatctggtcgccggtgaagacgatcagatcgggatgcgttttcttgatggcggcttcgatgagacggatcgtgtcttcgcgcacgtttggtccgtcctgaatatcggccatctgcagcacacggaaggtgccgtcgctgttgaatcgcaaggtcatgatgctcactgtaatgcggcaaatttggatatgaggtgaaaaagagacgaaaatcgtggtctgtccgtcatatggcggaatgccggcgatatatgggattggttgccgctactatgggcggcagtgcaggtaggtaacatgcacgtaacaatgtgggtcggcagaaggcctgcccagctttacagataaggaggagtgatgggtcaggatcaatcttcagtgtttgatctcgcggcagtggctgcagcgtccaacggagggaacaacgacccgctgctgcctccggcgcgttatattggagctccgcaaaagcccagcaagatgccgtacaacaagtacgtcgcatacgataagcaggtgccgtttgattacccggagcgtacgtggccgggcaagcgactgcagcgtgcaccgcgttggtgttccgtcgatcttcgtgacggcaaccaggccctcgtcaacccgatggattccgagcgcaagctgcgtttctggaatctgctggtgtcgttgggcttcaaggagatcgaggtcggcttcccgtcggcttccgaaaccgattacgatttcattcgtatgctgatcgagcgtgagctcattcctgacgatgtcacgatcgtggtgctgacgcaggctcgcgagcacctgattcgcaagacttacgagtgcctgaagggtgccaagcgcgccgtcgtgcacttctataactccgtgtccgtgctgcagcgtgaggtcgtgttccgcaaggataaagccggcatcaagaagctcgccaccgacgcggccaccctgtgcaaggagcttgagggcgaagcccagggcatcgacctgtattacgagtattctccggaatccttcaccggcaccgagccggagtacgccgttgaggtgtgcaatgcggtgatcgacgtcatcaagccgactccggagcatccgatgatcatcaatctgccggcaacggtggaaatgaccactccgaacgtgttcgccgatcaggtggaatacgtgtcgaacaatctggtgccgcgcgacgccgtggtgctgtcgctgcacccgcacaacgatgagggcatgggcgtggccgccaccgagctggccgtgcttgccggtgccgatcgtgtcgaaggctgcctgctgggcaacggcgagcgcaccggcaacgtcgatctggtcacgcttggtctgaacttcctcacgcagggcatcgatccgcagatcgattattccaacgttcctgagattcgcaagacggttgagtactgcaaccagctgaagatttccgagcgtcacccgtatgccggcaatttcgtgttcaccgccttctccggttctcaccaggatgccatcaagaagggtcttgaggctcgtcaggtggccgccgatcgtgccggtgccgatttggacagcttcgtgtggctggtgccgtacctgccgatcgatccgaaggatatcggccgcacgtacgaggccatcatccgcgtgaactcccagtccggcaagggcggcatggcctacctgctgaagaccaaccacaatcttgatctgccgaagcgtctgcaggtcgagttcgacaaggttgtgcaggcgtacgccgatgagaccaagaaggaagtcaaggacgaggatatttggcgtctgttcaaggacgagtatctgccggtcgaagagtccggcgctactgcggctggtgccgtggtcggcgacagcaaggacgactccctcgagcagtggggccgtctgaagctgctgaaggtgtcggtgtcgtccggtgaagatggttccgataccgtgctgaaggccaggattcttgaccgtggcgtgaacgtcggcgttgatgagccggtggagcgtgaggtttccggcatgggcaacggcccgcttgccgctttcctgaacgcgctgagcaacttcggcatcgaggcttccgtgatggattacgtggagcacaccatgtccgtcggcaccgacgccatggccgcctcctacgtggaatgccagatcggtgaggaagaggatccgcggatcgtgtggggcgtcggcattgacacgtccatcgtcaccagctcgttgaaggccattatttcggccatcaaccgttccgagcgctgatttccgcgggttttcggttctcgtagctgaagggcttgtgatgtacttgcgagtacgtcacaagccctttgctttttgatttcataggattcccgagtttccggattttccagtttttccggattattcggaaactcggaaattcaggattgcgatccccaaatgcagacattgttgccgattgcggagaatgtcatgaccggcttgccgtcgatctcgcgggggagtgttgcgaaccgtgcaatgtaggtcacgtcgtccaatcggatttccgcgtcgcttgcgcaacagttgaatccgttcacggcgccggaaagcggtttccacgatccgcaggtgatcggcccgtccgtcgacctcggcagattcgcgtcgggagtatcgaagaaacttacgatttcaccccgggtgatccgcccgtcctcatggaacgtatatcgcgtcggacgattgatgccaacgtacgtgccatcatcctcttgcttgccgttgaagaacgtatgctgatcatgcagtacaacgttgtaatcgcctgtgatatcggcaatgccggtcggcgcgacggcaacggaaccgcggtattcgtacggtgccgcaaccagccagccgtcggaagtcggcagtaattcgcgtacgtgagattcgtaatcttcatcatcgccctcgctaaagcgttccgcgaaacgggtgtggtagacgaggaacatgcgaccgtccttcgaccgacgaatggcggaattatgcccctgcgagacttcgacatcggcaagttctgccggaccgccatcccactgtacggaagacgtcaatcgaatgccggtgccgcgctcctgattgtcgggaatctcaccgtacgaaatcgcgggattgccgttctggtccacgtacgggccaagcagcgattttgaacggaacagacgaatctgatatccgccggtgcgcccaagccagccgtacgacatgaacagataccaccatccgttttcacgaatgaagtacgatccttcgccggaattccagtagcctccggccactttcacgccgtaataaggatcggaggaatccttgaccagcgggtatcgcacggaataatcgcgcaagccggtttccggatcgagcttgaacatccagatgccgccgaaccatgaaccgaaactcatccacatttcgccgtgctcgcacaatgcgggcgccgcgtcgatggcgttgatgcgcgtgtctttgagcgacaggtagcgggtcaggtcatagccgacggtgccatcggttttgggctcaagttccagcactttcggcacgtcggtgttccacaggttgctctcgtcgaaaccggaatataccaccggccccacgtacgtccagtcgccgtccacatggtcggcggtcaacagcacgatcaccgagcggaactggtcgccgttcaccgacaggtacatgcaccacttgcccatggtcttgttccagatcacgtcgggcgcccacgtgttgccgagcaggtcgggattggaatcctgtttcggccatgcctgccaaatatcgccgagcagcgcgtacgggtcgcggctcagattgttatcgaaccgctcccaatgcaccatatccgtgctgcgcgcgcaccgacgatgcgtgccgaacagatagtagacaccgttttcctcgacgattgcgggatcgtgcacggccacccgaccgttggcgagcgtgtgctcgatgccgttgggcgaggtggccggtgccgcagatagtggttctgcagacgattgcactgcagcattcacggttgttgcgccgttttcactcacttctgcgacccccaaatgcacagattgttcgtgcccagagcgctgaaggtcatgactgccttgcgatccttgtctcgcggaagcttgtcgaacgcgccggaatacgtgacttcgccctcgtcgccggtgagcttaagcgtcatctggttggcgccttccacggcctcccaagtgcccgtctggtcgccggtcacggtgccgtcttccttcagggtgatgttgatgggcttgttcacgccgcgatagacggtgctcgtcttatcggtgaccttcttcgggcccttgaaatagctggacttgtcgtgcgtcaccatctcgtaatcgccggcgatgtcggcggtcttgtagcccttcttgtcggccttggtgcccgtgtattcgtacggtgcggccaccagccatccgtcggcggtcggcagcagctcgtgcacgcgcacctcatgcttttcgccggaaccggagaaacgggtatggtacacgaggtaagcggtgccgtcgtcgtcaacgaacgcggaattgtggccctgggagacttcgatgttcgcgttgtcgttgccgctccactggatcgagctcatcaggcgctcgccgatgtcgctttgccagttgttgccgatggccttggtggaaatcgcggtgttgccggcttcgtcaacgtacgggccggtgatgtccttggagcggaacatgcggatctggtagccaccggtctgctgcagcgcgccgtaggaggcgaatagataccagtagccgttgtcgtgcagcaggtaggagccttcgccggagttgccgaagccgccgccgagcttcacgccatagtaggcgtcggacttgttcgcttcggtggggtaggtggagttgtagtcgcgcaggccggtcgccgagtcgagcttgaacatccacatgccgccgaaccaggagccgaaggtcatccacatgtcgccgttgtcatcggttttcacgcacgggtcgatggcgttgatgccggtgtcggtctgcgaggtgtaacgggtgatgtcggcatcctcgccaagcacctgcggcacgtcggtcttcttcacgttcacgcgttcgaagccggaatagaccaccgggccaacgtacgtccaatcgccttcgatgtcgtcggcggtgagcaacacgatcacagaacggtagttcgcgccgttgatcgacatgtacatgcaccacttgcccatggtctcgttccagatcacgtccggtgcccacatgttgcctttgacgtcaggattggaggactgcttcgcccagccgtcccaaatgtctttgaagatcttctcgtagtcggtgctcagattgttggtgaaggtgctccagttgatcagatcgtcgcttttgagccaagcgcgatgcgagccgaaaatatagtattttccgttggctttgacgatggagggatcatgcgattcgccgcgcttgatgctggcggtgctggtttcggctttcgacgatgcggacgattgcttcgtcgaattgccggagcatccggcgagcgttccgaccagcatggctgcggcgatgatgcctgccgcgatctgctttgctgttgtacggaatttcatttttccccttccttgcggatgacattgatttgtacaacgatgtaatttcttgtatagtgtacaacgttgtaaagaaaagtcgaatcataaggggtttctcgatgtcgagttcctacgaattgctgtgctacacgcgcgaagctaccggccgtgaaaaggcgaataatgaggacatcgcctatagcatgcaccttgcgttgcgtgccgatggggccgcccaatgggagccgctcaacgagaattacggtattttcttcgccgccggcgtgcctattcaggccgccaccgccgagtcgcgccgagcgtgcgtcgcggcggcgcatttcgtcgccgatccgttcgatgaggcgcatccggccaccgatgccgtcgcatatggcgcggtgatgccggggatcgacatcacgctgaaatccctgaagaacccgtatctgttccgccttgcggatggccgattagcgctcgccgccacccgtaccgcgcgcggcggcgagccggatggctccgagcgatcggcgttcctgttggccgtcagcgacgatctgacctccttcacgcagcttggactggtgatgctgcgtaccggcggtggcgtcaatcgtccgtctgtcgcattcgacgcggacgcctcccgttatgtgatttcctggacgtcgaacgacggcaaatcgtatgtcgcgaccgttgccgatattgtcgccgtggccgaatccggcgagccgatcgatattgcggaagctgtggtaacggcggaatcaagccgttcctgcgattgcaatattcccaatgccattcctggcaacgtgattgccgtcactgaagaagaagcgtcgaaactgatcgaacgattcggtcgtatttacaacgttgaaacatcggtggcgacgcagcatatcgacatggcggcaagcagggaagcgtcccgtgaagccgtgcaggcactcgccaaggtccgcgccgatctcgtctacagcgacggttctggtgccacccgtgccgtggattggaacaaagacgaacttgaggcgattgcgcaggacgccgccgaaggcaagttccagccgggcgacacgcgcacggtgagcggccgcatccgccaaaccgtatacccggtgccatttgccgtggagcgtgcggacccgtcggtgttcgcttggaatttcaacggcaagccgatgttcatgttcatcgccaccgacgataccgacggcaactgcgtcgatccgaacgatggcgccacgcatatgccgttgcgcatcgccgactccatcgaagcgctttccgacgcggcgggcggccgtgccaaggaaatcgatctgctcaaatgcggtgattacaacgctgaaggacgcgccatgaccggctgcttctgggcgccggaactgcatgtcatcgatggaaaactgtcggtgctcttcatgccatgcttcgatgggccggccaccaatccagacggcacgcccaacgaacgcgcaggcaagccggacatgtggacgggcagctgccatatcatgcagctcaagcaacattccgacggcacggatttcgatccgcgcgaacccgaaaactggacggtgccgaagccgattctcacaccgaccggcggcgtgctcaatcccatccaacgtatctcgctcgacatgaccgtcatcagcgattccggccgctggtattacgcgtggcagcaggtcggcagcatttggatcgccagcttcgatccggcctgtccggaacggcttacctgcgagccgaagcaggtcgttgtgccggaattcgcgtgggacaatatgatcgccgaaggtccgaacgccatcgtgcatgatggcacgatctacctgatttattccggctcgctggtcggcattgactacaccaccggtctggtcaccgctccggctgggcagaacgccgacctgaccgatccgaacgtgtggacgaagctcgactatccgctacagaaatccggagtatacaacgagcaatggcagctcggtaccggccatggcatgtggtccaacgacgaggacggcaatctcatctatgtatttcacaatgcggaatacgagaatggacggtatggcggccgcgacgcccaggtgcgccgcgtgcactggtccaaggagggtatgccgatactggacatgcaggcggcggaagagctcaatccggactatgctgatataacgatgaaaatcgtggtttccggcaataaaggctgattccgttggcttcagcgccgcaaggggcgaaagccggtgttggggccgaatgtatgagacgttttggtgaaaaggggttgacatgccgaagcagaatggcgccaacggcgagcacatggtgaccatgcgcgaggtcgcgaaggcggccggcgtatcgatcaaaacggtgtcgaatgtggtcaacgactacgagttcgtgtcgcaggccacgcgagacaaggtcaacaaggccatcgacgagctcggctacacgttgaacatgtccgcgcgcaatctgcgcagggggcagaccggcatcatcggcctcgccattcccgatctgcagatgccgtacttcgcgcagctttcgtcactggtcatcgaagaggccaagaagctgggcctgcgcgtgatcgtcgagccgacgcaatactcgcgcgaaggcgagatcgaggcgctgcacggctcccagcagacgatgatcgacggcctgatctacagtccattggaactcgatcaggatgatgtcgaccaattggacgtggactatccgctggtgcttgtcggcgaacgcatcttcaccgacaaggtggaccatatcgccacggaaaacgtggaaggtgccaagcgcgccacgtcgtatctgctgcagaccggttgcaagcgcgtggccgtggtcggcgtgcatccgggcgagaaggtcggctccgccgcgctgcgctatcagggctaccttgaggcgttggaagaggccggcgtcgaattcgacgagcgtttggtggtcgagtcgggcatgtggcatcgtagcgatggcgtgcgcgtgatgaacgcgctgcttgattccggcgtggttcccgacggcgtcgtcgcgctgaacgacatgctcgcctccggtgtgatgcatgcgatccagatgcacaatctgcgcattcccgaagatatttcggtgatcggtttcgataattccgacgattcgcagtatttgtctcctgcgttgacgtcgattgctcccggtcttgaggcggtggcgcgtctgtcggtgaaattgctgaaggatcgtatcgacggggtttcgccgtcgaaggatctcaagccggagcagaaggtgttccgcaaggtttcgtcgtcgttggtggtgcgtcagtccaccaagctgcctacgaattccttggtggtgtgatttttcttccttctttttcttcttcttttggaaggaaggaagtgattggtgcctcggcgcttgcgtccggttttttacggattgccggtgccgaggtttttgttttccctttctggcgattgtctgttgccgggtactgcgattcgattcttccgaggagtcggatgcgagaaacacgcggtgcgttcctccgatttgttacaacgttgtaatagtgatatattcaacgttgtaaattactggaacagcggattgaaaaggaatagacatggctgtttacaacaatccgatcgtgcttcagcgcgcagatccttgggtcctcaaagttgacggcgagtactacttcactggctccgacccggaatacaactgcatcgccattcgtcacgcatcgaacatcaacgacctgcagaaagcccccgaaacggtggtgtggcgcaagcatgagtccggaccggcgagcatctatatttgggcgccggaactgcaccgcatcaatggcgcttggtacatctacttcgcaggcgccgcaacggatttcgaggcctccggcctaccgacccaccgtatgtttgtgctggagaacaccgatgacgaccccaccaccgacaactgggtggagaagggccagatcgtcactccgatcgactccttcgcgctcgacgccaccaccgaggtgatcgacggcgtgcagtacctggtgtgggcccagaaagatcccgcgatcgaaggcaattccaacctgtacatcgccaagatggccaacccgtggacgctggaaagcgagcccgtcatgctctccaagccggaatatgactgggagtgcatcgacttcctcgtcaacgaaggcccggccttcctgttccacgagaacaagatctacatcacgtattccgcctccggcaccggtgtgccgtatgtcgtcggtctgctgaccgccgagcgcggcagcgacctgctgagcaaggattcctggaccaagagcccggtgccggtgttcaagacctgcgccgaaaacggccagtacggtcctggccacaactcgttcaccaagtccgaggacgattccgaagacctgatgatctaccattgccgcaactacacggaaatcaagggcgatccgctgttcgacccgaatcgtcatgcccgtgtcggcgtggtcaagtggacggagaacggccccgacttcggcgtgccggaacctgacaatctgtggactccggacacgacggatgtgttgccggccgacggcggcgctcttgcgggaacgccggtagcgaactgacttgcgtaatcgtaagaaacgttgcgattccaacaaaaacgaataattgaagattataaagaaaacagcttttccatcggcgtgtttccgatttgtacaacgatggaaaagctgtataatcaaaattacaacgttgcaaacggcagtgcagctgacgaagcgtgaacgacatcgcaaacaaggttgttgatgaatgtcactgcaacggttggaggaaatgtcttgggagaccaagaagaaaaggagaaatccatgaagatcaagaagagcaccaaggctctcgcggccgcggcgtccctggccatgatggccaccgtcggcctgtccgcctgcggtggcggcagcaacgacgtcgagacgaccgctgacggcaaggtcaagatcacgatgtggcacggcttctctgaggccgatggcaagaccctcgagtccatcgtcgacgacttcaacaagtcccaggacaagtacgagatcgacgcccagctgcagccgtggagcaccatcggcgagaccatggtgaccaaggtcacctccggcgacggcccggacttcgtgaccaccggcgccgacaacggccaaggctggtccatcgacggcaccttccagtgcgtcaccgatttctacgacgacaaggacaacggcaccgatgagtacatcgagaacgtcgttgaccagatcaccttcaacatcgacggttccgaagagaagtgcggcgtcccgatgggctacgccccgaccgccgtgtggtacaacaccgatatgtgggagtccgccggcctgactgacgccgactacccgcagacttgggatgagctgctcgaagttgctaagaagctcaccaagtccgatggctcccagtacggcatcgctctgccggatctcggctgggctccgttcctgaagggcaatggctccggcatctacaccaccgatggcaaggtctccatcaataccaaggagaataaggccttcctcgagaagatgcgtgacttctacaaaggcggctactccgtgtccggcatggatgagaccgctgctcgtgaatccttcgaatccggccagtccgcaatggtgatcgtcggaccgtgggaggatcaggcctccaccgacaagggcatcaaccacgacctgttcccggttccgaacggcgacggcacctatgtgtacccggacggcaccaagggctccaacaccggctccaccggtctgtactggtgggtcacctcccaggttggcgactccgctaagaagcagggcatctacgacttcttcaagttctataacaaccacgacaaccaggtgacctggtcccttggctccgcttacccgccgaacaacaccaccgtcaccgccgatgagctctccgagcgtccgctgatcgccaagatcggtgagaacaccagcaagtccttcatcggtattgcaggcctcaagggcggcttcggcgacatcgccgcctccgtcgacaccctgacctccaataccgcccgtaccgacgacgatatccagggtctgctggatgacgctgaatcccagatccagggctatctcgacgagtacgccgagtgatcgaagcgggattcacatacaatcaacataagtgagcgggcctgacccgctcaccaccccagcaaaaggccacggtgctggccctcacgccagcgacgtggtctttgctgtcttaaaaacacatccctggtggcattaaggaggagataatggcacaagcaactgccgccccaggatccgcgcattccgcagtggccaaggagaacaagaaggcgattcaggcccgcaacctgcgcaccggcctgctgttcaccgcaccggctctcatcgttctcgcaatcttcgttttctatccggcaatcaagacgttcatcacgtctctgacttccgaccgcatcaaccgcgccggcaagttcgtcggcttcgacaactacgtcaagctgttccaaagcgccgacttctggaccgacgtcaagaacaccctcgtctacgcagtggcctacgctccgatcgtcgtgatcgtcgcactcgcgttcgcactgctgctcaaccgcaaggacctcaagttcgtcggattcttccgtacctgcatgttcctgccgttcgtcatctccctgaccgtcgccgccatcgcatggcagttcatcctctccccgtcgctaggcctggttccgtactggatccagcagctgaccggcatcgcgcacgtcgatctgctcggcacccgcgaaaccgccatggcggccatcgtcttcatcaccgtgtggaaaaacttcggctacttcatggtcatcttcctcgcaggtctgcagggcatctccgccgaactgtatgaggccgcttccctcgacggcgcctccgcatggcagaagttccgttacatcacccttccggcgctgcgcccaactttcaactatgtggtcatcttcggcctcatcggttccttccaggtcttcgatcaggtcttcatcctgacctccggcggcccggcacgcgccaccgaaaccatcgtgtaccgcatctacaccgaggcattcggcaacggcaagctcggttacgcatccgcactgtcgtacgtgctgctgatcatgacgctcatcgtgggcctcatccagctgtacaccaacaacaagcatgagaaggaggaaatcgcatgagcaccgcgactctttccgcacaagagcgagagaatgcccgcatcaacgccgaaaacgagcgtcttcgcaagcaggcgacccgcaagcgtcgcatcggcctgggcttcagctacttcgcattgatcctcatcaccatcctgatgatcttcccgctgctgatcgtcgtgctggtgtcgttcaccccgaacgccatcacgcagacctggccgccgaagctcattccgagccagttcacccttgaaaactaccagtcgctgttcaaacgcctgccgatcggccgagaaatgctcaacaccgtcatcttcgccggtgccgtgaccatcatctccgtgttcttcgactccctggccgcctacggcctgtcccgtgtgaacttcaagggccgtggcctgctgctcggcgtgctgatcgccaccatgatgatcccgggcatggccctgctcatcccggtgtacaagctgctcgccaacatgggcctcatcaacagctactggggcatcatcatcccgcgtatggccgacgtcggcggcatcttcctgctgcgccagttcttcatctccattccgaaggacctcgacaacgcggcccgcatcgatggcgcaggcgaattccgcatcttcgcgcagatcatcctgccgaacgcggtgccggccatcctcaccgtgggcatgttcaacttcatgggcaactggaacgatctgctctggccgttgatcatgacttccaagccggagacccgcaccatcaccgcaggcctcgcaatgctgaccggccacggttcctccgtcaccccgtacggcgtggtgatggcaggcgccctgatctccgcactgccgctgctggtggtcttcttcttggtgcagaagcgcttcgtcgaaggcatcgccatgaccggcatgaagtaaagcccaacttcatcgcctgatcaaacaatccataattgaaaatccataattgaaccttgttttccttccttcgataaccgcaccgtttggtgcatagaacaaggccgtcggcgtggctcctccccacggtggcggccttgttctgtattctcgtaaaaaacgtttgtacacgtattcgatacacgtatgtagacgacgcaaaggagcgcgcatatgacttcgcatattctcgaacgggtccccctacagcaggtgaggctactgccaggagaacattttgacgcgcagcaggccggcgcgcggtacctgcttgatctcgacgtcgatcgcctgctatatcccttccgcagggaggcgggactgccgcagccgaccgatgccgacggcaatccggtaacgtcgtacccgaattgggaggaaacggggcttgacggccatatcgcagggcattatctgtcggcttgcgtcggattcgcgcaagtcgcagacgatccgcaaccgttcatcgaccgcgccgccaccgtggtgcggtcatggcatgaatgccagcagtcgtttgccggcgatgctgtgatgcgcgggtatgtgggtggtgtgcctgattctcgcaccgtgttcgggcgccttgccgtaggcgatgttgaatcgcagaatttctcgatgaacgacgcatgggtgcccatgtataacgttcacaaaacgttcgccggtttgttggatacatgggccgattttgcttctatcgatgaacagacttcgcagctggcacgtaccgtcgtgcttgatctggccgattggtggtgccgtatcgccgagccgctggacgacgagaccttcgacaggattctggtgagcgaattcggcggcatgtgcgaatcgttcgccgaactgtacgcgcgtaccggcgaggagcgctaccatgtgatggccgaccgcttcaaagaccacgccatcttcgacccgctggcgcaaggcgaggatgtgctcaccggcatgcacgccaacacgcagattcccaaagtgcttggatgggaacgtttgggcgcgatttgcaacgatgaacaggccgacgccgccactaacaccttctgggattccgtggtacatcaccgttccgtaagcatcggcgcgcattccgtgtccgagcatttccacccgacggacgatttttcatccatgatcgaatcgcgagaaggcccggaaacctgcaattcgtacaacatgtcgaaacttgcggaacgactgtggctgcgttccggcagcgccgactatatcaacttctacgagcgggtgctggaaaatcacctgctgtccaccatcaatccgaagcagccgggattcgtgtatttcacgccgatgcgatcgcagcattatcgtgcctattccacacctcaggaatgcttctggtgttgcgtcggttcgggattggagaatcacgcccgatatggacgattgatttacgcgctgcagcggccggctgcgcaggattcggctgattcggctgctgctggttttgccagttctgccgccgagacgggcaataccgtttcaaacaatgccgaggcggaagctacgcgcctgctggtcaatctgtacatcgattccaccttcgactgcccggggcagggtctgcgcatcacgcagcgcgccgctcgcattgaggatggcgtcgattacacggtgacgttcacattggaatccacggccgagcatgttcccgatactcccggtggtttgcgggaaaccacgctgtttctgcgccgtccgtggtgggcggagcattacggcgtcatggaggccacatgcgccgtctgcacgcttgatccggcacgcaccaacgatattcccgaaggatatctgccgttgcgtctgcgctggaacggcgttgcggaagtggtgatgcggttgcggccgcggatcaccgtcgagcgtatgccggacggttcgccttgggtcagtttcatgaaggggccgaaggtaatggcgctggcttcggatagcgacgatatggacggcgaattcgcggacgccggccgtatgagtcatattgccaccggtccgttgcgtccgctcgtatccatgccgatcatcaacggcaatccggtcaaggcgtgcgcgcaggtttccagaccgtacgtgcatggcctcaccgttgccgcgacggacgtttccggccgtaccatgctgttcgacatgcatgagttcagcagtatgcatggctgccggtattccgtgtatctgccggttgccgacgatggcaacgtgtgtgcgttgcgcgcgcaactggccgatatcgatgcgcgtcaggccgctagcgagcagaccgttgtcgacaccatcgcatgcggtcagcagcaatcggaagtcgatcatcggtattcgggcgataacgacatgatgggtgccgacggcacgttgcattggcgtcgcgcgttggctggtggcgaattccagtatgcgatgcgcgggcgtggtcaggcgcatcgtttggaaatcgaggtgattgccgattccgcggaaagcgacggtgaaaacgcggcgtatgaagtgacgctcgacggcctgccattgcagcgtggcgagcatcgtcgcatcgacggcgatcccacggcaatcgacgtgtatccgctgccggatgccatagaaactgcggaaaccgcggaaaatattgagaataccggagaaaacgacaatgctgacgacgctgcgatcgtacgcatctcggcttcggcgcatgacggcgcgaaaatcaccgccctacgattgcataagtaggattgcagcgatgaaaatcgcgatatggcagacgactgaccgtccgggggcgtctgccatggcgatccggtgattggaggatgctgatacgcattgtggcggcaacgatggtattcgttgccgccacaatgtttttgcggttgctttaccggttgccgttccggctggcgtcggttgccgtcaatgagtgggtgtcttgcctgccgccgacggtcgttgcgacggttattgggctccgtttgactggtcgtctccggagttgtcgccactgctgttgccgccgttgccgccgtctccggagctgtctccgccgttattgccgctgtctccgccgtctccgccgttattgccgctgtctccgccgtctccgccgtctccggagttgccgccgtctccgttaccgccgctgttctgatcgctgttttgcgtaggatcgggtgtggtctgctcggtgttctcttcggccttcggcatctcctgattctgccgtgtctcggtcttctgcgcgccggtgccccatgtgccgtccgggccgccgatcttgccgttgtcggtcggttcggtgaaggtcagcacctcctgattctgcaatgcgagcgacatgaactcctcgaacagatgcgacgggtagcccgtggaggaaacgccatagcctgcgaacgatggcacttcctgcgcgctgccgtcttccgcaggattccaaatggcccacacattgagcagctgcggcgtgtagcccacgaacgaagcggccttctcgtcgtttgcggtaccggacttaccggccacctgacgtccgagacgtgtcgaaacgccagccgcggtgccatacgtggtggtgccctgcatggccttctgcaccagatggcaatcgttcgcatcgaacacctgctggttctcctgagccgtcttgtacagctccttcgaaccgtcggacgtgagcaccgtgtcgacgatgtgcagcgtgttcttcacgccatcgttcgcgatggtggagtggccttgcgccagatcccacacggtaatgccgttgatgcccagaatgttgtaggtggtgtcttcggcgatgtcttcctcaatgcccgcctgatgcgcgatcttggcgagattcgcggcgccgaggtgcttgttgacctccatgaacaccgtgttcaccgaattcgcggtcgcctgatagaggttgatatacccgtaattggtgttcaacgcgttcggcacctgcgcggtggttcccggcgtcgtttcaaacgtcaggccggaattgccgttgaagatggtgttgaaattcacaccctcctgcgcggctcccagcaagccgaacggcttcatggtggaacccggttcgaacgtggcctgcgtggcgttgttgagctgcttggtgaggtaatcgttgcccgcatacatggctttcacggaaccggtcttctgatcgaccgcaataccgcccacctgaatactttccggcatgccctccggtcgggtgtcgccgacctgctgaatctcgtcctgcatgtccttgtcgagcgtggtgacgatcttgtagccgccggtttccagatcatcggcggtgaacgccttggaattgaccagttcgttcttcaccgtggtcagcagatacccgttcgcgccggccatctggttgctctgctgtatttccgccacggcagggaactgcgcttccttcttctcctgggcggtgatgtagccgtcttccttcatgatgctgagcacgcggtcatatcgcttttcggcctgttcctgattgacggccggatcccatgagctcggcgccggaatgataccggccaacatggcggcttccgacaaggtcagatcgctggcgttcttgttgaaatacgccttcgccgccgcctgaatgccatatgcgccacgaccaagataaatcgtgttcatgtaattgcatagcacctggctcttatcttgtgcctgcgcgatcttgatggccaggaacgcttccctcagcttgccggaatacgacgtggtttcgcccaaatagtagcgttccgcatactgttgggtgatggtcgaaccgccctgacggctgcctgtggtcagattcgtatacagcgctcgcgcgatgccatacagatcgatgcccttgttggtgtagaaggaacggtcttccgacgcgacgatggcattgcccacataatccggcaataccgcacagtcgatgatttcgcggttctgttccgcgtagctgccaatttccgtagtgccgtcggcatagtagacggtggttttttcggcgagggcgaacttttccggttcggggatttccgtggtgatatacatgtatgcgaacaggccgattcctgccgcgagcagcgctgcgaagatgccgagtgcccacttcagcacgagatgcttgcgcttgttctgctttttctgaggtccgttggcgcggtgcgatccgtggttctgcggcttgggcgcgctatgggatgcgttgctgcgattgctgccggcgccgccgctgcgggcgcttcttgagcgtgagcttacgcttcgtgtgtgtgaaaccataggttccaccgtagctgattgacttgagaaatcaggtgaaaatggggtgagtttgcccttgggagggcattttttgcgcagctcttttacaaatcgacagtttgtgggtcgttgtctcaatatcggcttattttcagggttttatcagtttttcaggtgccttttcgctgtttcgcaggtatgcttgaaatttggtacctgtgaaacgcatatatgcatatataacagaggagtcgtttacagatgagcattcgtgtagctatcgctggcgttggcaattgcgcttcttcgctggtgcagggcgttgaatactacaaagacacgaaggacgaggataagattcccggtctgatgcacaataatttcggcggatatcgcgtgcgtgacattgaattcgtcgccgcattcgatgtggacgcgctgaaggtcggcaaggatctgtctgaagccatcgaagcgtcgcagaacaacacgatcaaattcgccgacgtgccgaatctgggcgtcgaagtgctgcgcggcccgaccaacgatggtctgggtgaatactatcgccagatgatcgaagagtccgacgccgagccggtcgacgtggcccaggtgctgcgcgacaagaaggtcgatgtgctcgtttcctacctgccggtcggttccgagcaggccgacaaggcatacgcccaggccgccatggacgccggatgcgcgttcgtgaactgcctgccggtgttcatcgcatccgatccggaatgggctcagaagttccgtgacgccggtgtgccgatcgtcggcgacgatatcaagtcccaggtcggcgccaccatcacgcaccgcgtgctcgcccgtctgttcgaggatcgtggcgtgcgtctggaccgcacgtaccagctcaacgtgggcggcaacatggatttcatgaacatgctgcagcgctcgcgcctggaatccaagaagatttccaagacccgcgccgtcacttccgtggtgccgcacgatatggatccgcataacgtgcatatcggtccgtccgattacgtggcatggcttgacgaccgcaagttcgcgttcgtgcgtcttgaaggcactacgttcggcgatgtgccgctgagcttggaatacaagctgcaggtgtgggattccccgaattccgccggtattgtgattgacgccgtgcgtgccgccaagatcgcgctcgaccgtcatctggccggcccgattctggctccgagctcctatttcatgaagtcgccggccgtgcagcacgaggatggcgaggcccgccgcttggtggaggagttcatcaagggcgaggtcgaaggcagcgaagagcagcttgacgccgatgtcgccgccgccaaggcagctggcaaggatgtgtggcgcgcctgatttttagttcgcctgatatgaggaatccccaatctaccgtcggtggattggggatttttaattacgatttggaaacgatgcgtatcgtcacttcttgagaaggggttcgacctgttcctcgtacgcggtcaacgcggtgtcgatcacattgtgcatgtcgtagtacttgtacgtgcccagacggccgccgaacaccgtcttcggctcggccttcgcgagctcctcgtacctcgcgtacagcgccttgtcggcctccgtgttgatcggatagtacggctcgtcgccacgctcggcgaaacggctgtactcctcccataccacggtcctgtcgggattctgcgaggcggcgcgctccggattgaagttcttgaactcgatcgcgcgcgtgtacggcacgtcggcgtcggagaagttcatcaccgggcagccgaaatggtcgccctcgtcgtaacgcacctccttgaagtcgaccgtgcgccacttgagctcgcccagcgagtagtcgaagtagcggtccaccgggcccgtgtacaccaccggcacgccggccgcggccaaagccgccttgttgtacggctgggacccgtcgaagaagtcggtctccagggtcacatggatgcgcggatcgtcgatcatgcgctccatccacgcggtgtagccgtcggccggcaggccctcccacgtgtccttgaaatagcggttgtcgtagttgaagcgcaccggcaggcggttgatgatgcccgctggcaggtccttcggatcggtctgccactgcttgcccgtgtagttcttgatgaacgcctcgtacagggggcggccgatcagcgaaatgcccttgtcgttgaggttctggggatccttgcccgccagctcgccggcctgctcggccacgagcgccttggcttcggcgggcgtgtagtgcgcgcggaagaactggttgatggtgcccaggttgatcggcagggggtagacctcgccgtcgtgcgtggcgtacacgcggtgcacgtagttcgtgaacgaggtgaacctgttcacgtagtcccacacgcgcttgttggacgtgtggaacaggtgggcgccgtacttgtggatctccgcgccggtctcctcgtccatgtagctgtacgcgttgccgccgatgtggtcgcgcacgtcgatgatctccacgcgcacgccgagcctctccacggcctgctgggccacggtcaggccgaacaggcccgcgcccacgaccaccagatcgggatattccaccgcttcagtcataagaacaaccttccgaacttaaaacaaacacacaatattcgtgtgcgattcctcatcaagcatacccgtccgccctccttaacgcgggatgctcttggggaagcggcattttgacgtttgatttccctgtgtcgctggtcgtggggctggctgctccacggatcatggcatggtctgtgtggttcgtgcgcggcctgtggcgcgggttgcgctgcggttcgtgcggcttgcggcgcggttcggtccgggcatggtgtacactggtctttgcctccgcgtggcggtacgtcacccaactcccccagggcaggaatgcagcaagggtaagtggcctcttccgggtgcgtggaggttttcttatatcttcatgccattcgcgcataccgtagagccaatgccgtattctcgatgattatgaccgacgaattcaagccaatcatccgagacccgcacaagtccgcgaatatgctggaacagccggtcgcgcccgttcccgtgccgcagccgccgtctgatccgatcgaacaggtgctttccccccgtgaagtgagcgaagggcttgccaaagccgatccgctgacccgtcatccgcgcgtgtcgagcattatgctcagcgtggtgttcggtctgctgctgcttgccgccgcggtgggcgtctggtggttgggcgtgcgcacgatggaaggccaaagctatgaagacatggtctggtcgaaattcgatgcggccctgccgggatggctggaaccggtcgtgcatgttttcaccatttccaccgttgtaatcgcaacaagcgcgattatgtcgataatcgccctcgcagtacttatcgtaagaaaacgatggctgttgattgctcaactggcggtattcggcggaatctgctttgccgcagcagagttgctgaagccgctgctgccacgtccgtacttaatcaatctggaatcaaatcccaataattccgcgccttccgggcatgtcatactcgccgccgcggcaggaatgatcctactatgcgccgtgcctcgcgtatgccgtgcgctcgttgccgtgatcggctggctgtatgcggtactcgtcggattgtcggtgattgcgggacagtggcaccggccgaccgacgtgatcatggcgttgctgatcgtcggcggagtggcaatgatcacgcttgccgcgacgtttgcgaacggcatggatgagcccggttcgcgtgcgtcgtcgccttccgtgcagatcgtcggcagcgtgctgttgacgttcggcgtgctcggcaccctgtatggcgcatacattatttggcagattcagccgggacttgcgatgagtgcggaatggacgaattctggtgcgcacctttccacggtgattctgacggcttccgttgcgtcgttggtgttcgggctggtgttgaccatgcgtcagctgaccgcctcgccattgacgaaacttgggcttgtcggcgcacctccggcccctccgaaacgctgacggcaaaacgtacgatcacgccgaaaatttccggcaccggtcgctcgcgccacacggacggtttgccaactgcatacggtcagtgagtattattgcgttgcaaacgctagtaataaggagtggctatggctaccggcagcaagctcgtgattgtggagtctcccaccaaggccaagaaaatcggtgggtatttgggctccgaatatacggtgatggcctcggtcggccatattcgagatcttgcgcagccgagccaggtgccggccgccgacaaaaccaaattcggcaagttcggcgttgacgtggaagacggattcaagccgtactacatcgtcgatggcaacaagaagaaaaccgtgtccgagctgaaaagcgcgttgaaaaaagccgacaccctgtacctcgcaaccgatgaggatcgcgagggagaggccatcgcctggcatctggtacagacgctcaagccgaaagtgccggttaagcgcatggtgttccacgaaatcacgaaggaagccatcaaagcgtcgcttgacaatactcgcgacgttgacgacgacatggtcgacgcccaggaaacccgccgtattctggaccgcctgtatggctatgagctttctccggtgctgtggcgcaaggttgggccgggtctttccgcgggccgtgtgcagtccgtcgccacgcgtttgatcgtggagcgcgagcgcgagcgtatggcgttcgtgcgtgccccgtattgggatgtcaccgcaacgttggaggcgccggatgccgatggcaataatgttgcgttcgagtctcgtatggtgtcgttgggtggccgtcgtttggctggttccaaggatttcggcgccgatggcaagctgactgcggccggtgcgaaggatcaggtcgtgcagttggacgaggcgcaggcttccgcgattgcgcaggcattggaatttgcaacgtttactgtcgcgtcgatggaaaccaagccgtaccgtcgccgtccggttccaccgtttaccacgtccaccttgcagcagaccgccggcaatcgtctcggcatgagctcgcgtcagaccatgcgtgctgcgcaaggattgtacgaaaacggctatatcacctacatgcgtaccgattcggtgacgctgtcgcaagaggcgatcgcagccgcacgcgaagcggtcgtcaagcatttcggcgaaaactatctgtcggacgcgccgaaacaatatgccacaaagacggcaggcgcgcaggaagcccacgaatgcatcaggccggcgggcgcgaaattccgtgaccctgcggaaatcgcaagcaaagtgccggccgaccagctcaaactgtacacgctgatctggcagcgcacgcttgcctgccagatggcagacgcaaccggttccacggcgaccgtgcgactgtccgcgtcgaccgaatcgaatggggaagccatgttccaggcttccggcaccgttatcgagttccccggctttatgaaggcgaccggtgagggccgccgagcgttcgccgaatcgaagaagggtgatgttgctggaagcgttgaacaggccgcgcaatccggcaaatccagcaaagcggataagaagtcggatgacaatgtgtcgctgccgccgatgaatccgggcgatgcgctcgctgcggtggcggttggtgccgacggacacgaaactcagcctccggcgcgttacactgaagcgtcgcttgtgaaaacgttggaacagaaggaaatcggccgcccgtccacgtatgcgagcattatttccacgattatcgatcgcgggtacgtgtatgagcgcggtcgtgcgttgattccgtcgtggctcgcgttctccgtggtcaaattgctggaaacaaagttcccgcggtatgtggattatgagttcactgccgatatggaaagcggtcttgaccagatcgcgagcggtcaggagaccggcaggaattggctgacccgcttctatttcggttccggtgagggtgccgcgcagtctgcagacgaggcacatgccggcttgcagcagcaggtcgcgcagttgggtgaaatcgacgctcgcgagatcaatacgatcgagatcggcgacggtttgcatgtgcgcgtcggtcgatatggcccgtatttggaggatatgaaccatctggatgatgagggcaatccgaagcgtgcctcgctgccggatacgctcgctccggatgagctgacggtggaagtcggtcatgatttgatcgagaaccattccggcggtccgcgcgctcttggcgtcgatccggtttccggaggcaccgttgaagtgcgtaatggtcgtttcgggccgtatgttgcgctggtgatgccttcttcggatgctggtgctgacggtgacgtggctggtggtggcaagtcgaagaagggcaagagcgctaagaaggctgccgatcgcccgaagatggcgtcgttgttcaagacgatgagtccggaatcgttgacgttggatgatgcgttgcgtctgctgagcttgccgcgtgaaatcggttcgtatgaagaggtggatgcgcagaccggtgaagtgcagacggttaccgtgcaggccaataatggtcgttacggtccgtatttgacgaagaccggtgccgatggcaagtcggatacgcgttcgcttgcttcggaagatgagattttcacggttgatgtggataaggcgaaggaactgttcgcccagccgaagtatggccgtgggcgtggccgtggcgctgcgaagccgccgctgcgcgaattgggcgtcgatccggaaacgcagaagcaggtgaccatcaaggaaggcttctacggcgcgtatatcaccgatggtgagacgaatcgtacgttgccgaagcagtatgctcctgagtcgatcgaaccggccgaggcgttccgtttgctggctgagaagcgtgcgcagggcccgtcgaaaaggcgtggacgtaagaccgccgccggcaagggcggggctaagaaggctggtgctgccaaggcttctaagacttccaaggcggcttccgtcgataaggctcgtgccgatcgccgtgccaaggtgcgcgagttggccgataagggttgggccaacacccgtatcgccaaggagatcggttccacgccgaccacggtgaaggccgatgtggaatggcttgccgccaacgaaggctacacccgtcccgccgtagttcccgcccggtgatgaacagtccggtggactgttcgtagcagtgagcagcggtagcgttgcgaacgccgcaatgtagagtgatgaatatgcaaggcatattcatctcctttgaaggtgtagacggcgtcggcaaaaccacgcaggttgaacggttgcgtgcgtacgttgaggcgcaggggcgcgaatgcgtggtcacgcgcgagccaggcggtactgtgcttggcgtggcgattcgcgagttgctgcttggcggcgtggaaggttccgatgcggatatcgctccgcgtgcggaggcgctgctgttcgccgctgaccgtgcccagcatgttgccgaggtgattcgccctgcactggaacgcggtgccgtggtaattaccgatcggtaccttgattcttctcttgcataccaggctggcggccgcgaattgacggcaggtgaaatccgcgacttaagtatgtgggcaacgtgtgagctattgccgaatcgcacgtatctgctggatcttgaccctgtgcaatcgcatgcacgactgcagcatgatgaagatcgcatggagtctgcaggaaacgatttccaacgtcgtacacgacaggcgtttcttgacttggcaaaggcggaatcgcaacgcttccgcgtgattgatgccagccaatccatcgatgaagtatgggcgcatattcagaacgattttgcgcaaatcagtcaaatgaaaactttccaatcggaggccgcccagtgagcgtgtgggattcgattgtcggccagcagcaggttgtcgaacaactcaaagccatcgcaagtggcgatccgaaagccattgcgcaatcctggctgatttgcggtcctccgggatcgggtcgttccaatgtggcgcgcgcgttcgcggcggcgttggagagccccgatcatggtcttggcgacgagccgaccaaagccgcgcagcaggtgcttgccggcactcaccccgacgtgaccgtgctggccaccaacaaagtgaccatcggcatcgacgaggtgcgaaacatcatcactacgtccgagcagatgccaagcactgcgccgtggcgcatcatcattatcgaagatgtcgatcgcatgctggaacgcaccaccaacgtgttgctcaaggagattgaggagccgagtgagcatacgatttggctcttgtgtgcgccgagtgcgcaggacgtgttgccgacgattcgctcgcgcactcgcatcgtcaatcttgccgtgccctccacgcaggcggtggctgcatttctggagcaaaatggcggattcgagccgaaaatcgcggtgcgtgccgcacgtcttgcggaagggcatatcggcatcgcgcgcttgtatgcgaagaatgagcaggtgatgtctgaccgcgacgagctgattgtgggcgtgcttggattgcgtcgcgcgtcggatgcggtgctgcttgccggcaatcttatcgacaatgcgaaggcgcaggccgaagcggaggtgaaggtcaaagcggcagaggcggaagctgattttcgcagagtcaatgggcttggggcgaaggatcgtattcctccgaagctgcgtggcgcatacaatgcgattgccaaaaaagacgagctgaagcgacagaccacgcgccttacgcgtgacgtgctcgaccgtgcgttgaactcgattgccagtatttaccgtgatgtggctgtgttgcagaacaatgccgaagattcggttggcttgattaatttggagaatcgttcgtcgatcaccgatctgtcggtgcggcttacgcgtgggggagcggtgcggcggctggaggatattgccgttgcgcgtcgccgtctggccggcaatggcaatcctgtgctggtctttgaagctctcttttgctccctcatcgccagctgaggtttcgcttgtttgcctgattggctgtttttcaccgattttgcttgtgttgctgagtttggattgtgcaacacgccgatatgacgttataacgatatgacgttatgatgtatttatcagttgggcagatggccacggcggctttccaaacaacgtaacgctatgcatcgcaaatcagcgcaagcaaggaggcagagtgctaggacagtttttcgcatcggacgcggtgatgtacgccgatgaggtttcgggatggcgtgaggcggtcgataccgtcactgcaccgctggtggaacacggtgccatcaagccgagctatgtggatgccatcaaagagtccattgcagctcctggcggcacctacattgaccttggttggggcatcgctttagcacatgcccgcccggaagccggcgtggtttccacctcgttgtcggtgctgcatgtcggcaagccattcctactggccgatgatgagaagcaccccatcaccaccatgttctgccttggcgcagtcgattccaatgcgcacatcgaaatgatgcaggcgctggcaggactgctcaccgatgaacagcagcgtaccgcgctcgaacatgcgaccaccgtcgaacagctgcgtgcagtgcttgactgatcgacaatatccgatcgacgatcatcaatcgcatatacaaactccttgaataccaacaaacaacacaacaaccaacgcgattattcgccacaaagaaaggtgaacaccaatgaagatctatactgcatgcagcactggcctcggctccagcttcatgactcagctcaacatcgaaaaggctctcggcgagctcggcgttgaaggcgtggaaaccgaccacaccgatatcgcatccgtgaccgaaaacacttgcgatgtgctcttcgtggggcgtgatatcgccgaagccgctgaaggcaagggtgatgtggttgtgctcaacagccttatcgatatggacgaaatcaagacgaaggttgctgacgcgctcgaacgtcacggtgttgcagttccgaacaagtaaaacaaatatttcggatttcacttcgcttattccataagtttttggagcgacagcacataataatttgaccttttcaaaatcatagtaatcaccgcgatttttggtcgtataagtgccgctgtgggcgaagcttacctaaaattcattacgaaaaataagagaaatatagagaaaataataaggagagagtcgtgaacggaattctttcgcttctgctcgatatcttccgtcagccgtcggtgatcgtcgcgctgatttcgttgatcggcctggctgtgcagcacaagaagggcaccgacattatgaagggtacgattcgtactcttgtcggcttcctggttctggctgccggcgctagtgttgtgtccggcgcattggtcccattcggcgatatgttccagcacgcttttcacgtgcagggcgtggtgccgaacaatgaggccatcgttggtaccgtgctcgtcaagtacggttctgaagccgcgctgatcttcttcttcggcatgatcgtcaatgtgctgctgtcgatgacttcgcgcttcaagtacatttatctgtccggccatgtggcgttctatatggcgaccatggttgctgtgattttcgaggttgccggcttcccgacttggggtgtgctgctgtggggatccatcgcacagggcttgatcgttaccatttcgccggctctcgtgcagccattcatgaaggacgctaccggcactgatggcgtagctttgggacacactggcggcgctggtatcgcactgggcggttttgtggcacgtctgactcgttccaagaagaacccgtccaaatccaccgaagacatcaagttcccggcaggtctcggcttcctgcgtgacaccactgttcttatcgcgctctccatggctgttatctacgtgatcgtggctttgttcgccggtgccggttacatcgaagaaaacctgagtgacggccagaacttccttgtcttctccgtgctgcaggcagccaccttctccgctggcgtgttcatcattctcgccggtgtacgtgtggtgcttggcgagatcgtgccggcattcaagggcatttccgagaagctcgtgaagaacgcagtcccggctcttgatgtgccgatgaccttcacgttcgctccgaacgcagtgcttattggcttcatctccagctttgtcggcggcctgatcggcatgggcatcatgatcctggctggaaccaccatcattattccgggtattgtggcccacttcatgaccggcggcgccaccggcgtgattggtaacggacagggcggtcgccgcggtgccatcatcggctccttcgtgaacggcttggccatcaccttcctgccgctgttcctgctgccggtgctcggcgatatgggcttggtgaactccacctattccgatgccgacttcggtgtggctggcattttgcttggctgcaccaatcagttgggtggtcagactgctctggttgccggcgtgctcattgcagtggcggtgttctacctggcatccttcctgctgacccgtcgcgacaaggcgaagcaggctgcgcaggtcgaagcctgacatacgaatagcctgtaaatgatacgcggatgatatcgggaagttggtgcgaattgctgactttccgatcatctgctatccacgggcgagtatattcagaacaagcacaatacgtaaggggttgatgattcatggcagcgggcgtgccgaaatatattacggttcgtgagaacctgcggcagcgcattatctcgatggatccgggggagaagctgcctgcggaaccggaactgtgcaagcagtacaacgtcagccgcatcaccttgcgtcatgcgattgacgatttgattcaagatgatctcatcgtgcgtgagcagggtaagggtacgttccgtacgggagccgacgccaatactgagcgtgaggtgatcagcgaccatattcgcggtttcttccgtcaacaggaggatttgggcaatgtggtgcgcaccaaggtgctgagcaatactacggtggttgattccgaggctgccaagaatttgggagtcgacaagaatgagccgttggtcaggcttgaacgactgcgttatgtgggtaatacgctcaaacagcatgtggtaacgtttctttccgcatcgcgtttctccaaagtgctggaacacgacttctcggaaggctcgctgtatgagtttcttgagcggcagtatgcagtgcatatggtggaaaacgaagtggtggtgcgtatccagaatgccgatgctgatatggctgaagtattcgaggtgccggaaggtgcgccattgctggctatggattctgtagtggtcgatgaattcggcgctatcattgcgttcggtgtggcattgcacacgcaggaacaaggtgagatcaagttcatcattcgcagtcagaaagacgtcggtccggtacagaactaatcacacgattccgatttcctgtcgcacgattttggtttacagacgaaaaatggaatggtgagaggtcagtaggatcggcaaggcgagttcgtggggctgtcaaggcgaaatgtgcggcaaaattgcaaaaattgcgattcagcgctggtagttggtggattcgcgcacgatcagttgcggtgcaagtgatatatgtgcggggctgtcgggaccgtcgttgagtaggcgtagcgcttcggagacgatttgtttgaacggcgggcgcacactggtcagtggcggcatggtggtgcgtgcgattggcgaatcgttgtagccaaccaccagcacatcttcaggcacgcgaagcccaagcgaatgcaacgccaccatcacgccgaacgcgatcgcatcgtcggcgcacaccacggcctccggttgcacgagcggctcggaaaacagtcgcatggcgcagttgaatccgcgctgcacgctacggtctccgaacttgttccattcggtttcggtggcaagatggtgcgctcgcatctgagtgtggaacatggtgaatagttccgccgattcgaaggagatttccttgccggccatgtatgccacggatgcgatgccacgttcagccaaatgcccgatcacgatttccatggctgcgttttcgtcgacgctcaccatggatgtgcggaacgagcattgacggccgcccacctgcacgatcggcagtgtggaggcgtaatgttcaagctctgcggaaaggtaggcctcccaggcgggcagcacgatcagaccgtcaacatggcggtctaccaacgactcgatgcgttgaatctgcgtggcctgatcaccgccgatgcccagcagcagttgctgcgaatccacgtcgatgacgggttcgatttcgtcaagcagctgcgcacagaacgggtcgttggcggtcggaatcaccaggccgatggtgttggtgacggtgctgcgcaacgcgctcgccgcataattgaccgaatagttgaggtgtgccgcggccgctcgcacgcggcgtgcgatgtcgtcgtctttggtgcgtttgccggaaagaacgcgggagacggtggcgatggagacgttggctagcgctgcgacgttcgtgatcgaactgttcgccgaagttgccgaagccgaagcgttgtcggttgtacgtgccatgctctcctcaccacaaatattcgaaatgctcgaaaaaactcgattattcgaattactgccgtatctcaatcgcgtattcaagaataaaacggccacccgtcgaaagcggcaggtggctggaagcaagtatctcaatcatgcatgttgcattgcgatttcataattgcgatgcaataactgaagattgttgaatatcttgcgaaatcctgaaatcttcagcaaaaggaagatcactcggcgttgacaaggatgttcagcaggttgtctgccacggtttcgtcatcggcgccctgcacgtcgatgaccacggaatcgccctgcttgatgcccaggcccatgacggacaggatggagttagccggaaccgggttgccgccttccttggcgatggtgacggtgcagccggaggcggtgacggcctgggtgaactgtgctgccggacgggcgtggatgccgacgggatcgttgatgacggtggtgcgggttgccatgatggacactcctttgagtcgtgtgttgactgatttttggttgtgttatttgaaagtcgtgctgcttgccgagcgaaatgcctcggtgcgccgctaataattactatagcacctttttccacgaaacgcagaaaacgtttaccggttgtgtgttgcggcttaaagtgtgtatactgtgcgcaggctgaaaatgatttaccggcaaagacggtgggaatcatgcagtaactcgacgcgcaaagcaagcgcggaaatcacaacaacaaacgttcggttcgcgttcccctcgcgggcaaacaacgaaacaaggaaacaggtcaaaggagttcacatgattatcaaaggtgttggcattggtcgcggtgttgcagtcggcccggtcatccgtatggcgcagccactgccggaaccgtcggacgctccgcgtgcggaaggcattgctgccgaaagcgaaatcgcccgcgttgaaaagtccctcgcactggtgaacgccgacctgaaccgtcgtgctgaagaggccgccaatggtgacgaaggtgccaagcaggctgctccgattctgcaggccgtcgccatgttcgcttccgatccgtcgctggctgaatccatcaagggtctgattcagcagggtaagaccgccgaacgtgcggtgctcgaaggcttcgccgcagtggaagacatgttccgtgccatcggtggctatcaggctgagcgtgccgccgatctgcacgatgtcggacagcgcgtgatcgccgaccttatggacgctcccgctccgggcttgccgcagagcgaaaccccgttcgtgctcgtcgccgaagatctttcccccgctgataccgcggcgctcgacatgagcaagactctcgccatcgtcacctcgcagggcggcccgacctcgcacaccgctattctggcgcgcgctcgtggcattgtggcggttgtttccgcagccgaagccgaaaacctgaccgacggcactaccgtggtcgtgaacgcggccaagggcgaactcgtcgttgacccgaccgaagaggagatcgccgttgccgaagccgccaagtcccgcgcggccgcagccaaggaactgcgcggcaatccaggctccaccaaggatggtcatctgattccgctgctcgccaacgtgggcaagccggccgatgcagccaaggcgctggaatatggcgctgaaggcgttggcctgttccgtaccgaattcctgttcatcggcaactccgagccgccgaccgtcgaagagcagacccgcgcttacaccgagctgctgagccagttcccaggcaagaaggtcgtgatccgtatgctcgacgccggcgctgacaagccgctgccgttcctcactccggaagacgagccgaatccggccctcggcctgcgcggcctgcgcaccctgcgcgcccacatggacgtgctcgaaggccagctcaaggcgctcgccgcagccgatgccgccaccgatgcgaacctgtgggttatggctccgatggttgccgaccagcatgaggctgactatttcgtgaagcttggcaagagcttcggtctgaagttcgtgggtgcgatggccgaagtgccgtcgattgcgcttatggctgacaaggtggccgacgtggccgacttcgtgtcgatcggcaccaacgatctgacccagtacacgctggccgccgaccgtacgctcggttccgttgccaactatcagaccgcctggcatccggcggtgctgcgtgccatcaagatgatctgcgacgcgggcaacgccaagggcatgccggtgggcgtgtgcggcgaggccgctgccgatccggacttggctgtagtgctggccggtcttggcgtgaactccctgtccatgactccggtggcactcgacgacgtgcgtgcctcccttgccgaagtcaccttcgaagaggctcaggcccgtgccgaagccgccctcaacggcgacttctaccacccggccaactgagccgtactagctgtgcctatcgcctgtaacgccttgtttttcaagcgatgtgaggtctgataggccctgtttcccggaccgacccctgcccgcgtgccccacaggctcgccgcaggggtcgtttcgttatgtttcgttatgccgtcaattgaaaccttgtatgagtcagacgcttgagggatactgggtgcatgaagatttccgcagatttcaccgtcattcccgacgcgtttgccaaggcggcgccgcctgagaactgcatcgacggtacgccgattgtttccttccccttctacattgatgcgcttgatcctgcagtgcagttcctgcattgggaattcgttgatccggattcaattccggtatgcggtttccagtggaatcattggtccctcgcgaacctgcccgtggatgcgctgatgtacgatttcaacgattctcacgcgctcgcgattccggctgatttctcgcgcacggtttccgcgatgattcctgaaacggttcagggacgcacatccgccgcctcgccgttgctgcagggccgcagcagtgatcccgcagtgacgatgcgttacaacggtccatatccgccagatcaggatcatgactactatctgcatgtgtggggtaccacggctccgctcgccggcctcaatcagggattctggctcaacgaaatggaacgtgcgctgcgtacttccggtacaatcgttgatcagggcgctattttcctcactggaaaagcctgatttgtgaaagaggatctcaagtaaggccagaaatttgatttccgcagcaatataacgatataaagatgcggaaatcagaaatatatccgacgaaaacgtattaacaataatcgaaaggattgctgaataattatggcgtgtaccacgattttggttggcaaagacgcaagttatgacggatcgaccatcatcgcccgtaatgaagatagtgcaaatggtgaattttgcccgaagcgcttcatcgtagtcaagcctgaagatcagccgcgcaagtacaagagcgtgctttcgcatgttgaaatcgaccttcctgacaatccgctgcagtatacggctgtgccgaatgccgatctgaaagaaggcatttggggcgaagctggtgtgaatgaagcgaacgttgccatgagtgccaccgaaacgctcaccaccaacgagcgtgtgcttggcgccgatccgttcgtggaactcaagcctgccaagggcaaggaaggcgaagaaggctttgaaccggaagtcgccggtggtattggcgaagaggatttcctcacactcgtgcttccgtacgtcaccaccgcccgcgagggtgtggaacgtttgggtgcgctgcttgaggaatttggcacctatgagatgaacggcgttgctttctccgacgttgacgagatttggtggctggaaaccgttggcggccatcattggatcgccaagcgtgtgccggacgaagcgtatgtgaccatgccgaatcagttgggcattgacgaatttgatcttgaagatgcgtttggcgagcaggaggaccacatgtgttccgccgatctggccgagttcatcgaacgcaaccatcttgacctgtcggtggagagcactacgccgttcaacccgcgtgacgcgtttggctctcactccgattccgatcacgtgtacaacactcctcgtgcttggtacatgcagcgtttcctcaacccgtacgacgagcagtgggatggtcaggatgccgaccacaagccggtttccgacgatattccgtgggctcgccaaccagaacgcaaaatcaccatcgaagatgtgaagtatgtgctgagctcccactatcagggcaccccgtacgatccgtatggaaagcttggcgaccagcgcacccgccatatgttccgcccgatcggcatcaaccgtcagagccagcttgcggtaatgcagatccgcccgtaccgcccgcaggtgagccgcgcgatccagtggatcgcctacggttccaacccgttcaacacactcgtgccgttcttcccgaacgtcaactccacgccgaagtatttggaagacaccaccacgcgcgtcacatccgaaaacttctattgggagaaccgcattatcgcggccctgtgcgattccagcttcgccgacaccgccaacgctgtggaacgctatcaggagaagaccggcgcgatgggccaccgcatggttgccactaccgacgagcagattgaacgcttggtgggtgacgttaccgacgaattcgatgcggaagacgaaatcggcgatgtgcagccgatggaaccggatgaaatcatcgaagccgtgcgcaacgacgacgcccgcgaaatccttgccgcagccaacgaaaacatggccgcgcaactcaaggaggaaaccgacaagcttcttgattccgtgctgtacaccgccagcatgaacatgaagaacggcttccacatgtcggacttctaatatctcactattcggctcctgtgaccacgttgcgggagccgatttttccccgcaatacaacgtcgctaaaatgacgtcattccaaatcgaagaaaggaaaaccccagtgaccagcattgaggatttcaccagccagtacggcttggtgcagaagattgatgcgtttggctatctcgattatttgaagaatgatccggatgctccacgcaagcatggcaaggtcgtgctcgtcaccgccgataccccgctgaaggcgtctcgcggcgagggcaagaccaccactacgatcgcgttgatcgatgcgctgcgtgagcgtggcatcgatgcggccgctgtgctgcgtcagccgagcatgggcattaccgctgccggttccaagggtggtgcttcgggtggcggcaaggcttccctgactcaccctgagctgatcgactggggtctgtgcggcgaaatgggtgctatcgaagcggctcagaacctgttggtctcctttgcagagaaggctgttgatgacggcaagctggacaccattctcgtgccgcgcgtctccgaagtgccgtcccgttccctgcgccagatcgcagtggaccgtggcaagggcgatgtggctgagcgcgtggtgctcactccgacctgcgagcttatgcagatcgttgtgctgtcgcgttccatggatgagatttccgagcgcgttgccaagatggtcgccggcacgaaggatggaaaggccgtgaccttcggtgaattcgttgatctgtggcgtatcaccggcatcctcggcgacgccgtgaagccagccaagacagagaccgtgaacggctctccggtgtacgtgcacggcggcccgttcgccaacgtgtccatcggcattccgacgctggtctccgtggaaatggcgtgcgctctgcacgacgtggtgattgttgaggctggttatggtactgatgcgggcgctcagaagtggcttgacattgcttgccgcgagtatggcgcacagtggccgtccgcagccatcgtcgtgacccgcgcttccacgtggcgcgacgatccggatctggcatggcgctacccgttccacgtccagcgcctcgaaggtcttgatattcctaccttcccgcttatcaacctgtggaatggcgaggatgatcagattccggcgctcaaggacaccgccaaggaactggaattccgcgacccgatcatcggcaacctgtaccgcgacggtggcgacgcgctcgccccgcagctcgatgcgttcgtcgatgccgtgacgaacggttccatgccggccgaaccgcacagtcacaagggcatggctctggtggagaacgtgcgttgggtcgccgagaacgcgtatggcgttccatctgaccgcgtgattttgaaggacggtttcgccgaatcgctggccgccgctcagaacctatgcgccagcgcgggcatcgatttcggttcgcttgctttggtcgccgtgaagtccccggccaccatgaccgacaatgaccgcgctccggaagccgagcgtacggtgacgctaaagaaggtcgaagtgcattccggtgccggcctggtgcacgtgaacctcaccacgtccctgaccacgccgatgccgaagatcgtgtgataaacgagtcgtagcgttctgatcgcaacgttttagggcggccacttacgtatatgcgtaggcggccgcccttttgcaccctaattttggcggtttctagcgaacgtcgcaacgccatgacctcgaaggaacggtggtaacttcgtcagaagttgtcgccccgaaccgtgaggcgggaaacacggtgtgtttccccgtaggtgaggtgagaggttcgcaatatgggcgaacctcgaaggaacggtggaaacttcgtcagaagttgccgccgttccagccccagtcggtggtggcggtgtaacggatgtacgtgcggtcggccggaatgcccagttccttctccaatgcggccatgatctgctcggtcagcttctcccaggcggaaccgggcacggaacgaccgaacacgttcacttcgacgtatgcggctggcttggaatcgtcgccgccgaaataaatcggcatattgtcttcaaatgggcacatcagccagccttcggacttgccgggaacggcggtgatcgccttgccgtatgcggacttcagcgcctcgcgctgttcggcggtggtggacacggaaacatgggtatgaatgactggcatggtgctctccttgaattgttgaaatcagcctttgcggttcacctccagtctaggcgtcgaacggcgcagtcggggtggttgcgtgagaaattttgggctttgtctgaatggctgccaaggtggtctgcgtgcgcgtgttaaatattcgttgtgagaaaactgattgaacagcttatgaaatttggcctcgttggcgtgatcgccttcattatcgactggggcattctgaatcttctcgtcggcgtattccgcatgcacaacgtgctcgccgcaaccatctcgttcattatttccctgattttcaactacattgccagcatgaaactggtgttcaagcaccgtgacgacatggcccgctggatggaaatcctcattttcgtgattggcgcgctgatcggcctgttcatgaacgacgccattatctggatctccacgtatggcatgaaccatgatgcctacgtgtcgcagagcaccgaatacctgatccgcaccaacgtcggcaagctcatcgccaccgccgtggtgatggtgtggaacttcctgacacgcaaatggttgctcgacgatacgcacaccaacgccatgaaccgtttgcgcaaagccgacaaccgcctcacgccggaagagctggaagccaagtggcagaacagcttctcgcacaagcttggcatatggtcgctggaacacactcccaacggttggcccaagtagtcctgaattcggaaaatctgcctgcacaacccggaaatctgccctgatcaaatctgccctgattcccgactcgcgcagacggccggacagtcctgaatatgaaaaggcggtgcttacacctataaaggtataagcaccgccttttcgtatgctctgcatgctttacgtgcgaaaggtcacacgcttacggtggtaagcatgggctgctcggtggagtccttgatctgcttgaagccgaacagggcgatcgccagcgaggtgagcgccagagccgtcactacaatgaaaccaccgtgtgatcccatacggtcgatgaactggccggcaatcgccgagccgacggaaccgccgattgagttcatcgcacccatccaggccatgccttcggtgaagcgtgtgggcggcaccaagtgcagcatcagctggttgccgttcacccacgtcggtgcctggcatacgccgatgaacaggtagatgatcatgatcacccacagatgtttggcgaacatgaacgagccgatgcctagatcgaccacggcaaggcagaagtagaaacgcttccacagcggaatagtccaattctttgcgccatacacgagcgcgccgatcagcgagctgaacgagaagcaggcgaacacgaaaccggtgtactgcttcatattcgcttccgtggcgaacgcgacgatcgaaatgctggcggccgactggaacgcgcccaaaccgaaccacgtcacgcatacggcgattaggcccggcccccaaatcgattccttgcgcccggcattcacatcggcggcggcctgatccatggcggcctgcacttccgcagccgttttgccttcggaacgtgcgcgatcgcgagcgtactcaatggccgcttccgcctgcaacgccttggaacgggcggcttcgcgctcacggtattccttgcgggtcatgcccgcttcgcgagccagctgcgtctgcgatttcggctcggtggaaagttcggtgaggaacatgagcgcgccgaccaccacacacacgccagtgaatgagaatgccaacagcccggaaatcacggccagtgtggaggcgagcggattgccgatcacccacatgcattcgtcgaacacgccggaaagcgaaagcgcgcggttggttttctccgtgtcacctttaagcagcgtggtccaacgctgacggctcatcgcgccccacggcggaatcgccgccatgaacggtacgatacagaacagaatccacgacggcactcgggcggtgatacaggaaaccagtgcggtcgccgcaatcatccacacgatgattgtcggaatcgacacctgacgctggccgaacttgtcaaccagcttgccgagcaccgggctcgcaacggccagcgcgatcgcctgcacggccgtcagcgcgcctgccagcgaataattgccgtaataatgctgcacggaaatcgtaatcgtcatgccgaccatcgggaacggcatgcatgcgatcactgaaccgaccgaaaatcgggcggtgtgcggtatgcgaagaagctccgcgtaccctccgaaaagatgttggccgatgcttttggcgccggcgaggactgaattggtcatgttttgccgctcctttctgctcacggttggtgcttgcgtccgctgcgttgcgttgccgcggaccgcttgatataccctcgttctgtcttgattgtttgctctccagccccagtctctcacttcaaccttgcttgaacgtcaatcgattgacgttcaagcgtgttgcatagggggtggagactggttgtgtgccattttcttgaactagacaactttatgcggaggtactgtcgcaacacgcggtgcattgaggttggcagacataattcgattggctattttgtaagtactcaccacacgttcacttggtggacgaaaagatgtccggcgggcgaaagacggttgttgcaaaatggttgcgcaacgcttccaaagcttgcgattgcagaattttcgttccatcggtcaacgtcagcagtccggcagcatcttgcggaaaggcggtagggatgcccgcaacaaccatccatttcgtacgtcacggcaaagtcgaaaatccagggcatttgctctacgaacgactgcccggattccacctgtcggaagtgggtgtgcgcatggcgcaggcgaccgcgcactacattgccgtcaatccacgactcaacacagtttccgccatctactcgtcgccgctggaacgcacgcgcgaaacggccggcgaaatcctcaccgcactcaacgaagtgcgtgaaacccgtggcgaggagccgctgaaactcaccaccgacgagcgcatcatcgaagcgcgcaacgaattccgcggcacgcgcatcggctacggcgaaggcgcactctggaaaaacggcaactggaagctggtacgcaacctgtggaagccaagctggggtgaaagctaccagtcgatcgcgcatcgtgtgcaagcgttcgccctcgaaaaagtgggggagcatcccggcgagcaaatcatcgtagtcagccatgaatcgcccatctggagctacaggcacatgctggaaaccgggcacccggaacataatatgctgctacgccatacggcactcgcctccatcacttccattacgtacgattgcgatacacgcaaagtattgtcgatcgcttacgtcgatcccgcggccgacgtgaaatagcgcataatgcggcatggaatcgccggattggaaacttttgaccgagacacgcgacaatgagtgcggcggttgttgaaagaacggggattccatgcaatcatggaagggctggatgctgttgggtccagtgaggaaaacaaaatgtcgaagctgcaaaggggcacgcatggctttcactatcaacaacggagcgctttatcaattattcgataggcctcatatgaaaattgccatcgaaagctgtgttggagtggtggaattatggccgctgcaaaccgttcaggagatggagaatgacgcaaagtacacggaagatctgcaagtaagattctcctgcaccatggcaagggcaatgctgcgattgtcccacgggattaacccgtccgtggcggaagccgtgtacgagggaatggacgagattccgggttgcgatccggaaattgtgcaagcgctcacgcgggccaatcaggcatacgatgtgatgcgcaattattccgaaaccaacaatgccgacctgttcttcgaagcggccgacattctgggcatcttcatcgacgcccatgtcgagacggaagtccgcaatatactgcaaaagatcgtggagtacattcggcagagcgtcagcctgggcttcgacggcggagcgctggaagatgtcaactactgctacgctttcaccacgaccccaaggacgctcaccgggcgattcctcgcggcgctcgcggtgggtgacggtctgatgaatctcatgtgcgaaggcattgacgatgtggacgaacagaccgtgcgcgtgctgccggtgatgctgtacatcaacgagttgtgcgagcagatggctgttccgccgatctatgtcggcgacgtgaccttgtctcgaatggttgcgctgcgtaatgctgtgcgtgaggcgggcagggcaacgccactcgaggagaattccttctgcgacaacacattcaccataaccgcggacaatgtcattccgtgcgcgggcatggagtgggatcatcatgcggagtgcctgcgttgggatccgaagagggccgagcaggaagccaaagatgaggatgaacgtaagagcaaggaagcgctcgctgaaaagttcaatttgatgacggacgctatgaaaagtatgagctacatggatgattccgatgattctggtgattcaggcgaaggtgcggatgctgcgtgacgtgggcaatccgagataatccgaattagtgggaattatcgatataggaataagaaaatcccggcacttgcgattgcggtgccgggattttctttatgtagtactgattattgcaagttcggttcttaagttcagtgctgaacaggcatatttcgtcagtgctgtatgttgccgtacgcggtaggatcgtcggaatcgtcggaatcgtcggatccgtacggggtctggccctgcgaatcgttgccgaacgtggggcgatcgaactgcgtctggtcaagctgggtggactgttccggaaccgtaggcagcggaggcatgctcggcatggaaggggcttcgggtgccggggctgcatgcggagttgccggggcggccggagtgtactgggcggctggagcggctggcatcgcaggtgctgcgtactgatcggtcggagttccgtaaggagcgccatacgggttgccgtacggagtgttggtggctgccggggctggggtcggagcgccatacgggtctgcggtgggcattgccggagtcggcgcaggcattgcaggtgccggagcggctgccgtatacggatcagcggttggcgtcggaacagccgctgcgtacgggtcggcgaccggtgccggagtgccgttcggggcgtattgtgcggttgcggtcggtggcatgcccggggctggggcgtagccgttgccggctgccggatcgtcgaagcgtgcgccggctggatcggtcttcttggccatgagcacaatgagcacgatcgacgtggccaggcatgcgatgaaaccgatgatcaacaggagtatgccggctacgccagtcgagctcgatccgccaccgattacggaaatggcgccaagtcccgtcatgacgaggccgacgctcagcagaacgccaccgatgaagtcaatcgcgtagaggatgaccagcgtggtgccggccttgttggtgtcgtgcaggcggcgaacggaaagcgcaagggatggaacaatcgttgccagtgcccaaatggtgttgacgaagcttcgcattccattggctgtattgctgtcgatgatggcgcccaacaccgcgaagatgacggcaaacgcgatctggatgatgaatgtgcacagaacccaccaccagaattcgccgcgggaggcgcggcccttgaacgtggcgtactttttccagaagcggatgaacgcctcgccgatggtgcagttgtaggccggctggtcgagcggagcggtcagtgcgaagaagctgccggacccctgtggctgaggttgcggtgcgccgtattgcggctgctgctggttgtatccggccgcattgccgtattgcggtgcgctgtattgaggcgcgccatactgcggtgcctgctggccgtaatcattctgaccgtaggagccgtaaccgccatattgctgggcctgctgcgggttctgcggattatattggttggggtccgtcattagattaccctttcggaaagtgaatcgacatcaaaaaagtgaagtcgattaacacaatactcttgcatcgccaaaaataccgaaaaatattgcagtgtgggacaatcccgacagaccccgcaaaaatcccctttgacgtggggcatcttctgacgcgttggggaagtccgtcgatggcgcggctcatgcccagcatggtgttgtaaggattggtggctgcgatcatcgggtcaattagctgcaggatgttcatgaccgcgaaaagcgagttggtgcgtgggactggatggcacgtccggtttgcggggcacaatggagcttatgactgaagctgaaaacaccaaaccagaacttcctgagcatgttcgcgtgcgtttctgcccgtccccgaccggcattccgcacgtcggcatggtccgcaccgcactgttcaactgggctgaggcccgccataccaagggcacgttcgtgttccgtattgaagatacggacgcccagcgcgactccgaggaaagctacaaccagatcatcgaagccctgaattggctgggcatcgactgggacgagggcatcaacgtgggtggccccgacggcccgtaccgccagtccgagcgtggcgacatctacaaggatgtcgcagccaagctgcttgaagccggctatgcatacgaatccttctccactccggaagaaatcgaagcccgcaacgtggccgccggccgcccgaaggctttcggttacgacggctacgaccgtgatctcaccgaagagcagaaggccgccttccgtgccgaaggccgcaagcctgccctgcgtatccgcatgcccgatgaggatgtcgcgttcgacgatctgatccgtggccgcatcgagttcaaggctggttccgtgccggattacgtaatcgtgcgcccgaacggcgatccgctgtacacgttgaccaacccggtcgacgacgccatgatgaacatcaacgtggtgctgcgcggcgaggacctgctgagctccaccccgcgtcagatcgtgctctaccgttacctgatcgagctgggcgtggccaaggaaatgccgctgttcggccacatgccgtacgtgatgggccagggcaacaagaagctttccaagcgtgacccggaatccaatctgttcctgcatcgcgacaacggtttcattcgcgaaggcctgctgaactacctggcgctgctgggttggtccatcgccgccgaccgcgacgtgttctccatggaagaaatgatcgaaaagttcgacgtgcgtgacgtcaaggccaatccggcccgtttcgacctcgacaaggccatttccatcaacgccgagcacatccgtatgcttgagccgcaggacttcctgaaccgtgccgtgccgtacctgaaccgcgatggcgtggtctccgccgattcctgggatgcgctgaccgatcgcgagcgtgaggtgctgtccgcttccgtggagctcgtgcagccgcgcgtgcgcctgctgggcgaggtcgccggcatggtgggctcgctgctctccaccgagggctacatcgagcctgatgatgacgccaagaagcagttgaaggattccgctccggcagtgctcgacgccgccattgcggcgctttccgacgttgctgaagatgattggaagaccgacttcctgcatgagacactgaacaagtcgctgatcgaagatggcggttacaagccgcgtctggcgttcggtccggtgcgtgtggccatgagcggccgtcgcgtgtctccgccactgttcgaatccatggagattgttggcaaggagatcaccgtcgcacgcttgcagggcttgcgcgagcacctgtgatgcgctgatggtgtgattttgccgatcgcatgactgtcgacccgctggaatgttccgttccagcgggtttgttgttctgggatgctgtttaagaatggcggaaaatggcgcgacacgccgtgacttgcgcactcctacggattcgcgtatatttatcactcgttgcggttcgcggctcagctgagaatcacagcaataactcaagcccccgtcgtctagcggtctaggactacgccctctcacggcgccaacaccggttcaaatccggtcgggggtacgacggacaacttttcgaagttgccacgcctgccaaattgggatgtggtgtaattggcaacacagctgattctggttcagccattcttggttcgagtccaggcatcccagccaatgaccctcgcagatgcgagggttttttgttttttcgcaagcatgtctgccagtacaacatagtccaagaaaattgcactaccctaggaagcatgactgaattgcagaacgcagcaaaagccgccgccacgcgaccgcgcatccaaccggcggaagaaggcgacgatcgcccgctttccgtatccgcgcgactgggacgattgcaattccaccaatccggcaaattccgcgttctgcagcttgccgacattcaagacgggccgaaagtcagcaaagacaccgtcaaactcatcgaagcgtcactggatgccacaaggccggatatcgtcatcttcaccggcaatcagatcgcaggatatgatcccgcatacgcgcaaaccacgcgcaaacgtcgttggagcgctgccgcggggatttcctccaaaaccgcttcatccaagtcttccgaagcgtcagaacggttcgaagctgcgctggaacgcacctgcgcatccgtgcgcgccactgtcgaacagctcgtgcgtccgcttgccgatcgcggcattccgtgggcggtgacattcggcaaccacgattttcaatgcgggctcagcaatgcggaaatcgaaagcatttgcagggaatttcccggatgcgtgaaccctgagcctacgggaggcgagagcggcctcgggggcgcaaattctgcaaattctgtgggaagcatggattctgcggaagatgcaggtttcgtgcaactccgggcggaatcgtatttgccgaatcagcgcgtattcgcttgcgagccgggcaccttcgcattgccggttgccgatgtggaccatacgatgtccgtgctgggcttggtattgctggattcaggcgattacgcacgttccggcgggtacggaagcccgtccgcggaggcgttgcgatttcttgccgaagtgccggaaatgatggccacgcaatctcagaaacaggcaggatcgcacgaaaccgcgcaatcgcaggaaaaggcagtgccgtgcatggtatttcagcattttccggtgcaacagtattaccaactgttgaagccgactgcggcgaatgcggcgcgtgcgattgaaggctaccgcaatttcgctggaaaacattacgttttggatgaggaaaaaacgcttcccggcagttatctgggggagggtgtcagctgcccggatgccgacagcggtgaattcgcgatattggaacagcatgactattttgcgatttccgcggggcatgatcaccgcaacgcattcgttggaacagtgccggtttcgcgagaaatggcctcggctgatgcgcagacggcggcttcgccaggcaaggttggcggtctgacgatgatcgcgtcgcccaccagcggtttcggatcgtatggtccggtgccgcagaagcgggccgcgcggctgatcgagttcgacatccgccatccgtacgagccgcgtacgcagctgcttgaatacggcgaattagtgggcaaaccgagcgcgggcaaggcgtacgcgtacggcatgaccagtgaatcgaagcccgaatccgaaggcgtggatctgctgcatcggccgacatggtggagcaaactgttgacttggctgcgtaagaagtagctgaaaagagcgaaatgacaaatcttgcaaggaaatggcaaaacttgcggaaggcaggaaatagcaaaaccgtgtcctgcatgcatcgtggaacacggttgagaggctgtatattgcccgtcagcgaccggaagaagccttaatcaaggcgtcggtcaaatacttgccggcagccataaccagcggggcgtaacggcgtccgggattggaccccatacgaccgtccgggccggaaatcgaaattgcggcaatcacctgaccggaagcattgcgaatcggcgcggaaatcgagcatacgccctcatcgcgctcgttgaccgactcggcccaaccgcgcttgcgcacggcggtaagcttggccgcggtgaacttggcgtgacgcaacccctgatgcaggcgttcggaatcctcccaagccagcaaaatctgggccgcggaaccggcctccatcgacagcatcgcaccaaccggaatggaatcacgcaaaccggaagcgcgctccacggcggcgatgcacacgcgcatatcgccctgacggcggtaaatctgcgcggattcgccagtgcgatccagcaacgtctgcaaaatcggcgcggctgcggtcagcaaacgatcctcgccggcagcagcggccaattccgcaaaacgcgagccaagcacgaaacgaccatgctgatcacgcaacacaaaacggtgacgctccaacgcaatcgccagtcgatgcgcggtcggtcgggccaagcccgtcgaggaaaccagctgtccgagcgttgccggaccggattcaagcgcgtcaaggattttgacggtcttgtcaagcacacccacaccggaatgaatctcattgctttgagaagacgtcgtgtggtgggtctcagctggaagcttagtctcatccgactgcgattcaggcatggtggtgcttgtattcgaagaagtcataagagggattatgccatctcacatattgaaatgcaaaatgtacgcaatgtcggactgcggtagagcaggtattttaatctttactcagttatggaaaaagctggaaaaaaatctgaattttcaacgattttgtaggtacatacggggaggtatgccacaatcgcggcgattttgacatgatctggagtgaacttggcccatatgtgatgtgtgcgttgcatgcaagtatctcatataccggcataaacgcgttcgaaccaggctcgaacaccataggcttatagcacgaacaacgcgggttggcaataccgcgaggaaaaagcgaggaaaaattcgaggaggtcccgcaatgggaacgacattggccgagaaggtctgggccgatcatttggtacgcaagggtagtgatggggctcccgacttgctgtacattgatctgatgctcatgcacgaagttaccagtccgcaggcattcgaaggcttgcgactggccggacgcaagccacgtcaccttgaccagctgatcgcaacggaagatcacaacacgccgactgccgacatcgaccgcccgaatccggataagatctccgcgctgcagctaagcacgctcgaaaagaactgcaaggatttcggcgtacgtctgtgcccgctgggagacgccgatcagggcgtggtgcacgcgttcgcgccggtgctgggcctgacgcagccgggcatgacgatcgtgtgcggtgactcgcacacctccacgcacggcgcgttcggtgccatggccatcggcatcggcacctccgaagtcgaacatgttatggcaacgcagaccctgagcctgaagccgttcaaaaccatggccgtgaatatcgaaggtgaactgccgaagggcgtcaccgcaaaagacattattcttgcgattatcgcgaagatcggcaccggtggcggccaagggcacgtcattgaatatcgtggtgaggccatcaagaaactgtcgatggacgcacgcatgaccatctgcaacatgtcgatcgaagcgggcgctcgcgccggcatgatcgcgccggacgaagtgacgttcgaatatctgaagggacgcccgcacgcgccggaaggtgaaatgtgggacaaggccatcgaatactggaagacgctgaaaaccgatgacgacgccgtattcgacaaggaagtgaccatcaaggccgaagatctcgagccgtatgtgacgtggggcaccaacccggggcagggcatcaagatttccggcgtggtgccggatccggcttcgttcaacgatgaaaccgagcgcaccgcggccgagcgtgccattgcctacatgggcttgacgccgggcatgcgcatcaaagacattgccgtggataccgtgttcatcggttcctgcaccaacggacgtctcgaggatctgcgtgtggccgcttccattatgaaggggcatcacaaggccgaaaacattcaccgcgtgctcgtggtgccggcctcctctcgcgtgcgtttgcaggcggaaaaggaaggacttgacaagatcttcaaggacttcggtgccgaatggcgtaacgcaggctgctccatgtgcctgggcatgaaccccgacaagatggtggcccgcgaacgttccatctccacttcgaaccgcaatttcgaaggtcgacagggcaaggggtcgcgtacgcatctggcgtcgccggcggtcgccgccgcaacggccatccgcggtaccatctcgtctccggctgatctgtgaatcgttgagaatgcttgaaaacctgagaaatcttggatttccggcattctgtgaatcgttacatcgaaagaaatagtgaaatggaaaaactgactactcttaccggcgtggccgtgccgcttcgccgttccaatgtcgatactgaccagattattccagccgtgttcttgaagcgcgtgcagaagtccggtttcgacgacgcgctgttctatgcgtggcgtcgcgatccggaattcgtgctcaaccagccggaatacaagcggggcaagattctcgttgccggaccggatttcggtatcggatcttctcgtgaacatgccgtgtgggcattgcatgattacggcttccgcgtggtgatttcgtctcgtttcgccgacattttctacggcaacaccgcgaagaacggcgtgctggctgcgattatgccgcaggaatccgttgagttgctgtggaagctgcttgacgaggagccgggccgtgatatgacggtgagcctggaggatcgcacggtgacgtgcggcgacgtgacgctgccgttcgaagtgaacgactatacccgttggcgcctgatgaacggctatgacgatatcgatctgacgttgcagtatgaagacgatattgtgacatacgagaagatgcgtgccgaaaagttcccgttcaagccgaagacgctgccggcgaagcgtgagccggagcagttgatcgcgtccgcgcgcgaaggcgaatacccggattggcagggcccgcttgccgatcgcggcatcatctgagttggcggctggctaggtgcgcgggctgtttgcggggtgattcctccagtgggtggaaggaacaccccgcttgcgttgttgcgcgggctgtttgcgggaggatttttccagtgggtggaagaattgggacgtcgggatgattgttcgcgggaggattcttccagtgactggaaggattgggatgttatgtgatgcgtgagcgggaggattcttccagtaggtggatgtttttggactttgagacggtccgtagcggggtgattcctccactgggtggaggttttgggacgattaggggactcatattgtccggattcctccagtgactggaaggattgggacgttgggattgctgattatgtgagatttgcgcgggttttgcatatgagacgcgctatggtgggcttattgtttcgtgctttcgtagctttcggagagaaaaatgagccagggttttgcgccgttttatgatgtcaatcgcacgtatgaagacaactatttgcaagggccgttcggcgcgtttgccgaagtgttgcgggctgatgcgtccgattctgcgggatcggtcacgtctgttgttgctgaggttgcgtccgattcctccagtgaggttcagggcgttcagaccattcaggccgctcaagcgcaggaattccttggttttcgtgtgaatctgccgttcggtattccagctggtccgctgctgaatgagcgtttcaccacggccgctttccgtatgggcttcgatctggcggtatacaagacggttcgttcccgcgcatggggctgcaatgcgttcccgaacgtgctggccgtgcatccgcggaatgccgatggttcgctggttccgggcagtgccgaacttgacgagggtgtgcttgccgatacccgttatgagcttccgatttcgatttccaacagtttcggcgttccctcccgtgatcccgacgaatggcagccggacatgcagaaggcaatcgccgcagccggtgacggccagctgctggtgccgagcttccaaggctcccgcgtggagggcatggatcgtgaagcgtatattgccgatcatgtcaccaccgcgcatttggttgccgaaactggcgctggcctgatggaaatgaacaccagctgcccgaatgagggacataatcgtctgttgtgccacgatccgcatttggtcggcgagattacggaagcggtgaagaacgaaatcggcgatcgtccgctgatcgtgaagctcgcatacattccgaatgatgccgatctggaaattatggtgaaggaaaccgccggccatggcgcggtgcagggtttctccaccattaacacaatctccgcgaagctggtggatgcgaacggcaatcaggcattgccaggcgcggggcgtgaccgttcgggcgtatgtggcaatgcgattcgtggtgcaggtctcgatatggttggccgcctgaatgcgattcgcgagaagctgggtcttgattttgcgatcgttggcgtgggcggtgtgattcgtccggaagattacaaggcgtaccgcgaggctggtgcaaacgcggtgatgagcgctacgggtgccatgtggaacgcccgtttggcgcaagacattaaagccgcactgtagtcacaggttcaattgcgcctgatttgcgctctgttgcgtttcaccgtccttttttcccattcgctggaaggattagtgcagcacgggggtagctgtccgtcctgattcttccagtgactggagggttttgcccgctgagatgcagtttggtgggatgattcttccagtgactggaggtttttggacggtggaggggcttgtatcgggaggattcttccaccgactggaagtttttgcccgctgggatgcggtttggcgggtggattgttccagtggctgggtattttggtcgaaagtcgaacgaaattgggagacactgcgctgaacgcggcatttcacgagcccactacatgccttatggcaaactgagggttagtgtgtttcaagcttgaaccgtataagggaagcgaaagaggttgagcgtgtctgacaacaacaacgacattctgcacgtcgaaggtggcaagccgctgaacggcaccatcaaggtgcgtggcgcgaagaacttcgtgagcaaggccatggtggcggcgctgctcgccccgggtacgtccgtgttgaagaatgttccggagattcgcgacgtgcatgtggtctccgacttgctgcgtctgcatggcgtggacgttacggtggatggcgatcacggcgtggtcacgatcgacgccacgaatgtgcagcttgccgatgtggccgacgtggatacgctgtctggttcgtcgcgtattccgattctgttctccggcccgctgctgcaccgtttgggtgaggcgttcattccggctctcggcggatgcaatattggcggtcgtccgattgatttccacctggaaacgttgcgcaagttgggtgccaacgtcgataaggaacataaggacggcattcatatcaccgctccgaacggtttgcatggcgcgaagattcacctgccgtacccgtcggtgggcgctaccgagcagacgttgcttgccgccgtgcttgctgagggcaagacggagctttccggcgctgccaccgaacctgaaatcatggatttggtgtgcgtgctgcagaagatgggcgcgatcatttccgtggatgtggatcgtacgttccgcatcgaaggcgtgaaggaactgaagggttacacgcacatttcgctgaccgaccgcatcgaggccgcttcctgggcttccgcggcattggccacgcatggcgacattttcgtcaagggtgctacgcagcctgaaatgatgacgttcctgaacgtgttccgcaagattggtggtgagttcgacattaccgataacggcattcgtttctggcatccgggcggcgatttgaagccggtcgcgatcgaaaccgacgtgcatccgggcttcatgaccgactggcagcagccgctggtggtggcgttgacgcaggcgaagggcctgtcgatcgtgcatgaaacggtgtatgagaatcgtttcggtttcacgaagccactggtgcagatgggtgccacgattcagctgtatcgcgaatgcctcggatcgctgccatgccgtttccagcagcgcaattacaagcattccgcggttattttcggaccgaccccgctgaccggccgcgatattgacgtgccggatctgcgtggcggcttcagccatctgattgccgcgttggcggcaaagggcccgtccaatgtgcagggcatttcgctgattgaccgcggttatgccgatttccgtggcaagctcgaagctctcggcgcagatttcgactgatttgttgcttgatttatcgctgatatagcttgattggcttggtaaggccggtgttcacaacagtgggcaccggctttttgcttacatattgccgttgctcgttctcaaaaacttagtaattcagtgtataaattattgaacttaatttagggggttatggcgcataatagtgatgcaaaaagttttattgtttttgaaaataatgtcgattttcggcagagattctttcggaatggcattatgattgtcgatatcgaatggcgtttgcaacgaggtgaacagccgaagatataagggtttccctcatcgttattgtgtttactgcatgtccagacggattctagggatagtcgcaacatcttcgtcgtcaatcgtcctccagcctatccaccagttccgcctttttcgtatattccgtgtttttgtatttcgtgtgtgcgtcgtgcatgagcgcaatcgttccaaccaagcggaatgggtggtggcagaatggaacgcatggcatccaaaggaaaaccctcgccgcgttccgcggtcaaaccgttaagcgacgaacaagtcgcaaagctcgcacagcgtcaccatctcgttgacccaacccacgactttccatgcgggccgcgcaaagccaatgaagccgaaatcgcggcgcagaatccgaaagcgacccatcgtctgctcaccggatgcgacatcgtattccgcaaccgcaccaaactcaaggcgtggggcatcgaacacgtgccggaaaccggtccgttcatcaccgcggccacgcacgtcaccatgtttgacgtgttcgtgcccatgatctccatgttccatcaaggccgccgtccgcgctacatggccaaagccgaaatggcctcgtggccgctgatcggcaaatggttccaactggtaggcatgcagcccgtgcaacgccgttcgggcaaggcgaaagccatcgaggaaacctccgtggaaatccttacctccggccgacccctaaccgtatggccggaaggcacggtaacgcgcgatccgcagaaatggccgatgagcatgaaaaacggcgtgggcatgatcgcgcttgaggcttcgcgccgactcggctaccagattccgctgtattgcgcggtaacgtggggcgcggcaagcatcaaccattggtggccgtggccgcgtaaaaacgtggtcatgtgctacgacgaggcgcttgattatgcggatctgctcgccgattgcgattcctggggtgaggaagtgccggaggatctcgccaacgaacttacccgacgcatccgcgtgcgtatgaccgaagtcatggccgaaatccgcagcgaacaagcccccgatggatattgggattatcgtacgatgagccgagtgaaggactgaatcgaagaaggccgaatcgaaaaagaccgcacacgcgattgctgaaatgcggtaatcgaaatactgccagccgattgcgcatacgtatggcgcgtattgcggcatatatcgcggtgtgcgtagccggcggtagcataggaaaagcaatttttgagccaagactccgggttatgaatgatgcccggagtaatgcaaggagcaaatatgacgaacgtgacggtactgggcgcaggagcttggggaaccgctttcggtcaggtgcttgccgatgcaggcaacaatgtgactatgtgggccatcgaaccggagattgtggaaggcattcgcgaccaccatcacaacggtgttcgcctgcccagcgtgaaagtgctgccaagcaacatgaccgccaccggcgaccgtgccgaagccgtagccaacgccgacattgtgatcgtggccatcgccgcacagttcgcccgcgtcgcgctcgtcgaattcaaggacctgattcccgaaaccgcgctcgtcgcctcgctgatgaaaggcatcgaacgcaccaccggcaagcgcatggatgaagtcgttatggaaacgctcgacctgccggccgaccgcttcgccgcgatttccggaccgaacctgagcaagcagatcgccgaccgcgagccggccgcaaccgtggtcgcctgcgaaaatctcgacaatgcgcgcaagatcgcagccgcttgcaccaccgactatttccgtgcgttcgtaacccgcgacgtgatcggcttggaaatgtgtggatcgctgaagaatgtggtcgcgctggccgtgggcatggcccgcggcgccggctacggcgaaaataccgccgccatgatcgaaacccgtggcctggccgaactgaccgccctgggcgaggcggcaggcgccgatccgaagacgttcgccggtttggctggcgtgggcgacctgatcgccacctgcggatccccgttgagccgcaactacacgttcggatccaacttgggcaagggattgagcgttgaggaagccaccaaggtgagcaacggcgtggccgaaggcgtgccgaccaccgatgcggtggtggcgctcggcaagcagtatggcgtgcctacaccgctcgccacggccatgagccacgtgctttccgatggcatctcctgcgcgcagatgctgtccgaacttttcggcgaaggcatcagcgaagaataagctttccgcaacatcgcgattgcagataagaccgcactttcaggtgcggtctttttatttttcgaggcatgcgattgcgtaaaacgtcaatcggaatgtgtcaatcgtcaatcgccatatatttcggcaataatagtaaatctgtataaaaatagtctaatcgtgattagtctaatcgtgattagacaaagcgattaagctcggtttttcaggttgcaatcgcatcattccaacgtttgattccgtattctatgattcatgaaaataggacatgagtgacgggcgtgtgtaattatgattcgtcgtgtgtgggctgtggggtgcggtttgtatactgaactgcgatattgcgaatgcgtggtatcgcgggcgaacagaagtgcgaaccggcgcgatattgcgaagacagacagtacagacagtattggcagacggtattgggcgcgcgtgcgttcaacggaccaacttatggagcataagacaaagatggcaaaacagcgcattgtggtgatgtatggcggcaaagccgacgagcattcgatttcctgcatctctgcggcgggcgtgctgcgcgcgttggatactgacaagttcgaagccattgaggtgggaatcaccaagaacggcgagtggatcgtaggcggcgaggatccacgcaagtggaacatgagcgaaggcctgccgatggtggagaagacggattcctccaaagatgtggtgctggatgtggcactcggccaggatggtttcttcgctcgtgaagatgacggcacgctgacttcgcttggccacgtggacgccgtgcttccggtattgcatggtccgtacggtgaggatggcacgattcagggcctgttcgaaatgatgaacgtgccatacgttggctgcggtgtgctcgcttccgccgcttgcatggacaagcattatacgaaggtattgctggctgcggccggtattcccgtggctccaggcatcacgttggatgtgcgcgattatgatgccgcttccgaatttgccaccgaggcggacgaaatgcttgccgcggtgcagcaggccggattgcagtacccgctgttcgtgaagccgtcccgcgccggttccagcttcggcgtgagcaaggtcgaacatgagggcgatgcggccgagcttgccgccgcagtgttcgaagcgtcccaccatgattggcgtgtgctcgtggaacagggcatcgacgcgcgcgaaatcgaatgcgccgtgctctgcccgaaggccggcgaggctccgcaggccagctggccgggcgaaatcgtgcttgacaagcgtgccgagggcgacgaccagttctatgatttcgacagcaagtacgtgaactccgacgcaagccatgtggaagtgcccgcaagcctgccggaagaaactctgaaccgcgtgcgcgaaaccgccaaaaaagcgttcatcgcagtcgacggcgccggcctgagtcgtgtcgacaccttcgtgacggccgacggcgaagtgatggtcaacgaaatcaacaccatgccgggcttcaccccgatttccatgtatcccaaggcatgggaggcaaccggcgtgagctacaccaacctgatcaccatgctgatcgagggcgtgctgcgctgatttcgattgtgtggttgctcgctttagtctgattcgatttgcatgagactggcatcaatgctgacactgcgttggtgccagttgacatattccgccaatttacctgcagtttgggaaaatttagttttttcgattcaaaataaactgcatatttactgtaaggtcagtatcgcgttgatttgagggcttatcttctttcttgttgttatgaacaaggcataagaaagatattgatttccatgatttctctgcgcaaactggctgccggctctcttgctgccgttctggctttctccatggccgcctgcggatcgggcagcacggattcctccgctgattccacttccggcaaggccgtgaagattgatgaaaagtccgcaaaggccacttccttggctgatttcggtacgatggacgatttggttgccgccgccgaaaaggaaggccagcttaacgtcatcgcacttcctcacaactggtccaactatggtgaggtcatcaacggcttcaagaagaagtatccgaacattaagatcaacgagctgaacccgaacgcctcctccaaggaagaagtggacgcagccaagactaacaagggcaccgacgctgcccccgacgtgttcgacctcggcttggccgtggcttccaccagcaccgacaacttcgcctcctacaaggtgcaggcctgggataagattccggattccgtgaagaatgctgacggcaagtattacgccgactacaccggcatcatgtcgatcggttggaacgccgacaagtacggcgacatcaacagccttgacgatctgatggatccgaagttcgccggcaccgtggcgctgaacggcaagcctgccgaagccggcgccgcattcaacggttacctcatgatcaaccagctcgcaggtggtgacatcaacgacttgcagccgggcctcgactacttcaagaagctcaaggatgctggcaacctcaccaccgttgacgtgaccgacggaaccatcgattccggccagaccggcgtggtgatggactggagctacaaccaggcctcctatcagaagagcctcaaggagaagggcgtgaactggaagttcaagaccttcaagaacgcccaggtggtcagctactacaaccaggccatcaacgtggacgctccgcacccggccgcagcacgcctgtgggaggaatacttgtacaccgccgatgctcagaacgaatggttcaagggcggcgccaatccggtgctcctcgactccatgaaggaggacggcacggttgaccaggacaccctgaagaccgccatcaccatcgagggcgatccggtgacctatacaaacgatgattccactcgcatcaccgaatggctccagaacaactgggacaagaccatcggcaactgattggcaaccgctcgcaagcaacgcaaacgagctggatcgcaatcgaaaataatgcaatctaaggccggtagaccggcggacacgacgggctgaagcaagttccccgacgtcttctgccgcaacaaccggccttgaagcatgtctcccgcaatagcggaatcccacaatcctatgcaatctcaccgcatatcaatcgtatgaaagcacgcatgcaaccatgactgcagcaatcacccccaaagcgggagtcatcggcgggcgtaacgcacgcgaagcccgcggaactcgaggaaacggcccctccgcaacctccgatttcgccacgcatcgccgcgaaatcggtacattcgtcgtgaccatcccgttcttcgcctacaccgcctgcttcctgcttgcgcctaccgttatcgtgattgtcggcgcattccggaacgtcgacggcggatttaccctcaacaacttcagcaaactcttcgaagcgaacaccatcgccgcgttcgccacctccattctcgtttccgtgatctccgcactcattggcgcggtcgtgggtgcggttgcctcgtatgcgctggtgattggcagcaaaccgaacggactgctgcgccgcatggtcagtgccatttcgtcggtgctcgcacagttcggcggcgtgatgctcgctttcgccttcatcgccaccatcggtatcaacggcgtcggcaccatgctgatccgtcagctgaccggactgaccgtcaatccgaactggttgagctccctgcctggcctaatcacggtctactgctacttccagattccgttgatgattatcatcttcctgcctgcggtcgattcgattcgtccgcagtggcgtgaggcttgcgaatcgctcggcggtaacacattccagtattggacgcgcgttgcggggccgatactggttccgcgtttcctttccgcattgctgttgctgttcgccagcgcgttctccgcatatgcgacggccgccgcattgttctcacagcgttcgattctggtgccgcttatgattcagggcgccatgcgcaacgaaatggatccgaatcagcagggattcgcgcaagtgctcgccttcgcgatgatcatcgtggttgctctggtgatgatgctgagccacgctgtggaaaagaaggccggacaatggcagtgaatcatactgaagcaatgcccccgcagctgcgtgccgcccgcgtgcgcaagcagcgcgtgatcaaggcgattattctcacgttcacgctgctgttcctgttcgtgccactggtgtctatgtttgtgttcaccattcgacacccgctttccggcaagtggagtttggatccgtggattgcgattttcaccggcgatggcagcgcgcttggtgctgacttgtccacattgtggagcggtcttggatcgtccatgggattgtgtgtggtgactgtggtcatcatgctgctgctcatggtacccaccatggtgatcgtgcacattcgctccaagcagctggaacgcgccatcgaatgggtggccaccctgccgctgaccatccccgccatcgtgctcgtagtcggcctggggccgatttaccgttggctcagcgccgacgtgctcagcaccaacccgatctggctgtgcttcgcgtacgttattctggtgatgccatttgcattccgcgcgctcgctgtgggcctcaactccattgacgtgaaaacgctgtgcgaagcatcccgctcgctcggagcctcctggccgcgagtgttcttccgtgtgctcatccccaacctgtggcagtcgatcctctctgcatcgttcatctccatcgccgtggtgctgggcgaatacaccgtcgcatcgctgcttggacgcatgaacctgcaggtggcgctctaccagcttggccaatccaactcccaaatctccaccgccatgtcgctgctggcactactgttcggcgtgatcctgctggtagccctcgatcttatttccgacgcactgcgtaaatccaaagaaagcaacgaatcatgactctcgctgatcagaaagcaaccatcgcacgcacttcggaagcgttcgtaaacgccaatccgagcgccgaaaccgtaacccgagccgcacgcgaagtcctcaacgactccgcggaacgcggcggcggcgtgcaaatgcttaatgtagacaaaatctacccaggagccaccaacaaggcgctcgacaacttcaacctagaaatcaatcctggtgaaatggtcgtgctgctcggcggctccggctgcggcaaatccaccgcgctgcgttccctcgcaggcttggaagacatccaggccggccgtattctcgtcggcggccaagatgtgactggcgtgcccgtcaacaagcgaaacatggccatggtgttccaggcgtactcgctgttcccacacatgaccgctctgcagaacgtggaattcgggttggaaatccgcggcatgggcaagacggaacgccgtaagcaggccatggagaagctggaactcgtaggtcttgccgatcaggctggcaaatacacgcagcagatgtctggcggtcagcagcagcgtgtggcgctcgcccgcgcactggccgtgaacccccgagtgctcctgctcgacgagccgctttccgcacttgacgccaaagttcgtgtgcagctgcgcgacgaaatccgccgcatccagctcgaagccggcaccaccaccgtgttcgtgacccacgatcaggaagaagcgctcaccgttgccgaccgcatcggcgtgatgaaccacggatgtatcgaacagatcgccgacccgcagacactgtaccgccgtccgggcagcgaatacgtggccaccttcattggcctgaccaaccgactcccaggcatcacgaatggtgaggaagccgtggtgtttggccagcgcgtgccgttgctcgaagcctccaagcgcgacgcctccaccgtgctcgtgcgaccggaaaaccttgtgatcactctagccgcaaacgatggcaacatggtaggcgagcatggtcgcgtcgacatggtgcacttcctcggtgcgctcgcccgcgttgacttgacggttgccgcaggtgtgggccacctgcccgtcaccgtgcagctgccggccaatgagcttcctgccggcctgacggttggatccgaagtggtggtggctccgcgtccgatcgccgcgctcgccgtatgagctgtttcgttgcggacgcccatgacgacggtcatgagattgtaagctgatattcagcattcctgtactaaggtgctgaatatcagcattttcgtatatgcaccccgtgcacgtcgtcgcaaaggcaaatatgacgtttccgcagtacccccaatatccgcagcggccgcaacaaccgcatacgcagcagaatccacaacagccatcccaatatcagcaacaaccgcagtatccgcagccacaagccaatccctacgaactgtggctcaggcgcgtgaaaagcgtgttctcccgcatcggcgcaggcatgtgcctgatggtggtgatctggtatgcgcttgcaacggtgctttccggcatgctctatcaggtactgcacaccacgaatctgccgaattgggcggtgtatgtggcatcggatacccctttgtatctcgtggccatgccgctcgcggtactgattatgggcaaatcgtcggtcattgaaacacgcaagttcgacatgaagccgggccaattcttcaaactgctggtcatgtgcttcccgctcatgtatgtgggcagtctcatcggcaatatgttggcgtcgctgctgtccggaggcaaagccagcaattcggtgagcgatctggccatgcaattcgacgtgtggaacgtggtgttcctcgtgattctcggaccgttgttcgaagaatggatcttccgcaaggaactcatcagccgcacgcgcaaatacggcgaaaaaaccgcgatcgtgttctccgcactgttctttggcctggtgcacatgaacctgttccagttcttctacgcattcgcattgggtcttatgttcggctacgtgtacgtgcgcaccagcaaactgcgttattcggtggccatgcacatgatcgtcaacttcatgggtggcgtggttgcgccgtgggtggtgacgaacattgacatcgacagtctgatgaacgtgctgaccagtgcggaaaacggcgacggaacggccatgatgcagtggatgggccagaatgcgacgggaatgatgatattcggcatctatatgctgctatattacggtctgatcatcgcgggcatagtgttgcttatccgcaatcgcaagaactttgaattctataccgcaccggaagaactgcctcgcggcatgcgcacgagcacggcaatactgaacgtcggtgtagttacttacattgtagtgacggttattattacgtcaatcaatctaatgatgcaataatttcagtataaaaaagtgccgcatgtggactactgcatgcggcactttatatatatgggtcaaccgcgatttcttatgttcgcgaggatattacgattctttgttaatggcgcgattctcaagaaaatcagcattggcgatggaacgtgccacggcgttgatcatgtcgggaagcaacgattccggcttggcgtacgcgcacacttcgacattgatgccgtaaggggagtagccggtcagtcttactttcggagggaagcgcggatcggccaaatcggcggtatcgcgctgcacggcctgaaccacctgacgggtcatctcgtcgatgtcggtaccggccttggcggtaaacggcacacgaaccagcatctcattggacggattgagtttttccagtgacgcggtgttcagaatcgaattcggaatgatcttgacgttgccattgcgctcgcgcaccacggtctgacgccagttgatatcttcgaccacgccatcggtgcccgccacattcaccagatcgcccggctggattacacggccaagcatcagaccgaaaccgccgatgatgttcgcgatcgtatctttcataccgagcgacaccgcaagaccaccaatgccgagcgcggtgaaaatcgtggtcggattaatgccgaacaccggctgcagcacagtgcccacagccaacgtccacaccaccgcgcgcagaatattgatgaaaatcgaagcgttcggcacttgcgaacggtccagcactttgctcacgattcgggtaagcgccttgtcgataacggccgcaagcagtgcaacgacaatgagcagaatgatttttccggaattggttttcagccaatccacaacgattccaatcggttccatagtgttctgaagcgtcccttcataagtttgattcgcatgcattaccggtgcgcgcgacttgcgttcgctgcgtctgcgatgcgtgttcgcaacttgtgttcgcacatatcctacagtgcgtggctgagtcggtttgagcgtgggtgtgcgggggcgtgcgcgagaacatgtgggaatgcgcgtggtgacatgtgtccggagccgtgaacggactaaagttgaggcatgggcaatgttgtggattatgtgcgccgcgagttccgcgggtttggcgaattggcgttcagcaatgtcgattccttggtgctttccgagctttcctacatgcgattgccgggcttggttccagcattcggcgaggccaagtcggtggcgaccgtgccgatccgtgacttgctgcgcgccgaaagctacgatgagatgtttgtttcgaattcctctgaaatgaatgattatcggctttcgttgctgcgtgcggtttgcgaatcgccgcgattccgcgggttgcgggtgggggagtatgccgaacgtttggatgagggcgagcagcagcaattcgctgcgatgaccttcgatttgggtgccgatttcggcttatatgttgcgttccgtggcactgacggcacgctcgtcggttggaaagaggattttaatatggcggtgcgctgcccagtgccgtcgcaagaatcggcatatcgatatgcggactcgattctggacaggacggaacgtttcctctcggcgaaaaaatcacccgacattatgatcggcgggcattccaaaggcggcaatatggcggtatatgcggccatgcaaatcacgcaaagcgatattgaagcgaccaacgaacgcgcgcaacggctcggactgctgccggcgctcggaggaagcgtgccgggacgcaactgcagaatctcccgcatcttctcgcatgacggtcctggaatgtctcaagtcatggtgcatagccgcgcatatcaggcaatcgcggcacgaatcgacaaaaccgtgccggaatcctccattatcggcatgctgttgcaatcgcaaatcaaaccaaccttcgtcaaagccgacgccataagcattctgcagcatatgggatcaagctggcaagtgacgcaatccggcgaattcgagcaggcaagcgagctgacaggcggtgcgcaactcatcggcaaaaccattgacggatggttcgaccgcgtaagccaggaacaacgggaacgggccatcaaccagatatacgacatcttcgcagccgcggggtacggtaatatcgctgatctggtggcgcattggacggattcgctgccgaaaatcgtggcagccgccagaggtaccgacgtgcaaacgcgcgaactcatcaaagacgtgttcaaggcgattccagccagtgcggcgaaagtcgctgtcggggaactgcgcaacgacaaggagggggatgcgtgatgggcaatattattgactatgcgcgcacggaaacgcgcagtttcgaggcattgccgttccgcgaggccgacgcattggtgttggcgcagctttcgtacgacgaagtaccggaatgcgtgctgcgattggacgatttggtagcgaaatacggtacgttgcaggcgcgtgcgaagcaattcgatattcggcgtccgatcgcatcgttgcgtatgctgcgcaagcccccgtttggcggcgtgacgattgcgcgtgccgatgacgagctgaaccacgacaagcccgtggccgaccatgatgtggagaacgtgggattggtcgatccgcaggtgacgcacgacttctaccatgctgtggcggcgaatccgcggttttccgacgttgagatgagcgcgtattgcgagcagttcgatggtggtgcgcaaacgcagttcgcggcagtgactttccggctgccgtcgggaacgctggttgtggcgtttcggggtactgatgattcgctggtcggatggaaggaagacttcaacatggccttccaatacccggttccagcacaggtttccgcagctgaatacctgaaaaaagtcgcctcgctgtgggatggaccgatactgctgaccggtcactccaaaggtggtaatctggccgtatatgcggccatgaacgccgaagacgagatcaaggaccgcgttgaacgcatttactcgctcgacgggccgggcttccccgaagaagtggtgaaaagtttcgaatatgcgagcgtgagcgaccgcattgtgaaaatcgtgccggactcctcggtggtgggcatggtgtttgaaacccccgaacgttgcgtggtggtgaaatccgacgtggacggcatcatgcagcatttcgccttctcgtggcagatgcacgggggtgaattcgccaaggccgaagatgtggccgacagttcggtggtgttcaacaagtcgctgaacggctggcttgcgggactttccaaagaacagcgtgagcatgcggtcgacgcgctgttctccgtgcttgaggcttccggggcgggcagtatttctgcgatcgtggcggccggtccgaaagtgattcctgaaatgctcggcacatatgttggcttgagcagtgcggatcggcgcaacatcaatcaggcgttggtgattctgttgcaggcggcgctcgctcgcaatccgaaagttcagcgaaagtgaagcgcgaatgaggcgtgagtactgtgcgaacgtgggcgggcactgttcgcgtagcgtacttgtgttgtaagcgtgaattcgtatacgacatttgccgaaattcggtctagacaacttgtacaataaaacgtggttatgaggcaacatgactaattattagggggtactgatgccacgaccacgtagggattcggaaatcctgccagcaaaagatcgtctcgaaaacgccttctgggagctgctttcggaacgcgagtacaacaaaatcaccgtcaccgacatcgtgcgcacggccgacgtgaatcgcaattccttctactatcatttctccggactgccggaattggccgactccgccattctgcacgccgtcgaagacacgccaatgccgggcgtgccagggcgggatttcaatcctgacaccgaatggcgcaagcacgtcaccgcgttgctgcgcgatcccgaacagcgtcagcgtctcgaccgattggccttgctggcaggtccgcacagctcgccggaactcgtttcgtcactcaaggaattcgggcgactcaccatgatttccgtacttggactggatgccgacaacctcgatctgaaaaccgatctcatgctcgatttcaccgtcggaggcatgctggccgtactgcagcgctggccgaaactgcatgaaaaactgccgctcgacaccgtattcaacgaggatgtcgccgtactcgcggcgggcatgttcatgtcaatgtcgaaagcggacatgcttgaatactggcgcaggatcttcagcgaaggattcgtacccggcatggcgatttcgcaacagcagccgccgtctaccaagtgaccgtcgaaagccggctgtgacaatccagtggtagaaacgatatagcggcgtttttccgcggattgttccgtggaaaaacgcgagcgtgcgaaatgaacgaacgacggggaggttgtccatgatcaacgaagcttacaaggccatgctcggcggaaaatccgtgatccgcgagctgagcgaatacgcgaccgcgcgcggtgccgaaatcggctacgagaacgtgttcgactattcgttgggcaatccgagcgtgccctgcccgcaaagcttcaccgacgaaatgatcgccctgtaccaagaggcggaaccggtcgcgttgcacggatactcgccgtcgctgggcattacctcggtgcgcacggccattgcggaaagcctcaaccgccgcttcgacatggactatacgaccgactacatcttcccgaccacgggtgcggccggtgcgctggcccacgcactgcgcgtggtgaccaagcctggagacgaagtcatcacctttgccccctacttccctgagtaccagccgtatgtcaacggaaccggcgcgcacctgaccgtggtgccggccgacaccgaaaacttccaaatcaacttcgaagcgttcgaacaggcgctgaacccgggaaccgcggcggtgctcatcaacacgccgaacaatccttccggagccgtctattccgccgaaacgctgacccgactggctgaaatcctgcgcgccaagcaggtcgaatacgggcacgacatcttcctgatttccgacgaaccataccgtgaaatcgtgttcgatgggggtgtgcagccgtacccgagcaagttctacgacaacacgctctcgtgctactcgtactccaagtcgctgtcgctgccgggcgagcgcatcggctacgtggcggtgaacccgcgcgctaccgatgccgaactgatcgtgccgatgtgcgggcagatcagccgcggaaccggccacaactgcccaggatccagcgtgcagctggccgtggccaaggtggtggacgaaaccagcgatctttccgtgtacgagaagaacatgaacctcttgtatgacgcgctggtgcgcctcggattcgacgtggtgcgcccgggaggcacgttctacatcttcccgaaggcgcttgaggatgatgcgaatgcgttctgcatgaaggccaaggattacgacctgattctcgtgccatccgacagtttcggcgtgcccggctacttccgtatggcgtactgcatcgatacggaaaaggtggagcgttccatcgccgcattcgaaaagttcgtgcacgaagtctacggccgctgagccctgtgtgcgctcgctggaggaattcggacgcaaataagccaaaggggtgtgtatctgccttatatatggcagaaacacacccctgtccggagctatctcgcttatatatggcaggtcggttggctaaaacagccaaaaacgtacccccgaagtgctgttttgctgaggacgtctgccatatataagcgagataggcgttcttaagctgtgtggagtgtccgtttctgcagaatcggacgttcataggctggtttttggtgtttggatgtccgtttccggtgaatcggacagttgggctgatgtttttgggtcctgtttgtccgtttctgcagaatcggacacatgcggactgggggatggtgggttaggcggcctgggttgcggtttgggcggccaccgtcgcggctacggttgtcgcataggcgttcaacgctttgatggcacggtcgaccatttcgtcgacgctgccttcgatggagatttccacgccgttctcttcgggggcaagcggctcaagaatggcgaactggcttggtagtagcgcgggcggcatgaaatggcccttgcgttcgctgagcctctgctgaatgagcttgtggctgccgttgaggtgaatgaagaatgtgggcacgtttttggcgagcacctcgcggtagctgcgcttcaacgcggagctggacaccacggtgttttcgccgagcgcctcgcgtgccaccatccaggagttgatgacgttcagccatggccagcggtcctcatcggtgagtggaatgccggctgacattttgtcgatatttgcctgcgggtggaagtcgtcgccttccgcgtacacgtatccgagtcgttcatggatggcttctgcgacggtggatttgccgcatcctgcaacgcccatcaccactacgtgaatgctcatgttgctctccttgctattgacgatcctgtgccgctccgcaccaggaataagactactataaaccgtaaaagtagtatcagtcaaataaaaagtactacgaattggaaaaatcgtgtgacttgctatgctgaagatagtgcaaaatggcggtaaatcacgcaatcgcagatacgcaatcatctgcgattggtgattgccgtgcgtgtcgcagaatacgtgaaacataccgtgaaacaaagcaggcatggtgtgaagtggacaagggaggagcgatcgatggctgaaggcacggtaatcgcagaaaataccgtcggtgagctgatgcaggattcggtgagtcgaacgctcgccatcgaaatgctcgacggcgtgtggaaggctggcgaaagccttacgttggaagccttgcaaagtcgtttcggtatttccagaaccgtggcgcgagaagtcgcgaaaacactggaatccatgaatgcggtactcgtcaaacgtcgcatcggacttgttgcacgtccattcggcgaatggcaggcgcttaaccatcaggtgatcgaatggcgtctccactccacgcaacgcgaacggcagctgtcatctctcactgagctgcgactggcggtcgaaccggctgcagcagcttccgccgcacgtcttgcccccctcgacgtcaaggcgaaattccccgtgtatgcggcgcgaatgcggcagatcgccgaagccaacgaggaaggcgaagccgggcttgcgcaattccatgatcttgacgtggaattccatacgctgattctgcatgaaagcggcaatgagctgttcgccgcgctttccgacaccatcgccaccgtgctgcgcgggcgtgtggaactcggcaaatacccgatgaagccgaagtccgacgcgcttgacgcgcatgatgccgtagccgacgcgatcgccaagggggagcctgaacgtgcgcgcagcgccatgctcgacatcgtcgacgaagtggcacgtgccctcaatttcttctgattttcgcgccaaacttgctttcttcagtgaaaaatcgcaattgcgattactatgcggccgactcttgccatgcgcgacttttcagacgtaaggcgacatcggaaatacggcatgaaggcagctctgccaacgtttctttcggtgaatatgaagatgccggggaatacccccggcggcttggagccttccttgttgccaagagaaagcttcactattgcagcaaaattcgcatgcagaatcaatcagtcttggtgattggatttgcatgcgcagttgcaagcaagtgttactttacgctacttgcgggtggggtctttttgcaggagaaggaagatgagggcgacgatcagcaggattgcgatcgaaagcacgcccaccgaagcgttgccggtcagcgacgtggtggtcgcaacgaggaaagtgccgataatcgaagcggtcttgccgaaaatatcatagaaaccgtaatattcgttggcacgattctttggaatgatcttgccataatacgagcgcgacaacgcctgaataccgccttggaacaggcctacgagaatcgcaagaatccagaattccgttgcggaacgcaagaagaacgcggcaaacaacacaatgcagatataggcgaccacagccgtggtgatcatggttttcgcgccgaaacgaccggcaagcttgccgtacgcgattgcgctcgggaatgccacgaactgcgtgaccagcagcgccattaccagatgcgtagagtcgatgcccagctgcgtgccgtatgaggtgctcatggaaatcaccgtgttcaccgcgtctatatagaagaagaacgcaatcatgaacatccacaacggcttgttcttgcggattgcacgaaaagtggagccgagctctgcgaatgtgccgcggatggcctcaccggtctgacccgcggtagcgcggtagtgcacctgcttatagctggtgagcagcggaatggtgaacgccacccaccacaatgcggtgattacgaacgaagcgcgcgtgcatgccaccgtggaccatccaagcaacgacggaccgccgaaaatcagcgcgatacaggcgataaacggaatcgtggagccaatatagccccatgcgaaaccatgcgaggacacgcggtccatacgttcattcgacgtgatatcgaccagcatggaatcgtagaacgtgagcgaaccgttcaggccgaccgtggcgagaatgcacaccaccaagaaaacgagccagctgagcggcaacgccatcgcacagcaggcgaccacgcccgtcaggaagaatccggtaaagaacttcaccttcatgccctgcacgtcggccatggatccaagcacaggcatcatcaccgcgatgatcagcgacgcgatggtctgcgcgtacccccatgtcgacacgatattcgattggccggcggactgcagcagcgagtttgcgtagattggcacgactgcggtcgacagcatcacgaatgcggaattgccgacatcgtagacgatccacttcttttcgcgggtggtaagttttgcgttggggtccggcatatgctctggggcagtctctgtggccatgtcggacgtaggtgcggatgcgggcgctgttgcgcgttcggacatgattgttgactctttcgaataaaccgtcaattcactattgtatatactacagttcatcttaagcggctgtaaggggagcgctctgccgttacgcatgaacattgcatgaacattgcgactgatgtgtgatcgacataaaaaatctgaaatatcgaaatgctgcaaataatactgggaatactgaaatgacggagatgaacatgtgcagattgtagattgcatcatctgtatgttgatgtcgtatgttgatgtcgtgaaaaacgttcgcagaacggtatattggaacgtgtcaaaatactgggaaaacacgaactaagtttgctgtgtgtgactgccgccgcgctgttgcgtcggcatatttctgcgaagagtcgaggagtctgtatgagtggggaagttccggacatgcttggtgcgaacgctgaaatattgtgctcgatattgagccagccattgcctgacacgcttgacatgatcatctggcgtggcgtcacgaactccgcgcaagcgtcgccattcgaacgattcgcggcacgacttttggtggaagccggtgctgcgggcatccgagacattgctgccgaaaacgattttgatgtgatccgactgagcacgacgaaacgattctggctgcgctgcaacggcaacgatctttccaatgaacaattcaatgttgtgcaggcggtcgaatcggcgcttaaccgcatcgactatgccgacgacgaagcgcgcagggcggtgcacggaggtatgccggaagcgtgcatcgacgaaaacttctatattgcgaaatcgcaacagtatctgcgaaacgtgtcgggtgcgatcgtggcaatcgacggtctgcaggaaggtgaaaacaacttccgtagaatgaggggtacggaaggggcgcgcggcggaaattgggatatcagcaccagattcgccaatgtttgcgaaaatctcgaattgcctttccgcttgcattaccgatttgacgtcgatgcgtccagcggcgtgatggtagtgcgtttcagcataccgaacacggcgatcatgccggttgcgtcgcaatatcgcgacggattcgcctctgcgtatgccgtgcgattggcgggcatgcttgcgtgggcggcgttctcgtcaagcgtacgactgacgcaagtcgatctgaccggttgcgtgggggatgctgacggcattcccgtgatttccatgggattcgatcgcgtgccattcatgatgggtgcgctgcctgccatgaaaaacggacaatgcgacgtggttccgttggatgtagatccgctggcgctgctcaatttgctgcgcccggtgcgttatgtgggtttctttgatgggaaccgtgccctgacgccaatcacaccgctggcaacgtcagccgtattcttggagaaacgtgtttccgaatggcaggatcaacgtgcgctgcctgaaggattgcggggattcctacgtgccgaccgtgcctgcgaacttgacgtgatgcatgacgaatcgccggtttccaccgatgatgtgaacgcgatcatggaagaaaacgaaggatcccccatggtcgccgaactccaattggaagccgcgttggtgcaacttggcgaaagcggtgaagcaggtggggtgtgcgaagcgggcggaactgacgagacaggcgtagcgaaaattggcgaaaatggcgaaattccgctctactgcagccgtccaggcgtgcgactcatcatctccctgctagacggcgacgaacacacgcgctactggaaactgccggatgctgtagtcgacgtacaccagaatcttggggaactcgccaaaaacaatggcgactatgagcgcgcggaacgtgagctgcgcgcctgcatcaaacttgccccaaccagcgtacgtttctacgaggaactatcgcaggtatacgcaagaaccgacgaatacggcaaagcggccgacgtgctcatcggcgcgttgaaaatcgcagtgctgcctatcgattgcgaagtactctactatcgacttggctacgcattgtggcagttgggacgtctgccggaagcgctcgcctgctatgcgatgatggtcaacggcggcacgccattccgtacggccgcgcgcgatgaggccgaagaagtgagtaggcagatgggattgccttcgccggatatgaaatatggggatgcgtgcgatgcgctgcgatccggcggcgtgccggttgcgccggaagacaaggtgttagatacgattgcccgcgccgcgatttgcctgacggatgctggtttcccgctactggctcaggatgcggcttggatgcttggaatgcgcgatggcggtgatgtgatcggcgcggttgcgatgagcctgcgttttggagccgaagggcgttcgaagaactagcgcgacgacgccgggtggggtgtgctgggcggtttgactggctggcggctcgggctatgactggctggcggcgtctatgcgcggggcaaatggtggtttggatgtgctgtctgccgacctgacgcatgttgaccagacagcggcattccggggaatttaaggcgattgctatccacaaatttgcgattggctggggctggttgtatagttgagaagttgtgtgttctgccttgcattcagttgcggggcatcgaacgcgcagacttgcaagtcaatagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtcaagtgcatcaaggctggcaaggttcagcgcgttgaagcgtgaatcgcgaaataacagcttgaaaccccggtagaccaatggtcaccggggttttgctttatcttgatcccgccagggctttaagcgttcggatttctccactcgatggagaaatcttcccgcttacagtggcgtttgcgtccgtattcctccagcgagtggggaatttgggcggtttgagtcgtacccagtggtagaagccgcatctgtcggcataactggggagaatggtgcgttatgagcaccacactggaaacaccgatttcatcaatcgagagcaaccgccgcagagtcggcgcgctgaaatcgcttggtgtggtgtcagttggcgacgccctgacctattatccgttccgcgtaaccgatccggttcctgcgcgctcactgcatgaagcgaaaatcggggagaaaatggcgttcgccgcgcatgtgctcgaaacgcgcgttttccccatggcacgtcgaggcttccgcctgatcgcaacagtcacggacgacgatttcgcagcgcgtcgcaacaccccaaaatcgttggcgtcgctggtcttcttttcgtatcgcaaatcgtatgttgactgggtgcagcgcaaactgcacgcgggagcgctgctcgtcgtcgcaggcgagccaagcgtgtacgacaatcgtctgcaattcacgcatcccgacctgctcaccatcaatcccgtgcaatcgcagtcggaaaacggggaatggaacgacggtttcggcgatcctgcgaatccgcctctcggcaatctgaaatacgatgcgcaaacgatcgacgaagcgctgaaacgagtttgccgtccacgaccggtatatcatgcaacttcgcgaatttccagcgaacatattcatgaatcggtattgaaatatatggatgcgttgcgcggagccgaatatttggcaacgcaaaatgcagggaatttcttagataatcctacgcaagaaggggattttgatattccccaaattgatcgagaaatacagattaaagtactcggtaatgctattcccgatattattccggaagattttcgtgaggaatatgggcttatgcatcgtgctgaggcattcatggcgattcatgatccggttgatcgcaagaatttcgataacgccttgcaaacgttgcgatatgaggaagcgctgatctgccagaccgcgctcgtcaaatcacgcgatgcatcgcgcaaatccaaggctaccgcatgccctgaaacgcggttgaaagacgatttcatcgcgtcgctgccattcgcccttacgaacggccaacagcaggtcatcgccgatatttccgccgatatggcgcacgattaccccatgcaacgattgctgcaaggcgaggtcggttccggtaagaccgtggtcgcggttgctgccatgatgcaggccgtcggatcaggcggccaggccgtgcttgtagcgccaacgcaggttcttgccgaacagcattatgcgagcatttccacaatggtatccaaactgggaaaaagcgacgcaaattcgagtgataatcaaaaaaatctagatgatgccaatgcgcggcgaagcaataaacggtccgcgcaaagttcgaaagatggggaattcgacgcaaaaacaattcacaataatgctgtggataaaggtgtacaacttgcagaccttcttgatttggccgcatctgatgatgtggaaaccggattttccggcaaaggaaacgatatatttggcacaaaagatggggagattcctgtatttcttctcacgggaagtatgcgacttgccgaacgtcgtcgcgtgctcgcagcagccgcatcgggcatgccctgtatcgtcgtggcgacgcacgccgcattttccaagagtttccaggcgccgaaccttaccttggcggtgatcgacgaacagcaccgcttcggtgtggaacagcgcgaatcgttgaattccaagggttctacggcgcctcatctgttggtcatgacggccacgccgattccgcgcaccgcagccatgacctggttcggcgatctcgacatttcctcgctgaccgaacttcccggcggccgcaagccgattcgcacattcgtggtgccggaagacaatgcgtcgttgatgggcgaaatgtttgccctgattcgcaagcgcatcgacgcgggggaacgtgcctacgtggtctgcccgcgcattgacgccgatgccgaagatgcggacggcgcgctggcggcgtcagcggcttcaggctcgaaaaccgcaggttcgtcggccgcggcttttgacgacgcctacgatcttggcgaagacgacgaacagcgcgcacaacgccccccgttgcattccgtggcggaaatcgtggagcgtctgcaatcgctgccgcagttcaaaggcattcgattcgccacgttgaccgggcgtgacgatgacaccacaaaatcgcaggtcatggccgattttgaatccggcataacgccgattctggtggcgaccacggtgatcgaggtcggcgtggacgtggcgaaagccagctgcatcgtgattttcgatgcggaccggtatgggctttcgcaattgcaccagttgcgtgggcgcgtcggccgaggcggcaccgattcgggggctttcctgatttcgcgtgcgcccgcggacagtgatgccgcccgccgtcttgacgtgattcagggcacgttggatggtgccgaaatagcgcaggccgatttggaattccgcggcgccggcgacgtgctcggcgacgcgcaatctggcggaaagtcaggtttgaagctgcttcgtgtggttaaggatgtgaagattattgagcatgcgcgggttgaggctacgaggcttgtcgctcaggatcctgatttactcgaacatgtgcagttggccggggcggtgcttgatttcacgcgcggcaatgaaacgttcctgaccagtaattagtttggtgcgattaattaatcgcctggcacgctagagtggtgcgtatgcgcgtaatttcaggacgattcaaaggcgttgcattgaccacgccgaaagcgggcactcgaccgaccaccgatcgcaccaaagaggcgattttctcgcatctcgattcatggggagtgttggacgatgcccgcgtgctcgatttgtttgcaggaaccggcgctttgggtatcgaagcattgagccgtggcgcacgagagctggtggcggtggaatcatccgctccggcggccgcattgatcgcgcagacgctgaccgcgttgaaacataaccgttcgtgggaacatggcatgagtgcccgcgtggtgaaggctcgcgcagaaaaatacgcggcttcagcttcggccgttgaaccgttcgacatggtgttcatcgacccgccgtacgccttcgaaacgaatgattgcaaccagctgctcgccgatcttgccagccgtgaactgacttccagcaacacggtgatcatgctggaacgatccacccgttccgaagagcccacggctccagaaaactgggaaatcaccgatcggcgcgattatggcgaaaccgccgtctactacattgaacccagcgagccaatctcagataacggtcagcaataatcgcaagaaaaaacttgcgattattccgcgtaaaaacaagcgtttaaaagctagcgtttgcgcggatgggcggcggaaacctcccaaccgagcgccatcaaggtcttgcgatcggccttgtcgagcttggcgcaatccaacgcttcgatcaggtcgggacgcaactcattggttttctcgagcgcctcatcgcggcggaaacgatccactttcgcatgattgccggaaagcagcacgtccggaaccttgatgccacgccattccgcgggcttcgtgtactgtcggtgctccaacagcgcgttctcgcccgtatacgattcctcaacaatcgaagcggcattgcccataaaaccgggcagcagccgcgtgatcgcctccaacatgaccgacactgcgacctcgccgccgttcaacacgtaatcgccgatcgaatattcgcgcacgtcaatgccttgcgcgcggtaatactgcggaatgcgcgcgtcatacccttcgtaacggccgcagccgaacagcagatgatcggcatggctcagttccgtcgcatcctgttgtgtgaacagcggggcggaaggattcggaaaaatcagcacaggacctgcggaagattgtgcaatatcagttttttcggaattctcaggaccttcggaagattgtgcagtgtcggaatctgcagtatcgcaagaattgccagtatcgaaggaatccgcagaatcctcaatattttccgtattttcgattaccgcaggctcaagctgaagcagctcgtcgaggcattcgctccacacttccggcttcatcaccatgcccgcgccaccgccgacaggagtgtcatcgacggaatgatgtacgtcgtgcgtccagtcgcgcagattgtgcgcggtaacctccacaagccctttcgactgcgctttgccgagcagactgaggttcagcacttcaaaatattccgggaaaacagacacgatatcgatcttcataatgttcagaataccgggatgcctgccaagtgacaggaaacataaaaagtgggcactggattccaatgcccacttgaatggatatgtgatcgaaagcgcgtaatcatgaatgcttacgcaggatcgcaaacgatcacagacccggaataagacctccaggcggatcgagggtcagatagccctcttcaaggtcgatgtctggcacgagctcgtccacgaatggcacgagcgcgctgttctcaaccacaacgccgtcggcatccttcaccggattggcgagacgaatcttcagcagccattgggccacttctatcacgtcaacgactttgccgaccaccacgcccggttcgagaccaagcatattgtcttcagccagtcgcgcctcaagaccgatgaggtctttcggataccactcgtcggcttcaagcatgtcttccggatcgtccgcctcgccatacagcacaatgccgttggccgcttcggactggtcgcggttgtcaatgccttcgaacttgatgatccaacggttcttgaaagtacgggagttctccaccacatactcttcttcgccgtctttcgtgtacaacacagcaccgggagcgaaccggtattccggttcgtccgtaaagatctgcacggtgacttcgcctttgagcccctgcgcacgcccgatacgacagaccctcagcagctcgggctgttgagggtcgtcagaatgcatatcacgcaccacgctaggatctcacctgcgcacgtccatgatgtcgacgcgcaccttgtggtcggacagtgcctgcaccacggcgcgaatcgcatttgccgtgcgtccgctgcgtccgatgacgcgaccgatgtcttccgggttgacgcgcacgcgaatgagttcgccacgcgcgttctcatgggacttcaccgaaacgtcgtcgggaaaatcgacgatgttcttaatcagatgttccacagcctgggcgagcatgatcactcagcttccgcagccggctcttcggccggagcttcctcggtagcggcggcttcggcttcagccttggccttggcgtcagcttcggactttgcagccttcagcttctgagcctgagcctcaacggcctcaacgcgagcggcggcatccgggccggcctcaacggtcttcagggtgccttcagcaccgtcaaggcccttgaacttctgccagtcaccggtgatcttcagcaggttcagcacctgctcggtcggctgagcgccaacgccgagccagtactgagcgcgctcggaatcgataacgatggtcgaaggctgggtgttcggattgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtataactaggggtgtgcgtttcgttttctgtgtggggcacggaatccgaaacccacatgttcctcacgtcacgcgatagttagagggcctcgcgcgcgcgaataacttaccaagtataaccgtggggtacggacggatgggtcttaggatgtttcccgctctatgcgactttccgaatccgtgcaaaaccgggaagtcgtttgtctgattctgcggaaacggtcaattatgcggcgaatgtgatgccttgaatgaccgaatcggcagaatcggacatttgctggcattcgtgagatgtttgcgtgggtctacatggcggaatcgtcggaatcaggcaggctggctacacttggaggttccgagtttgcgtatgtccgttcggagtgaacggtttgcatagggggagttgcctgaatgattatcgcgctttggattgcgttgattatttgcgttgtatggattgcgcttggcgagatgccggctggttgggatggccatttgccgctgccgtacttgattgcgttgattccgttgctgtggattccgacgcttgtgatcgccgtcgccggtttcgcgttgcatgagccggctctcgggggagtcgctgcggtggcctgtcttgcgtcgctgctacgcaaaatcgcatattggatggaaaatcttaattctcccaatactgcgcagagggttgccgaaaaacttgcggaaaagcgtgaaacatctcgtgaaacaggcaatgaagctgttacggaatccgcgaaacatggccgtttccgtgtgatgacgctgaactgccgatttggtcgcgccaacgctgcggcaatcgtcagtgcggtcaaaaaacatgatattgcagtacttgcattgcaggaattgacggacgatctggttgcgcaattggacgcttcgggattgtctgatttgcttccgtaccgtcagttgggggagaacaaggggacggacaatggcggattcaacggtgtgtggattcgtattgaaccaagcgacatgtctccggtcactgcggtgattcccgcggccgacgtgccgggcgtgtgcttcccgatcgattcgatgcgcggcatcacgtttgtttcggcacatccgaagtctccgatgcgcggatgcagggaatggtccgccggcatcatcggtttgggagagttggcgaccactcagaagcagggcgacatcaccgttgtgttgggtgatttgaattccggtaccgatcatccgagcttccgcaagctgctggatgcgggcttcaaggatgcggccttgtgcgaggcgaagggccgtcatgccacgttcccatcatggctgccgtggccgcgcatcattctcgaccatgtgcttttcaccaagggattggacgcttccgacgtgagttcgttctgcgttgaaggtagcgatcatcttgcgcttgttgccacgttgacgttgaagtagttgatggcgattataaggtagtcgattcagctgaaaacagctgattggagtacgcaaaaaggggatgcgattcgtcttgaatcacatcccctttttatgcgttaccgttttcgcgtcgcttgctttagtgcagcaagccggacagtccgccgccaaagttcggcggcagctcaccggcatcgcccatcaagtcttgcaatccggcgggaagtgcaggattctgcggcttcttggcaaaagcggaaccgccggaagacttaccgtcggagttcttgccggcaagcttgtcgcgcaatgccttctcttcagcctcgcgcttcatcggattgccggacttaccgcccttcttcttgcccttcttgcctttgcccttgcctttgcccccgcccatggcagggccgccaaagccaggcatgccagcgcccgccttgttgctcatacgcttcatcatcttcgcggcctgctcgaaacgctgcaacagcgcgttcacctgcgaaacggtcacgccggaaccgtaagcgatacgagctcgacgagaaccgtcaataatcgaaggatcacgacgttccgcaggagtcatcgaacgaataatggcttcagtacgatcgatttccctctcgtcgaactgctcaagttctttacgatgcgcggccatacccggaatcatgccaagcagattcttcatcggaccaagcttgcgcacctgttgcagctgatcgaggaaatcatccaaaccaaaggaaccatcggaaatcttgatggcggccttacgagcctcttcctcgtcgaactgcttctgcgcctgctcgatcagggtaagaatatcgcccatatcgagaatgcgggaagccatacgatccgggtggaaaacctcgaaatccttcagaccttcgccagtggaagcgaacagaatcggcttgccggtaacggaggcgaccgaaagcgcggcaccgccacgggcgtcgccatcaagcttcgaaagcaccacgccggtgaagtccacgccctcatcgaacgccttcgccgtctgcacggcatcctgaccgatcatcgcgtcgattacgaacaggatttcgttcggctgcacggcgtcgcgaatatcgcgagcctgcttcatcagctcttcgtcaacgccgagacggcctgcggtatcgatgatgaccgtgtcgtacagcttctgcttggccagcgcaacagcgtcacgcgccaccttcaccggatcgccggtggtcagacccggggaagcaacggcttcgccaccgtcggactgcacgcccttttccggagcgtacacgggcacgcctgcacgttcgccaaccacctgcagctgcgtcactgcgttcggacgctgcaaatcggccgcgaccaacagcggagtgtgaccggaatccttcagccagtagccgagtttgcctgcgagggtggttttaccagcaccctgaagaccggcgagcatgatgacggtcggcggattcttcgcaaaattcagcggtcggtcaacgccagcgccaagcacggccgtcaactcttcgttgacgatcttcacgacctgctgggccggattcagcgcctgggaaacctcggtgccgagcgcacgctcgcggattcggccggtgaaggaacgcaccacgtcgagcgccacgtcggcgtcgagcagcgcgcggcggatttcgcggatcgtaccatcgatatcagcctcggaaagcttgcctttgctcttcagatgcttgaacgcattcgagagcctatctgtcaaagaactaaatgctgccataatgtccctcagtctagccgtcccgcgggaaatttcgcattccaattaatggtgttgatgatgttcggttgatattcggtgagatgcttgatgctatttgcatgagaaatggaaatcccgtctcttccaataggagaagacgggattattgcttattaagaacgctgcggattatttgagggtccaggtgggaccctggggagtgtcttcgatggcgattccgactgcgcccaaggcatcacgaatggcgtcggcgcgggcgaaatccttggccttgcgggcttcggcacgctcctccaactgttcggaaaccaaacggtcaagcgcagtatgctcagcggaatcggcaccggctccggcggcgccgccggccgtaccctcgcttacccacggttccgccaacggatccaaaccaagcgtatcgagcatcgcacgcacattcaccaaaacagcgcgaacttcatccttcgcaacatctgaatcaacacgatcggcaagcttcgaaagcaacgtgttgccagaacgaatcgccgtgaaaatcgcagcggaggcgccggaaacattaatatcgtcattcattgcggcgacgaaatcagccggcagctcatcggcggaaaccgaaacgatctcctcacgggacggctgcccgccaacggcggcaccggcacgttcgatgaaattcgacacacgatcgtacgcggactgagcctcggtcaacgtctgatccgaccattccaacatggaacgatactgcacggaaccaagcgcgtaacgcaccacccaagcggaattttccgccaaaaccgccggcacggacaagccgttgcccagcgacttcgacatcttctcacccttggcggtaacccatgcggaatgcatccaacgagccgccgaatcgtaaccggcggcacgagtctgcgccatttcgttctcatggtgcgggaaacgcaagtccagcccgccgccatgaatgtcgaacatatccttcaaatagcggtggctcatcgccgagcattcaatatgccaacccgggcgacccgtgccgaacggagtattccaacgcgcgtcaagcggatcggaatccttcggagccttccacaatgcgaaatcacgcggatcatgcttgtcttccgacatgtccgcaggatcaaccggattgtacttgtcgttgcccgtattgtcgacagacggacccatggcatcggccacctcggaagcggcatcggccacagcggtctgcttctgatgcgtcaactcgccataatgaggccagctggcaacgtcgaaatacacgttgccggtcggattgccgttctcatcagtcaccacgtagccgtggccattgtcgatgatctgcttgatcagatcgatcatgtcgatcatgtggccggtcgcacgcggctcatacgtaggcggctcaacacccaacgtgttgtaagcctcagtgaattcacgctcgtaaatgtacgcgcgctcccaccactgctgaccggcggccgcagccttatcgagaatcttgtcgtcgatatcggtgacattgcgcacgaacgtgaccttgtagcccaaacgctcgaaccagcgacgcaccacgtcaaacgcgacagccgcacgaatatggccgatatgcggcgagctctgcacggtggcgccacacacgtacatgccgacctgaccaggcttgatcggcgtgaaattcgacacggcgtgcgatgcggtgtcgtacagcttcagatcggcagcggcgctcgccactgcgtcaactgcggttgcgacgctagaaatgttgatattctgcggttcttgcgtgttcgtcataaccacgagagtattgccagaatcggacatgcatgcgagatgaaaatgaacggcaaaacggtttttgttggatttgtgaacatcgtttacgtaggtgatgcaacaatagaacgtatgacgcaatcgcaggtgctgattttgcaacacgttccgtgggagagaccgggacgcattttagacagtctggatgatttgggactgcagtatcaaatcatcaatgtcgccaagcagaagaaaccggatttgcctgattttggcgaggtttccggcgtggtgatcatgggcgggccgatgggcgcactcgactacgacaagtatccgggattaaaggccgaggccaagctcgcgcgggctgcggtcagtgtgggcaagccggtgttgggcgtgtgcctgggacatcagatcatcgccaccgcgctgggggcgaagctgaagtcgggagaggcgccggaaatcggttttgcgccgattaaatgcatcgacaggcatgattatttctcgatgtggaacaaaaccgtggatgtgctgcactggcataacgacgtggtgtcgttgccggagggcgcgcagccattggcgcgatccgcgaagaccaaggtgcaggcgttccgttttggttccgctctgggcatgcagttccacttggaggttacccctactctgttggaggagtggcttgacgagtcaagcatggtcaaggatctcaaggctgccggcgggtcgaaatcgcagttgcgcgaggcgttcgccgaatataatccgcagttgcagccgcttgcggatcaggtgttttcgagttttgccgctcgttgtaattcgtatgggcagaatttggctcaggcgcagcagggctgatcgccgagttgcgtgcggttccgattgctgcgtagcgctggtggcgattcgcaagttgcggcattgcctgcaggtttgggagatgttcccgctacattggtgacttatgccgacttatgatttgggacttgaacacgtttcgcttgcttttgcgaccaagaatattttcaacgatgtaacgcagggtgtttttgaaggcgatcgcatcggcatcgtcggtaagaacggcgacggcaagtccacgttgctgcatttgttcaaaggcacgcaggagccggattccggtcgcgtgaccattcgcggcgggcttacgttcggcatgctcgaccagcgtgacccgctcgacgacaacgccaccgtgcgcgaagctgcgctcgaaggccgtgaagactacgaatgggctgcggaaaccaagtcgcgcgaaatcgtcgaagcattgcttggcggcatcagcttggaagcgaaaatcggttcgctttccggcggtcagcgtcgccgcgccgatttggcacgcctgttgctcaaggattgggatattctcgcactcgacgagcctacaaaccatttggatgtggtgaccattcactggctggcggaacatttgaagaaccgttggccggccggatccggcgcgctgctgctcgtcacccatgaccgttggttcctcgacgaagtgtgcgaatccatgtgggaggtgcatgacggcgaaatcgagccgtttgaaggcggctattccgcatatatgctgcagcgcgtggaacgcgatcgccaagccgacgtgcgtgaaacgaaacgtcgcaatctggctcgtaaggaacttgcctggcttacccgcggtgcccgcgcccgttccaccaagcagaaattccatgtgaaggccgcgcgtgagctcatcgccgacgtgcctccggtgcgcaatacgctggaattgaagcaaatggccacatcccgcttgggcaagcaggtggttgacctgatcgacgtgacgcagattttcgaacatgtgcaaggcgaggccgatatcgatcctgacgttgccgacatggaagcgtcggcatcgcgcgtcgatgtggtgccggccatgtatgccgagccgcaagtgcatggttccgtggaagttgccgtcgacgatctgactgatccgcgattggtggatgccggtgttgcagcggcgcaagttgctgcagctgcgaaagaatcgcaagaaattcaggaatcgcaagaaaataatactgatgattctgcagaagaaattacttctgcagcgcaaaaaattactgttaccggtcgtaagattcttgacgacgtgacatggctgattgggccgggcgatcgtttcggcatcgtcggcgcgaacggtgccggaaaatcgacgttattgaagattcttgacggcacgatcacccccactgtaggtcatgtgaatatcggcaaaaccgtgaaattcgcggtgctttcacagcgtctcgacgaattggagaagctcggtaaatacaagatcaaggaagtgctgagccgttacaagccgagctatatcgtggacggcaaggaaaccacgccggggcagatgatggagcgtctcggattcgagtcggcgcagctgatgacgccgatcaaggacctatcgggtggtcagaagcgtcgtatgcagttgctgctgatcctactggacgagccgaacgtgctcatcatggatgagcccggcaatgatctcgacaccgacatgctcgccgtgatggaggatctgctcgacacttggccgggaactctgatcgtcgtctcccatgaccggtatctgctcgaacgtgtcaccgatcagcagttcgcgctgatcggcggcaaggtgcgccacctgcccggtggcgtgcaggattatctggacatgactgaggccatcaagaacggcaaggatccgtttgcggacgaaaagatgggtgccggcaaaggtaagaagggcggtttcgctgggactgccggttccacgaccggaggcactgcaggcaactccgcaagcgggtccgcgactgccgaagccgcatcttccgcatcttccacaccgaagctttccggcaaggccttccacgaagcctccaagcgcgtatcggcaatcgagcgcaaactcgccaaactcgaagagcagaaagccgatcttgaacagcaaatggccgcgcacgaccccagcgactacgagggcctaggcaagctcaacgaccagcttcaagccgtcaccgacgagtccgaagaactcgaactcgaatggatggaactctccgaacagctcgagtagcattcgtaccgcccgcgccaattaccggacagggtgtgcatgttgtggcggcggcgcagctcctccagcgtttccggtgaatgttggccattcgtgcgacagcgatgcgtggcattccatgtgccaatgtcatattcttgttattgcaggaaaccttagctgttcttgtcggagagaccaatggaggtgccttatgaatcaagtgatgcgaagaagcgcctgttgcttgttgtccaccttgttgttgtggtcatgcgttggctgcgcgaaagctgcacatgaaagttccggtgatggctccgcacagagcagcagcgagaatgatgatgccgcaaaacaggcatataaagcatttactgtggacgctcttgaccgcgttgccgtcgatgaccttaatgattcggatgaactggttctagtaaacaagttgggtgcgaaatccgtacatggcgatgatgctatttcatttacaaaaacagttgatgacagcaatatgtattatgtcatctccatgtgtaagcagaaggagcaagctccttattcgcttgttctctacaaagatggacagccacataccctaaccactagggaggcctgtacatctaacggaatagaaacgatctctcttcaggcgaagaatttcccagatgccacctcattgtccattatcaatatcggcaatacggatcttgttgtttccgtatatgaagtaaaggaacaccatcatgaataatttcagtcataacgctccctgtcgtcctgccatcatcatagtttgtggcatcgcgataatgctactgggctagttgctgcaaaacttgctgattaggtagatggggtagtaggtgatgttgtgatcggtctcgatgttgccggggccgaaaactaatccttggtgaaggtgataactttcctctgacaacacattattaagagcccgatgaaccttgtttgatatcttcttgcgcctggcgaacgtctatgagactgttgttttgcgcaaaagatgctactgcagctggcatgtctccaatgatcagatattttctgaatatcgcagatctgacaacaaaaagggctttcccgcgttgaaacgggaaagccctgtaggtttgggattaggctgattggatcagcgaccggtgatttcggagccgagcaccttttcgctcaaggccttcggaccgcgcgtcactgcgaccgcgccggaacgaaccagctcgataatgccgtaatgctccaaaagccccagcagcgcatcaatcttgccttcggcaccggtggcttcaatggtcagcgattccggattcacatcgaccacgcgcacgcggaacagacgcacgatctcaagcacgtcggaacggttggattcgtcggcagctaccttgataagcaccagttcgcgctccacagtggtgttcggatccaaatccacgattttcaacacatgcagcagcttgttgagctgcttgatgatctgctcgagcggcacttcatccacgtcggcggtcacggtgacacgcgaaatgtcagggcgctcggtgggggagacggacagcgagttgatgttgaacgcacgacgggcgaacaggccggcaatacgcgccagcacgcccggacggttctctacgagcacggaaagcgtatggcgcttggaacccggctgagatgcaggatacattggtagacccttccttactacttactcgtttgctcgtttactcgttgtcggcagcggccttcgggcgctgcagcggcttgattccgggcatataggtgacattgtcgttggcatcgccagctgcgaccatcggccataccatagcgtccttccacacgcggaaatcgataagcaccgggcgatcgttgatttcgttggccttcttgatcgcttcaatggcttcttcttccgtgaacgcgcgcatgccgacacaaccgtacgcttcggcaagcttcacgaaatcaggaacatccacgatttccggcgtattctctccatccatcagattggtggcggaataatgctcgccgtagaacagggtctgccactgacgaaccatgccatacacggaattgttcagcagtgcgatcttaatcggcgtgtgatcgtggaacgccgtcgccagctcttcagaagtcatctggaaggaaccgtcaccgtcaatcagccacaccggcttctcgccctcatggaaacgttcggaaccaacacgagcgccgatggcggccggcagtccgtaacccatggtgccgaggccgccggagctcagccaagaatgcggcttctcgaaatcgatgagctgcgtggcccacatctgatgctggcccacaccggtaacccaaatcgtgtcaggatcggccaggtcggaaagctgcttgatgacccactgcggagcgagcgaaccatcggtcggctcatcccacttgatcgggtacttttcacgccaatcgttgatgatctcccaccaatgcgaagtgtcaggcttgccatgcacggcctgctcgcgcttgatttccggaatgagatccttcagcacggttgccacatcgccaacgatcggcacatccggctgacggttcttgccgatttccgccggatcgatatcaatgtgaatcacacgtgcacccggagcgaaagcgtcaagcttgccggttacacgatcgtcgaaacgagcgccgatcgcaacaagcagatcgcaacgctgcacggcaccggtagcggcaatcgtgccatgcatgccaagcatgccaagcaccttcggatcggaatcaggcacaacaccgcgtgcgggcagcgtggtgacgatcggagcgttcgtgacttccgccagctcctgcacgagcttgccggcatcggaacgtgccgcgccgccgcccacatacagcaccggacggtacgactgctcgaacagcttcgcagcgtcggaaagcacacggccgtgcgccttcgtggtggggttgtagccgggcagaatcatgcgctgcggccacgaatagtacatatcgccggtctgtgcggttttggtgacgtcgaccaccaccggaccagggcggccggaacgtgccacatagtgcgcttcagccagcacacgcggaatgtcctgcgcacgcgtgaccagataggagtgcttgaccaccgggtaggttgcgccgacgatatcggcttcctggaaggcgtcggtgccaatggcgttcacgccgacctggccggtgatgaccaccatcggcacggaatccatgttcgcgtcggcgatcggggtgatcatgttcgtggcgcccgggccggacgtgacgatgcacacgccgacctgaccggtcgatacggcatagccttcagccgcatgacctgcggcctgttcgtggcgcatcagcacaaaacggaagctggtttcatcattgattgcatcgtataccggcagaatcgcgccgcctggaacgccgaaaacatccttgacgcccagatcttccagcgaacgtaccagcgcttcggcgccggtcatcttctcgccgtcaacaatggtctgcttttcagtggttgcggctgccttgggcatgccgctgaatgcctgcaggggcgtaggtaacaccatgttccctctcatactcgctcgtggaactttcttacaggggtatgctgccgcgtttcggtgcacgcaatcagccgaaccccatcatcggaaagcggcgcaatcgcttgtggcgacttgcgaatcgcaatccttcgctagtaatcagtctatgctatcggctgacaggagaatatgccggattcgtgccatattctggcgtattgcgttccgcggcggtatgagagggcggattcgtagctgcttgttatctacctgcgactacttactggtgttttcgccgttgctgccgttactttcgttgccgttgtgcttgtgatgatgtttgcgatgcttacggacgttttgtgcttcaggcttgcgattgtccagtgccttccaaccttcttcggctgcggcgagttgcgccttgcgtttgctggtgcctgtgccggtgctgatgatttcgtcgctttcgcccagcatgacgttcgcagtgaacacttgcgcatattccggaccggaaaccgacatctggtagcgcggttcgccgaagcccatgccatgcgctttgacggtaagcgaggttttccaatcgagggctgggccttccgtcgcgacttccgcaagcgtttcgtcaacaagatgatgcacaacgcgacgtgcctcgtcaatgccatgctgaatgaacgtcgcaccgatcaacgattcgacgatatcgcacagaatcgagcttttatcagcgccgccctgatcgctttcgccatgaccgagcagaatgtacgggcctgcattgagcttttcgcgagcgattttgctcaaggattcctcggaaacggctttcgcgcgcattttcgcaagctgcccctcgttcatgtcggggtgtgccttgtacagggtttccgtggagacgagctcaagcacggcgtcgccaaggaattccaaacgttcgtagttttttgcgcccggattctcgtgcgagaaggagcggtgggtgagcgcttcgaccagcaggtcgggttcgagcgtggtgccgagcgcttcaagcagtgcgttggcggtcatctcgccttcggaaacggcggatgcgtcggcgttgttctgggtcataatcgtcctcggtttcgtagtgggtatgcgacggcgaagctcgccgcgctgttcgggacgttgcgtacgtggcaacaagccagcgaatctggccgattgctatgcaaacaacgatcccgttcagtctactctccacccatgtcgaggcggaaatgcagggaaatgcgcggatactaggtggatacgatacttggcggatgcgaggtgagatggttgggtgcatgcgaatgcatatggccaagtgcgcagcctgaaatatacaaaaccctgccacccgtcgatggcagggtttcaatgcttcatgccgttactcggcagccactcacttggtgtggatggagcggacagcctcgcggtacacgcggccgcggtaggcgccgcagctcgggcaggccatgtgcggcagcgccggagcgccacagttcgggcaggtaacggtctgggcggccttggccttccagtttgcgcggcgagaatgagtattcgcgcgcgaggtcttgtacttaggcagtgccattgtgtttcctctgtttcgttcgaacgattgagcttaagcgttcagtatcttaacttgtgctccgtacaaattgcaaaaaccgagcaaaatcagccctgccagcacccggatggaccttactcgttgccttccagccgggccttcaagccttccaaagcggcgaaacgaatatcggtcacatcgtgatgatggtccggatcctcgttcagatcggcgccgcactgagagcacaatcccaagcaatcaggcttgcacagcggctgcaacggcagttcctcgaccaacgtgtcgcgcagaagcatctcaatatcggcccaggatccgccttcaagcagcggatacgaatcctccgactcgtcttcgccggcgataatgtcgacttcctcttccttgacgccgcccttgccgtttttgccgcccttgccggacgcaacgcttgcggacttgtcttcatatgggaagaacgaagtgacgttcaccgtccaatcgcgcttgatcggtttcagacagcgggtgcattcggcgtgcacgggggcactgatgcgggcgttgaaaatcaggccgtcgacaatggagtcgaacgagccgacaacggtcacatccgcaccctcctcaacgccgacgatctcatcgccgatgccgctcggtgcggggaatgttgcgtcgatctccttgctttgcccggctcgcgaggcgacttgcgccacggaaatcgcccacggggaatcttcgatacgtgccatgttcagccttccattcagctttccggatagtcgtttgcgtcaagatgcggcacatgcgtgctcgcttcgcgctggcgatcatacagtacgttcaatcccgcctgcacgtcgttgccaagcttgccgagctgctgttgcagcgtttccatcaccgtggtgcagtatttgtcagctccctgcgtgagatggtcggccctggcttgcgcttggtcgagaatagcacgcgccttctgccgagccagttcggtcacgttttcctgcccggcgaggaattgcgcctgctcgttggcctcacgtatcgtgtctgccgcacgcgattgcgccgaagcgacgatggcgttggcttgcgtttgcgcgctttccaaacgtcgttccgactcacgcatcaacgccgaggcgcgttccagctgcaccggcatcattttcttcaactggtcgagctgttcggtgaattcgtcgcggtcgacgcgcacgctgccggggaagaacagtatcggtttcgcttcgtccaatgccgattcgagtttgtcgataatgtcgtacacggtggtgaattcgtcgcggctcaaatcgttggaatcgtccagcggcgcgttgggattgaacgtgttgcgtaaatccggcagatcagacatggaaatcaacggtttgaccggctcggcggcgcgtgccgtggcttgtgccttctgaccggattgggccgcccgatcggtcgggcgttcggcggtcacgtcgtcgtcaaactggctgccggccggatcgtacgcattcgtttcttcacccatcatgccctcttttcattattgagcgcttctccgagtagcggaatcacgcaatcgggcaccatgccggtcacatcgccgccgtgacgtgccacatctttcacgatcgaactggagatatgttccaaatcgggcgccgccggcaaaaacagcgtttccacgtcggcaagcttgcgattgaccagcgccatacccaactcggcttcataatcgccattctgccgaagccccttcacgataaccgtcgcaccgaccttcttgcaatagtcggtaatcagtccggttgttgaagcaaccttgatattgcggcaattccgctcttcaagcgccttacggataatctcaacgcgggtctcttcggaaaacatcggtgttttcgccgcgttcaccgccactacgacatgcacttcatcgaaaaaacgcgcgcaacgttcgatgacgtccaaatgtccggcggtcactgggtcgtacgacccggggcaaactgcaattgtcatagcctcaagcgtaccgcgattgcgtgaaattacgcgaagtgtcggcgaatatgtgggttttcatggctatgatggaggcagtggtgccgcggttgcggcgtatttgaggagttgattatggcatgttcgatattcgatgatcgcgacggcttcattgacgaggccgacccggtctcgccgctttccaatcccgacgcgggtactggcactgcggtgctggaacgccccgaagaggagacgaagctggatgatggcggcaacggcgatgcggatcgtttcgcgcattatgtgtcgcgcgatcgcattgccgagtcccgtcgcaccggccgaccggtggtggcgttgtgcggcaaggtgtgggtgccgaagcgtgatccttcgcagttcccggtatgtccggattgcaagcgtatctacgacgaaatgatgaattccaatttctaatcgttttttatctctttcatcgtatggtgatcttggaatttcgttgaaatttctgaagattgccgaaagtgattacatataaaaaatctgccgagacaatctcaatcatcgaaaaataatttcgatatagagaccatctcggcagattttttattgttgttgcgtcttatatctgctgatatatccgcgtttagcgcaacgaaatttcgtcgatgcgacgcaattcctcatcgctgaacgtggtgttcttcaacgcgccgatattgtcgagcagctgctgcgggcgggaagcgccgacaagtacggaggtcacgtaaccgtcgtgcagcagccaggcgagcgccatttcggcaagcgtctgcccgcgttcggcggcaagatcgttcaggtcgcggatctgctgcaggcgttccggcgtcaacgcgctttctttgaggaagcggccgtcgtgtgcgatgcggctgtctgcgggcacgccgttgagatagcggttcgtgagcagaccctgttcgagcggcgagaacgtgataagacctttgccaagctttttggcggttttcttcaatccgttgcgttccacggtgcggtcgaaaatgctgtaacggttctggttgatgatgaacggcacatgcagctcatcgaggatcgcggtggccttttccagcgtcggaccatcgtaattgctcaggcccacgtagagtgccttgccgctttgcacggcggttgccaacgcgcccatggtttcttcgagcggcgtggaggaatccatgtggtgatggtagaaaatgtcgacatagtcgagaccgaggcgttcgaggctttggtcgagcgaggcgagtagatatttgcggctgccgagatcaccgtaggggccgagccacatttcgtagccggctttggtgctgatgatcagttcgtcgcgatgatgatggaaatattcgcgcagcagacggccgcagttcttttccgcactgcccggctcgggaccgtaattgttggcgagatcgaaatgtgtgatgccgttgtcgaatgcggtgaacacgatgtcacgcatagtggcgtacggcgtgatatcgccgaaattatgccaaaagccgagcgaaaccgctggaagtttcaggccgctctcgcccacatgattgtaggtcatggaatcgtatcgagcgggtgacggcgtgtagacggtggtcggttcaagcatggttcctccttgaaaactctgcgtattccgctgtgcgctgtgttgcttgagttggcgcatgtcgtaagtttgtcgacgatactatcgtcgcacttcaagtaaacttgaatgcaagtatcgtcgatagtgtgttttccgatgattgacaatcgcaaggaatcgcaaaatcgctagaaaaacctagaaaatcgtagaaatgagaaggggaatggcaacatatacgattcgtgaagtcgcgcaacgattccatgtgcagacgtcaaccttgcgctattacgaggatcaggggctgctgtgcgacgtggagcgcgacgatgcggggcgacgcgtgtacaccgactcgcatatcgggcggctcgaggcgatcgcctgcttcaaacatgcgggcatgagcatcgatgaactcaaacgcttcttcgcatacgaaaaagacgagcgtgcgcacattgcggacatgctggaattgttggaatcgcggcatcaagcgattttgaaacagcgggccgcgctggaagaggcgtacatgcatgtgttgcgcaaactgcacttgtatcgcgatattcagcacagcatcgaaacgggggtgccatacccggattgggcgaattatgatggcaaggattttcgcgccgacgatcagtgaagttcggtggactgacgaagatcagtgaagactggttggcgaagggcggtgacgcccagttggcgaaaaagcggaaaataaaaggtgtggaaccgcaaactacagttccacacctttagaacacctagcagaacgtctaatagagactgctgcgactcgtttcagccctacttcagcagagtggccacggatggcagcagggcgcgcaacgccttgccgcgatgggagatggcgttcttttcggccggttccatctgcgcggacgtgagcttctcgccggcttcgacggcacgcgccggctgatcgtcgggcacgaacagagggtcgtagccgaagccatgctcgccatgaggctcatgcagcagcacgcccggcatttcgccggtttccacgatttcctgagcgatcgcataacggccatcggcgcctgcgcctgcttcggtttgcggcaccaccagcgcggccgcgcaacggaaacgcgcggtacgcttggcatccggaatgtcggcgatctgcgcgagcagcagcgcgttgttggctttgtcatcgccatgcttgcccgcccaacgtgcggaaagaatgccgggggcattgcccatcacgtccacaatcagaccggaatcgtcggcgattgccgggcagcccgtacgtgcggccacatcacgggccttgagcagcgcgttctcttggaaggtcacgccatcttccaccggatccggcagattcagcgaaccggccgacaccagctccacctgatctgcgtccacacccaggcaatcttccagaatgcggttgatttcaacgagtttgccctcgttatgcgttgcgacgatgattctcacgttccgattcctttcgttgctgttcgttgcttcgttgatgtcggcttgcctgacgtgcgtttgacgtgccctgacttgcctaacctacgattggtttgcgaggccagcctgcggtcggcttacgtccgacttgcagccttcagtcctgtgcgagcgcggactgctgtgcggcctgcagttccttgttgcccttttccgccaggtcaagcagcgcgttcaactcggcgcggttgaacgggcggtgttcggcagtgccctgaatttcaatgaattcgccggaaccggtcatggccacgttcatatcggtcatggccttgctgtcttcgatgtacggcaggtcaagcatcggtgtgccatcgatcacgcctacggacacggcggaaacgctgtctttgatcacgcgctcggcggacctgatgtgcttgtgcttctcggcccagcgcatggcgtccacgagcgccacatatgcgccggtgatcgacgctgttcgggtgccgccgtcggcctgcagcacgtcgcagtcgatctgcacctggttttcgccgagtgccttcatgtcgaccacaccgcgcagacaacgtccgatcagtcggctgatctcatgcgtgcgtccgccgatcttgccgcgcacggattcacgatcggtgcggtctgcagtggctcgcggcagcatcgcatattccgcggtgacccagcccaagccggagtccttgcgccaacgtggcacgcctgcggtgaacgtggccgtgcacatcactcgcgtattgccgcattccacaagcacggatccttccggaacatccgtgaaatgacgggtgatgcgcaccggacgcagctcatccaccttgcgtccgtccgtacgaatcatcgtttcgcccaacaagtctttaatcgctaccatcgctgacttctctgctttcgattgatcacacgatcaacaatcgtttgtattttccgaaaaaacagtatcaccagccgaaaacccgtctttccgtcttgaactcgcctcttgctgcacctcaatttgcctatcccaatttgcgtcgtgcccgaatttgcgcgcatctcacgtttgtctcacgtaatacaggcatgcaagcacgtatgatggaacgaaaacctgtgcttggccacggcgaggcctacacttatggtcagtttcaccaaaagtcagaaaggctttggaaatgctggattattcacctgcactcatgaccgacatgtacgaatacaccatgcttgacgcgtgtctgagggacggcaccgccaatcgcaagtgcgtattcgagattttcacccgtcatctgccgcttggccgccactatggggtggccgccggccaaggtcgtattcttgacgcgcttgaaaatttccatcttgacgataatgatctgaaattccttgcagatcgcaaagtagtgggccccgaaactatcaaatggcttgagaatttccatttttccggttcgatcaagggctatcgcgaaggtgagatgttcttcccgaattcgccgattctgcaagtcgaaggcacgttcggcgagtgcacgctgctggaaacgctgttgctgagcattctgaattacgattccgcggttgcgtcggccgcgtcccgcatggtcagcgccgcgaaggatcgcccgtgcatggatatgggcgggcgccgtacgaacgagtgggccgccgttgccgctgcccgtgctgcggtagtgggcggattcaagggcacggccaatctgctggccgcgcaaatgtatggcttgaatgccatcggcacggccgcgcactgcttcacgctggtgcatgatgatgagcgcagcgcgtttgaatcgcagattgccgcgctcggcaagaacaccacactgttggttgacacgtacaacattgaagaggccgtgaagacagctgttgacgtggccggacccgaattgggcggcgtgcgcatcgattccggcgatctggcgtcgttggcgcagcgcgtgcgcaaccagctggatgcgttgggcgctaccaacacgaagatcaccgttaccaacgatttggacgagtatgcgctcgcttcgctgcagaccgcgccggtcgattcgtatggcgtgggcaccatgctcgtcaccggatcgggcgctccgacctgtgcgatggtgtacaagctgactgaacgcgagaattccgctggtgacatgcagccggtggccaagaagtcgaaagacaaggccacggttccgggccgcaagctcgccttccgttcgtacgagtatgcgctggccgactgcgaacatgtgatttccggctccgaagagcagctggccgcctatcagccggaagaaggctggaaggatctgctggtcggctacgtgagcaacggcgaaatcaactccgattatcagggacacgaagccatcgtcaacgcgcataattaccgcgcccaggcgctggccgaactgccgatcggcgcgcaaagcctcatgaagggcgacccggtaatccctaccgaaatcaccgtcctttgactcgtgctaccatcatgctggttgcgtacggcaatcaatctcgtaatcaaccagcatgaaggggtaggattacatgcgagcattttctctggttacgttgagtccggaggcgtttgacgatttttccgcacatcacgcggacggcaacttccaacagacctctgccgcaggccgtctgcgtgccggccaagggatcgaagtggaataccttggcgttcaagaaaacggcacaatcgttgcgggagcattattcgaaacgcatcgcagccgcctttccaccttcagtgtggtgcacgacggccccttgtgtgactatcgcgatcgcgaattgaccgaatatttcatgacccaactcaagcagcacgcgaaggcgaaaggttccgcacagatggaaatcgtgccggaaatgccatactgcctgcatgactcgcgtggcggcgaactgccagccgaccaaggtggtgctcctgctgatgatgccgtagaaacgttgaaaaacctcggcttcatgcatgacggcttcaccatcggctacactgcggtgccgcgctggcgttacctgaaagacctgactggcattaccgacgaaaagtcactgctcaagtcgtatgacaagcgcacgcagtggagcgtgaaacgtgccgcatccatgggcgtgcatgtgcgcgagctaggcgaagacgagctgcaggtgtttgccgacatcgagcaggccaccgccgaacgccgtaatttcgaatatcgtggtgaagcctacttccgcaagttcaagcaagcttacggcagcaaagcccacttcatggtggcgcagattcacatcggcgaatacattgccgacatggaatccaagtgtgacgccttgcggaagaaggtcgatgtgctgcaggccaagtacgacgagcatccgaccaccaaaacggaacgccagctaggggaggagtcccgaaacttggcggcggcggaaaaacgtttgaccgaggcggccgagtacgccaaagacggtgacgtgcttccggcggcagcatccctattcgtggaacacgctcgtgaaacggtgtatctgttctcaggcagtgtggaaaagtacaagccgttctacgcttccgcgctcattcagcatgatgccatgctgcatttgtgtgtggaacgcggtgtgacccgctacaacttctacggcatcaacggcgtgttcgacgatccggaagatgagggtcgtggcgtactcgaattcaagcaaggcttcaacgggtacgtcgaggaactcatgggctcattcgtgcttcccgtacgcccgctgaccttcaaactcaagaccgccctccgcaaactcctgcgccactagctattagctcaccttccgcttggaggattctgggtgggggcttataggtgcgcgagggttatgtgaacgctgttgacggcgactgtaggctggactaggttatcgcttttggtgaaaagggattttagccagttgggatagtgaaaggcagttacggatcgtgatgcgcgaagtgaatgcgagtgaggaacaagagcaagaatcgtctgaatggaatgtgcgcgagctgagcggtagtgagtttgatgagctttccgccgcgagcagatacggcggattccagcagacttccgaaatggcggcattggctcagtccgacggcatgcaaacgcaatacgttggattggtggattcgcacgatgctccggtggctggcgcgttggtggctttttcgcaagggcgtttcggcgtggaaggctcgttatggcttggctcgttgtgcaatgggaataacagagagcagatgaccgcgttgaccgaaggtttgcgcgaggctgccgaacaggttcacgccatcagcctgacgtgctggcccaaccaggtgtattgcgttcgtgattcgcaaggcaaggccatggccgaacccaatgatgagatggtgcgggagtacgagcggctgggttggaagcatgctggctttacccgtggatacgatgccctgatgaaccgttggaattacgtcaaggacttgagagagttctcgaacgccggcgagctgctcgcttcgtatgcgaagaacacgcgtcgtaacgtcaagatcgcgcggaacagcggcgtggaggttcgacgcctgaatcgcagtgagctgaacgtgttccacgatatttgcgagctgagtagcgaacgccagcatttcgccaaccgtagccttgattacttcgaacgcgtatatgatgcgtttggagacaaggccgagttcatggtggcggaagtgcatcttgaccgctatttgcaatcctgggaggaaaagctggcgaagttctcgaaagacgtggaacgcttggagcgttcgcttgagcatacgaagtacccggatgatgtgcgcaagaagctcgatacggctcagaagaatgtggagtccgcacgtcgccgcattgaggatgcgaacgagcgcatcgctcgtgatggcgaggtggtgccggtcgccgtaggtctgttcatgtggcatgaacgcgagctggtgtatttctccagcggatccgacgatcgttacgccaagttctacgcgcccaccgccttacagcatgagatgatgtcgcgttgcttggaacgcggagtgacgcggtacaacttctatggcatttcgggagtgttcgacgatccggaagacgatggacgcggcgtgctcgagttcaagcagggcttcaacggctacgttgaggaactgccgggcgaattcacgcttccggtgagcaagctgcgctacggcgtgagcgatttggcccacaaactcctgcgccgctagctttagggggtttcagccatgcttggcgcgacgcggatttgcgtggggtgagactttctggtacgctttatgtcttgtgcgcggatggcgtgtgcttccgggcattgccactttagctcagtcggtagagcggctcactcgtaatgagcaggtcgacagttcgattctgtcaagtggctccagcgccctagatgtgaaagcatctagggtttcgcatatcaggagcgtttcgccccgatatggctacttgcgcgagtggcggaattggtagacgcgcaggatttaggttcctgtgtctttgacgtgtgggttcaagtcccatctcgcgcactttcagaaaacggcggaattccgccagttcttggtcattgtagtccactcaataagcctttttgagaacatgttgaaaacattttgcccgtttgcgtcccaattcttccactgactggataatttgggacggtgacaggcttatttgcgggtgaattcttccagcgggtggaggatttgggacgttggggagctcgtttgcgggtggattcttccactgactggataatttgggacggtggcaggcttatttgcgggtgaattcttccagcgggtggaggatttgggacgctgaggggcgcgtgagcggagtgtttcttccagtgggtggaagaaacaggacggtgatgggtggcttggtggcaggggatgctcctaagatggcttcgggtaggaagagaaagagatgattagggattaggggagtgtcgtgtctgcgctgattcagcctgttgcgctactgctgattattctcgccggatacttgttcaaacgtgccggcctgttcgaagatcgcgattaccgcattatgcagaccattattttcaatctggtgctgccaggcgcgatcgtctattcgtttgctacgaatccgcatgattccagcatgctgttgatttcgctgttcggcctgattgttgcgttcattccgccggtcgtggttttcttgacgtcccgccaccgaccggtgcagaaccgtgcgttcatgatgttgaatggttccggcttcaacgttggctgcttctgtttcccggtggtgcaggcgtttcttggcacgggcgcgatcgtgcccgccgccatgttcgacattggcaattgcgtaatggttgccgccggtacgaatgtgatgacgcaaacgctgctgcacatcaagcctggcatgccgcttaccgaacagtatcagggcaatgcgcccacgctcccgtatgtgaagccgaaagacaaggatgccaaacgtcttgcccgcaaggcgttggcccgcaacgtgttcaagggtttcttcggttcggttccgttcgacacgtacttggtgatgattattctcacgctcgctaacgtgaagattcctgacattattgccgcgctcgtgcagccgctttcgaacgcgaattcgttctgcgcaatgctgatggtgggcatgcttatggatttgccatctggcaagcaggatgtgcttcagttgttgaaggtgattggctggcgactgccgtttggtattgcgtttgctactgcggcttggctgctgctgccgtttggcgctgagattcgtgaggcggctgcaatgtgttgtttggcgccgattgcagtgttttccacgctgtttaccgacaaggtgcttggtaatgcgaagcttgctggttttacgctgtcgattactgcgattatcagtttgctgctgatgaccggcgctcacttcttgttcgtcgcgctcgcataagagcggcaaggagatctttaccgggtgcgggagattgtttgtgaccccgcagagcacgaagtcgttgaatgcttgcttgctggtagttgcagtgccgttttcttgtcgttcactgcataatgcgatcgtttcgtttattacatgtttggaagtgttacgaagacttgcgccggagccatgcatacgatttcagtaatcgtcgaaaatgcgcatgtcgaagacggaaggttgtcggaaccgcgctatattgcgaatcttggcgaatgtgttaactcaggaaatatttttgtgttgttctgtcttcttttgtgagtatcttgtgaggtgaagagatacggaatgcgacacgcggaaatccgcagagaagccgcaatcgcatccgcttcatagtgatgatgaaaggacctatacaccatggccatcaatcctcctgttgacgccaccaagaccccggagtgggccgcactgcagaagcactacgatgagctgcagtccgaaggcatcagcctcaagcagtggttcgccgatgacgccgagcgcgtcgagaagctgagcttcgacgcgggcgacctgcacttcgacctgtccaagaacctgatcaagccggaaaccctgcagctgttcgcagacctcgccaaggccgtcaagctcgacgagcgcaccaaggccatgtacaccggcgtgcacatcaacaacaccgaagaccgcgccgtgctgcacaccgcactgcgccgcccggccgaagacgaaggcaagtacatcgttgacggacaggacaccgtcaaggacgtgcgcgaagtgctcggccgcatctacgcattcgccgacaaggttcgctccggcgaatggaccggcgtttccggcaagaagatcgaaaccgtcgtcaacatcggcatcggcggttccgacctgggtcccgtcatggtgtacgaagcgctgaagccgtacgctgacgcaggcatctccgcacgctacatctccaacatcgacccgaacgatctggccgaaaagaccaagggcctcgacccggagaccaccctgttcatcgtcgtttccaagaccttcaccaccctggaaaccctgaccaacgctcgcgaagcccgcacctggctgctcgacgccctcaaggccgccggcgcagtcgacggctccgacgagaagaacgccgaagccatcaagaagcacttcgtcgccgtctccaccaacctggagaaggtcgctgagttcggcatcgacccggccaacgccttcggcttctggaactgggttggcggccgctactccgtggacgcagccgtcggcacctccctcgccgtggtgttcggaccggaacgtttcgaagagttcctgcacggcttccatgagatcgacgaatacttcgccaacaccccgttcgagaagaacgtggtcgtgctgctcggcatgctgaacgtgtggtaccgcaacttcttcaaggtcgcatcccacgccgtgctgccgtacgaccagtacctgcaccgcttcccggcctacctgcagcagctgaccatggaatccaacggcaagtccgtgcgttgggacggcaccccggtcacctccgaaaccggcgaaatcttctggggcgagccgggcaccaacggccagcacgccttctaccagctgatccatcagggcacccagctgatcccggccgacttcatcgcgttcgtgaacaccccgaacccgaccaaggacggcgaccaggacgtgcacgagctgttcctcggcaactacttcgcacagaccaaggctctcgccttcggcaagaccgctgacgaagtgcgtgcagagggcactccggaagagatcgttccggcccgcgtgttcaccggcaaccgcccgaccacctccatcttcggcgtggcactgaccccgttcgcactcggcgagcttatcgccctgtacgagcacatcaccttcgttgaaggcaccgtgtggggtctggactcctacgatcagtggggcgtcgaactgggcaagcagctcgccaagcagatcaccccggccatctcccaggatgacgaagcactggccgctcaggacgcttccactcagtccctgatccagttctaccgcgcaaatcgcaagttctgatttctctaaggattaaatagccttcgaaagggctctgcacgggatgcagagccctttttgctacccctggccatcttcaaaaggtctggcgggtgaggtatttttgaatattgctgtgccgggattcaggacgccgcataatcctgattcccttcgggtccagccgagaacaattgcaagattgaacggaatgttgcacaaacgcaagttaccgtgattttcggcggattggcaatccttcgcaggcagacctgcggagaacatacgaggcagaacgaaattgaaaaatcgtgaagcccttacctgtgcgctgatatgcggcggcgactcgaggaaacacaatggttaacgctattgaggcatttgacgccaagcacatgaagccggccgaggaaatcccggcattccgtccgggtgacaccgttgaagtcaacgtgaagatccaggaaggcaacaactcccgtatccaggctttcaccggcgttgtgatcgctcgtcagggcggcggcgtccgtgagaccttcgttgttcgtaagatcagcttcggcaccggtgtggagcgtcgcttcccgctgcactccccggtcatcgactccatcaaggtggtccgcaagggccgtgtgcgtcgcgccaagctgtactacctgcgcaacctgcgcggtaaggccgctcgtatcgttgagcgccgcgacaactccgagaagtgagtttcaaacgcaaataaagcgtgaaattggccctcagccttacggccggagggcctttttctattcttggccgctatgataggggtcagtgtgcaaaccggacgataaaggaatcatgtatgaggcatgccaaagaagaaaacaatagcggcgacagctttggcttgcgcgacaccttggtctggtgcggaattcctattattatcgtgctgctgatacgcattttcctgctcggattctacgtgattccctccggatccatgatgaacaccatcgaaccaggtgaccgcgtgatcacctcgaaactcaccccgaaagtcttcgatctgaaacgcggcgacgtggtggtgttcaaggaccccgaccactggctgcggcaggaagacagtagcaaactcggcggtgactacctcatcaaacggctcatcggattgccaggagacaccgtggcatgcgaagggccaggtaagccgatcaccatcaatggtgtggcgattgacgaaagcgcatacattcgccccgacgtggatcccagctcattcgcgttcaacgtgaccgtgaccgaaggacacgtgttcgttatgggcgacaatcgcgccaattccgccgattcacgctatcatcagggtgattcctcacatggacttgtgcctatttccgacgtagtgggtgtcggactcgcgaaatattggccgttgaaccgcatcggcgggctcgatgcgcaccatgaagtgtttgccgacgttccggaaggaggctcggcggcctgatggcggtttccgtaattcccacattggatttggaacgtgctattgccgaacaaggctacgatgtgatcgtcggctttgacgaagtggggcgtggatctctcgcagggccggtaatggttggtgcggctgcgatttgggcgcgtgacttagacgggccggctggagcttcgcaaggaggctcgcaagaatcttcgcatctggaagtgccgaaaggcgtggccgactccaaaatgctgaccgaacacaagcgcgaagccatcttcgacgaactcaaatcctggtgcgcatcttgggcggttggcgccgccagcaacaaggagattgacgagtggggcatttcccatgcactcggcgtagccgcgttacgtgcgttggcacaggcggaggcgaagctcggcattgacggcaacggcatgctctccggcaaaccggtgaaggtcggcgcgatcctcgacggaccgaacgattacatcaccaagacgctgaacaccttcgacgcgcccgaagtgccggtgccggcgaacgttaccaccaaagtgaaaggcgaccggtattgcgccgccgtggccgctgccgcggtcatcgccaaagtcacccgggatcggctcatggtcgaactgggagcgcaaccccaatatgaaccatatgaatgggcccacaacaagggttacggttcggccgcacaccgtgacgccatcgctgaattcgggcccagcgacctgcaccgcctgtcctggcacctcgtctgacatacggcatctcatccgcagtccgcgattacgctaatccttgcggatgatgcatgccggaaggaaacctgtaagttcatcccgccgtctgatggccgggaccaatccgtttccgtaccgtaggaaacatggaacacatacttcaggcgaccgatctggtcatggattattcgacccaacaggcgacaccaaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctagcgcggttgagcgacgctgaccgcaccaaactgcgccgcagcgccttcggcttcgtcttccaatccggacaactgctgccagaactgccggccatcgaaaacatcgcgttgccgatgatgctgggcggcgcaagctaccagcaggccaccgacatggccatgctatggctggaacgattgggattgcgccagctcgcgcaacaacgtcccggcgaaatgagcggcggccagatgcagcgcatcgccatcgcacgtgcgctcgccgcgcagccggcagtcatcttcgccgatgaaccgaccggcgcgctcgaccagaccaccggccacgaaatcatgagcattctcatgcggaccgcacgacagaccggcgcggccgtggtcgtggtgacgcacgattcgaacgtggccgcattttgcgatgccaccgttaccatgcgtgatggcaggttgagctcgccgcagcaatcccaacctaccgccggaggcgcacgatgaacatgttccgattatggcgattgttccaccgctccggcacccgcggcacatccggccgcacctctgcgctggccatcgttgccttcgcatccgccaccgccgtcttcctaaccgtgctcggaggcctgcatggcttcatctggcgggcctccgccgaccacacgttcggttgcatgatcgattccaacaggtgcgcgcccggtacatacgaaacatggtccaaagccctggcgcacgccgacaagctcgtcgccacggtcggcgacggccattggacggccgaccaggccacagccgtcatgaacacctattccgacggctatgtgatgctcgccgcattcgccagtctgctactcatcgtgccgttcgtggcgctcgccggttcggcggcccgtctcgcggcctcccgcagggacgcacgtctcgccgcactgcgacttgcgggcgccaccaccgcgcaggtcacgaaactcaccgcgctcgatgcgggtggccaggctctgcttggcgcgctggtcggcatggccggctacttcgcgctgataccagcgatcatgctgctcgacttccaaaaccagcatttcaccttcgaacagttgtgggtgggactgcctgccctggcggctgtgaccgtcggagtcacgctgcttgccttggtctccgcgctggccgccctacgccgcgtggccttcaccccgcttggcgtgacgcaacgtaccggacaacccatgccgtccgcatggcgcgcactgattttccttgccgtgttggccgtaggctacctgctgctcaacagcatctccgcattcgcgcacttgggtcagatggtggtctacgccatcatcttcggcgtcttcttcctcggcttcgccatggtgaacgtcgtcggtacctgggtggtggcgatgcgcgccagatcgcgtgcgaaacacccgaaggacgcggccactatgattgccatgcgccgtatcctcgacaatcccaagcgtgcttggcgcaacgtgtccggcgtggcgctcgctgtgttcatcgcggggatgacgtcggtgtgcggattgctcgccaccggaatcggaggcaaccacgacccgttcgacccatctatgctgtacatgcgcgatatagcgatgggtggtttcctgacgctcgcctttgccgcggtgctcgccgccgtcagttccggcgtgatgcagacgagcaacgtctacgaccaggccgacgagtaccgcatgcttgcgttggaaggcacggatgaggcgacgctcgacaaggcacgcatgatggaagtgatcaccccgctcaacacggtgatggccgtttcattagggtgctcggtgttgttgctgtttccgattctggcaacgtcgttgctcaatccggcttcgttgcttacgttggccgcgggaatcggcttgtgttatgcgctgatggtgctcggagggtgtgccgcgaatcatgcggcgcacgggctcggtcatgccggctaccgtacggacgattgatggtctcgccgcggcggtcgtggataccgcggcgaggactggcgaggtcagccgagcagcaccgcgatgattgcgatgaagatcggtgaggtcagtgtcgagaagagaatgccgtcgcgtgcgaacgagagacccacgttgtaccgcgccgcgtagttgtagacgttctgcccggtcggcagggcggcgagcaccacgcacgcgtacaatgtggcgccgcggaagcccatcacgaaatacgacagcaggaacgcgataattggcatcacgatgttcttcaataccgccaccgtgaacaccgcgggaatattcgacttgtcctgcagcggcttcgtgccgtgcaacgacatgccgaatgccatcaaaatcattggcactgcggaatcgccgatcatgtcgatcggatcgtaaatacagtccggcaccacgaaatgaccggtttttgcggaaatcgcggatacggcgatgcccagcagcgaaccgataagcagcggctgatgcagcggctgcttcagaatctccctcgtggagaccttgcctttggtggtcacatcgagcacggtcaggccgatcggtgtgaacaccgcctgttgcatgaccagaatcggcgcgaccaaagcgggattgcccagaatgtacgtggcgatcggcagaccgatgttgttggagttcagatacagcgaattcaacgcgccgatggtggcatccgccgccttcagatggaagaacagcctattgaggatcagaaacaccaatccgaccagcacggccgagaagaacgccacaacaatggaggagtggaatatctcgaagattctctccttggacaggatggcaaacatcaggcacgggctcgatacgaaaaagctgaacctgttgagcaccatctgcgcggtaggtccgcctatgcgcatgcgcgcggccacgtaaccggtgccgatgacgatgccaatgacgcagaagccttccaatgcgcttaacagaccaggcatgacactcttcctttcgctctcggccgttggtttggccgctatccagtgttgcaccatgcatatggataacatccgatccgtctcaaaagcgttgtcgaacggcgatgtcggttccggtggtgctggataatgggcggtatgaacgaacttgagattggattttccgcttccgccaccaggcaggagcagctgaacgagctgatggaacagatcatgggaacctattccgtgagcgacgacgaagggccgttgaccgacgcggtcgaagcgtttttgaataaacagcagcatctgacagtgcgcaggcatggcgatacgctggtcgcatccacgaattttgggcgtgagcgtcgcgtgatcctcgccgggcatctcgacacggtgccggtgatcgacaatttcccgccgcgttggctggaaccgggcgatccgctgattcgcgaggatgttgccgccggccatgggcgggagcgcgtgatatgggggcgcggtgccaccgatatgaagggctccgacgcggtgatgatgtatttggcggccgcgttgacggatgcgaaatacgatctgacatacgtgttctacgaccacgaagaggttgccgccgaaaagaacggcctacgcaaggtggtcgaggcgcatcctgattggatttccggcgattttgcgattatcggggagccaaccgattgcggtattgaaggcggctgcaatggcacgatgcgtttcgacgtgatcacgcacggcattgcggcgcattcggcgcgtgcgtggatgggtaggcagtttctccatgctttcaatagacggcaatagcacttgcaacgacttgtatttcgggcgttgcttcgccgcgaacaccttgcggatcgcctcaatgttgcgcggatcgcacgcaacgccgtagaccgtgtccgtaggaatcacaatcaatccgccgtcacgtacgatttcgacagcctgggcaagggattcgtctgaaatagcgcgaatctcgctcatgacacctcccttttcggcttgctgaccccaccattgtaaggcaggattcttcaactgcgttgaaactgaccttatgcgcccagatacgccttgcgcacctgctcgttgtccatcagctccttggcgtcgccttccatggtgatgcgcccggtttcgagcacatacgcacgatcggcgatcgacagggccatattcgcgttctgttcgaccagcagtacggtaatgccctgatcgtgcagcttgcgaataatggcgaagatctctttgacgagtttcggagacagacccatcgacggctcgtccatcagaatcgtgttcgggtggctcatcagggcgcggcccatcgccagcatctgctgttcgccgccggaaagcgtgcccgccttctggttgcggcgttccttcaggcgtgggaacatgtcgaacaccatggcaagatcgtccgccatgtgagaccggtctttgagactgaacgcgcccatttcaaggttttcctgcacgctcatgcgcgtgaacacgtggcgtccttcgggaatatgcgccatgccgagggtcacgatcttattgttcggcgttttcagcaggtccacgccgttgaacagcacctcgccggaaaccgccggagtaagacctgtgatggtatgcaatgtcgtggttttgccagcaccgttcgcaccgatcagcgacacgatctcgccgtcgttcaccgtcagactgatgtttttgaccgcttcgatggcaccgtaggagacggaaagattcttgatctgcagcatcaggcgtccttcctttcggtcgtttcagacgtttcgacggcattgttttcagcatcgtccgcaccaagatatgcggagatgacctgcggattgttggcgatttcctctggcgttccgaaggcgatggtacgcccgtaatcaagcacttgaatacgctggcacacgttcatcaccaggctcatatcatgttcgatcagcagaatggcgatgccgaaacggtcgcggatcgtgttgatgcagttcagcagatcctcggtttccgtaggattcatgcctgccgcaggctcgtcaagcaacagcagtttcatgccggtcgccaacgctcgtgcgatttccagcttacgttgcgctccatacggcagattcgcggcttcggtttcggccaatccttccagtccgaaaatacgcagcaggtctatggctttggcatgcatgtcgcgttcctgcttccagaaggtcggcgtgcggaagatcgcaccgcccagccggtaggtgaaggattcgttgaacgccacaagcacgttctcttcgaccgtcatttgatcgaacagtcgaatgttttggaaggttcttgcgattcccgcacgcacgacctgatacgttttcttgccgttcatgcgtttgccgtcgaggaagaactcaccttccgtgggctggtaaacgccggtcagcaggttgaacacagtggtcttgcctgcgccgttcggcccgatcagaccgacaagttcgcccgcattgatggtcatgttgaagtcggatacggctttgaggcctccgaaggtgatgccgagatgctcggccttcagaatcggctcgctcatgcctgcacctccttgtcttcgctggatgtgttgatttcgctagatgcggtagtctcgccggtttccttggttttcttagatgccgattgagacgcacccgatttgccgtgcatcttcacgcgtaccggatagaaccacttgttgacgaatttcggcagcgagaactcccaattgccgaacaatccctgcggacggaacaccatgatgatcaccagcaccaccgaatacacgagcatgcggtatgcggagaacgcacgcagcaattccggcaaaatcgtcagaccaaccgcggcgacaatggaacccgtcagcgaacccataccgccgaacaccaccatgatcacgtaattgatcgactgcagccaaccggccatgcttggcgtgagcgcaccgatatattgcgcgaaaataccacccgcaatacccgcgaagaacgcggaaatcgcaaaaacgagcactttcatataggtgatgttgatgccggaagcgccagccgcgatctcatcatcacgaatcgccttgaccgcacgaccataacgggaacgcgcgaacatgaacaacagcaccacggtcacgacggtgatacagaacaccacatacagattggcgagacggtcgatgccgatcagtgcctgcccctgctggccgtccgcaagtcccttgccgccggccactttcagattctggatgatcacacgaatgatctcaccgaaaccaagcgtgataatcgcaagataatcgccgtgcaaacgcaatgccggaatgccgacaagcacaccgaacacacatgccaccacaccgccgacgaacgtgaccagcaggaaacgcaccgtatcatccatctgaacgccgttggcaaccagcagcttgctcatcaacgcggcggaatatgcgccgatcgcctcgaaaccgcagcagccgagcgtaagctgtccgagcacaccgatcgtcagattcaacgacgtggtcatgatcaccgcaatgcagcaagtcatgagaatacccttgacatacagggaaatagcgcccgtttcacataccgcaacaagaatgccgaacagcacaagcacgccaatggcacacaatgcatacgattgcttcgtggaaagcattgatttcttcataatcacaccttctcgctttccggctcgcccatcagaccggacggcttgaccagcagcacgatgatgagaatgccgaacacaatggcgtcggagaacgccgacgtgatcacaccggccgtaatcgtaccgatatacgccttggtaagactctcggccacgccgatcagcaagccaccgaccatagcgcccggaatggaaccgatgccgccaagcaccgcggcgacgaacgctttcaagcccagcatggcacccatcatcggagagacctgcgggtaggaaatgcagtacataagcgccgccaccgcagccaggccggagccgatggcgaaggtcaacgtgatggtggagttcacgttgatgcccatcagaatcgacgcttccttgtcttcggacaccgcacgcatggccttgccctgcttggtgagggagacgaacagctgcaacgcgaccatgatggcgatgccaagcagcaccgttatgatggtcgctccgtcgattttgagtttgccaagcaccagcgttggaatttcaacgatggttggcacggtctgataatcagcgccgaacagcgcctgggagccgttttcaagcagcaggctcatggcgatcgcagtgatcagcgccgtcatattattgcctttttcacgcaccggcttgtacgcggccctttccacgataatacccaccgccacgcacacaagcaccgccggaatcacggcgaaccatgcgggcagaccgcaggcgataatgaacggaatggtaagcatcagcgcgtaggagccgaccatgatgaagtcgccgtgcgcgaaattgatcagtcggatgatgccgtacaccatggtgtagccgagggccacaagcgaatacacgctgccgattttcagaccgttgaagatctgaccgatgaacataatgaccgaatcgctcatcatccctcctttcttgttgtttcgtcagttgaagtcttgtttttcttgattcctcgcgttttttcgctattccgccggctggatggtgtctttgtatgtcggttcgccgtcgctcatttccagcacaatcaccgatttcttcggagaaccatgcttgtcgagcgtgaatgcgccggtcacgccggagaagctcatacctgcgatggcgttgcgaatatcggcacgagtggcgttttcaccggcttgttcgatggcccgcttgaacatgtagacggaatcgtaaccgagcgcggtgaaggtgttcggcgattcgccgttattggccttcttgtatgaggtgatgaactgctgcaccttcgtattggacttgtcatccggcgaataatgcgtggtgtacagcaccttgttgtagttcgctttgtttcccgtggttttgaggccgtcgtagccgtcggggcccatgatgtagccctcatagccgaccgctcgcgcctgtggcacaatgtacgggccaaccgtggaatagtagtacggcgcatataggaattccgcaccagaagcttcgattttctgcagctgcgacgagtattcggtatcgtcggcgctagaggaattctcttccgccaccacgtcgagtccgttcttcttcgccgccgcaacaaaagccttgcccacaccagacgaatacggatcgcccgtgccatacagcacggccactttcttgaccttcaatgtttcggccgcatacttggcggcgatctcgccctggtaggagtccttgaagcaggtgcggaacaggtatccgcccgtttccacggaatcggcggttgcggccggagcgatggtcggcatctggttctggtcggcgagcggcgcgacggcaccggaggttgacgaaatggtcggtccgagcacggcgatcacgttcttgtcgccggccagacggttaaaggcgttggatgcctcgatcacatcacccttgtcgtccatggattccagtttgatctgtttgccgaagattcccccatcggcgttgatttccttgaccgccagtttgaacccgttcacttcggcttcgccataggctgcggctgcaccggaattggtggtgaccgagccgatggtgatcacatcgttatccgcgatggtggcgctctcattactggtggcgtacatgttgccgcccgaacaggctgtaacactcactcccataaccgccgcaagacagagtgcggccagtttttcggcattcttgattttcactgccgttccttctcttcctgtcagcgcaaccggacgcctcatcttgtggatgcttccgcaaccggtatgcttaccgctgaactggtctaatgcaatggtcggacttccaactggaactctattgcaacagaaaaaccacgttcccctggaaaaatctcttattctgagacgcgttgcatcactgctttttcgcggtcatgtatcgcgggcgacctgtgtaatcgttatgcaccatcacattgctgaatccatatgacagcgcgaatgcagacaatcgttcaccttgcgtaatatcgtgttccattaccagcaaaccgccgtttttcagcagttttgcggcacgggcgataatgcgttccggaataagcgtgccatctgcggaaccgccgtatagcgcaagatcgggatcgtagtcgcgtacttccggttgctgcggaatatccgcaagaggcacatacggaggattggtgagcacgatatcgatcgtgccgtccagctggttcagcgtcggtgtttgcgtggcatcagcgatttccagatgatagttgctggcgatgctggggtacttttttgcggtttcgttgagattgacgcgggtccattgcgcggtttgctcgcttttttcgaccgcccacacctcgctgccgggcacttccgtcacgaatgacaggccgattgcgccgcttcccgcgcacagatcgaccactttcgccgaatacatgccgtgcttggtgatccagtcgacaccttcctgcaccacgagttcggtttcctgacgcggaatgaacacgcccggaccaaccttcagatcgaggtagcggaagggcgcgtggccggtgatatgttgcagcggttcacgcttggacctgcgatccaccatggtgtggaatcgcttcaacgcagcgtcttcaccgctctgcttcgcgccttgcttcgccagttcggatgtttcgcttcccatcagcatggccttgtcgacggtctgcaggtcgacgccgaatacttcggcggccaataatttggcatcgtgctccggagtgtcaacaccggacgcacgcaacatggccgaagcggatcgcacgagttcgaatacggtagccatcggccgcctttacttctgatgggccaagcgatcggcttcgtcagcctgaatgtcgctgtcgatcacagcctgcagatcgccgtcaagcacggcgtcaaggttgtacgccttgtagttcgtgcgatgatcgacgatacggttctccgggaaattgtaggtgcggattcgttcggaacgatccagcgaacgcacctgggagtgacgcatgtctgcggcctgtgcggcttcctcctcgtgcttcatggcgagcaggcggctcttcaacacgcgcagtgcggccgcacgattctggatctggctcttctcatcctgcatgctcaccacgatgccagtcggaatgtgggtcatacgaactgcggaatatgtggtgttcacggactggccgcccgggccagagctcatgaagatgtcgattttcagatctttctgatcgatttcgatctcatcgtcatcttcatcggcttccgggaatacaatgacgcccgctgcggacgtctgaatacgaccctgcgattcggtgacggggatacgctgcacgcgatgcacgccaccctcgtatttgagggatgcccatacgccgtcttccggagcgggagtgcccttggcgcggatggcgagctgcacgtctttgacgccgcccagttcggtggtgttttcgctttgcagggtgacggtccaaccgcgcttttccgcatatcgcatgtacatgcgtagcagatcgccggcgaacaacgcggcttcctcgccgccggtgcccgccttgatttccatgatcgtgtcacgcgcatcatcgggatcgcgcggaatcaacgcggtacgcagcttctcttccgccgctggaagctcgctctccaaacgtttcgcctcttccgcgaaatccggatcttcggaagccatttccttggctgcctccagatcgtctttcacctgcttgtatgcggtgtatgcggaaacgatgacgcccaactcggcgtgacgacgtcccagcttacgcatcttatccggatccgacgcgacttccggctcggccatctgctgttcgatattatgatattcctcaagtgcggtaactgccgcggggaactgctcgtctgccaatgtacgccttttctatctgcctataaatctgcgcttcagcgtgaacgcttcgctgaactccactcaacctgtccatcatataaggtgccttggaaacgctgccgaagcgcggtatttcgcaggcatcccacgcatcttacgaatatcccgatcgcatgcacgccagcgcatgcgcatccgtcgcataatgaaaaacgccagcccataatcggactggcgtttttcattgcctaagcaataagactcacttggccttcttgccgtaacgcttctcgaagcgtgccacgcgaccaccagtgtcgaggatcttctgcttgccggtgtagaacgggtggcagctggagcacacgtcgacggtcatgtgatcgccgctgtaggtggaacgggtgacgaaggtgttgccgcaagagcaggtgacctgcactgcgtggtaatcaggatggataccctgcttcatagtttgtctcctagagattcgggggacccgggtcgctgagcccctatggcagagcgtgaaccggataaccttgcagagtatatcagaagccttgactttgtgaaagagtggggcgtcacgggcttgaaccgtggaccggcggattatgagtccgatgctctaaccgactgagctaacgccccacgttgcaacatgcgaacatgccaacttagcaagtttagcaaatgggtggactagttttgcttcatgaaacgcagcggattgtcgataaagcgtcgcaaaccgatttccgcagcgcccatcaaggccggacgatcgacgatatccgccacaagcacgcttgcctcgacttccggatacgccagcacttgcgggcgtaccatgcgttcgattctgcgaatcagttcaggttcgaaacgcgcccacaagccgccgagcatcaccacgtcgacgtcacagacattgatggtcgatgcgattacggaagccatggcctccaatgctttttccacaacggccacggtctgcgcatcgcgctggtgccagcggtcgatcaattcgtcgatggcgctgcgggtcgcggcggcatcgctgctggcgattccggccgcgctcaccatggaacgcctgcccgcatacacttcaaggcagccgcgacggccgcaacggcagacgggaccgcgcatgtcgacggaaacatggcccaattcgccaccgaaaccgtgatcaccgctcaccacacgcccttcgcggatcactgcaccgccgatacccacgtcggtcgacatgtaaagaaacgaatccgtcggcttgatccgcccagaatccttacgctgcgtggcatagccgggaacctgtgccaacgcggcggcattggcctcgttgcaggcaacaggatcaagtcgcttgaccacatcgaactgcttgagatccaaacgttcccaaccgagattgcgcgcgccaagcaatcgcatatcatcggtgacgagacccggcaatgccaaaccggtaccggcaagcacataacctttcttggcaagcgcttcttcctgctgcaaagccagttcgtcgagacgggcgaaaatcgcccgctcgtcggcgttggccatgtcggcgtcgacccactgctcccccacaacggaaccgtcaagatcgagcaccaccacaccatagccgtcggtgttggcctgcaatcccatgccgcacaggcgtccacctttgatttcaagcggaatgctggggcgcccatacagcgattggccggaaggcgcgccttccgccagaatctcattgtcgagcatcaacgacaccaataccgacatggccgctttggtcaatccggttttcttggcaagatcggcgcgactcattggttcggtggcacgcaacagcgagtcgagcaccacggaaagattatggtttcgcaaatcgtcttgattgatgctccgcagtgaagccatggttccctcctctttgacgcgtctttgccgaaaaagcgcaccgcctcaatagttaaatcactttatgatggtacactagacattatagttcattcatctaactaaatgaggtggcgaacggtgcattttccttgcatcgtgttgcgccagctcactgcaaggaggcacaatgactcgaactctcgtggccggcgtcgacacctcgacccagtcttgcaaagtgcgcgtgaccgacgccgaaaccggcgaaatggtgcgtttcggccaggccaagcaccccaatggcacgtctatcgacccgaaatactggtgggacgcgttccttgaggcatcccaacaggctggtggacttgacgacgttgaggcacttgccgtcggcggtcagcagcacggcatggtgattctcgatcagcagggcagtgtgattcgcgacgccatgctgtggaacgacgtaagctcggcgccgcaggccgcggccctcatcgagaagatgggcgaggctcccgccgaagagggcgaaccggaagatgtgatcgcgcgtggcaagcaacgctgggtcaaggccgtcggatcctcccccgttgcttccttcacgctgaccaaagtggcgtgggtggctgaaaacgagccggaaaacgccaagaagatcgccgcgatctgcctgccgcacgattggctgagctggcgtatcgcaggctacggtccagtcgcagaaggcgaggacgcacacttggaagcgctgttcaccgaccgttccgacgcttccggcaccatctattacgatgccgcttccaacgaataccgccgcgatctgatcgccatggtgcttgaaccagcggaaggtgccgaagcggcgcgcaagcatgccgacgcgatcatgctgccgaccgtgcttggaccgcgtgacgtcgccgcagtcaaggcaagtccgaaaattgccggcaagaacgttgaaggtggttgcatcatcgcaccgggtggcggcgacaacgccatggcatccctcggacttggcatgagcgtgggtgacgtttccgtttcattgggcacttccggcgtggcagcagccatttccgaaaatccgacctacgatttgaccggtgccgtttccggcttcgccgactgcaccggccactacctgccactggcctgcaccatcaacggatcgcgcattctcgacgccggccgtgcagccctcggcgtcgactacgacgaactcgcatccctggcattcgcttccgaaccgggcgccggcggtattacgctggtgccgtatttcgacggcgagcgcactccgaaccgtccggacgccaccgcaaccctttccggcatgacgctggccaacaccacacgcgagaacatggcccgcgcgttcgtcgagggcttgctgtgctcccagcgcgactgcctggagcttattcgttcgcttggcgctgagatttcccgcattctgcttatcggcggcggcgcaaagtccgaggcaatccgcacgctcgcgccgagcgtgttcggcatggacgtgacccgcccgaccaccgacgagtatgttgccatcggcgccgcccgccaggccgcctgggtgctgtccggcgaaacggaaccgcccgcatggcagctcaccatcgacggcgtggaaaccggcgaaccgactgaagccgtgtacgaggcctatgtaaaagcacgcggctgatcaatcggccatcgtgaatcgcgagtgatccaacataaaaatgggtgccatcacagccaaaccgtgacggcacccattttcgtctcaaacaaaatcgtgcgatattccgatcaaatcgtgaggtcaaaactgaaatcgtgcgacaacacgtctagcagtagggcaacacgcgaattcgctctgagggaacaccgtaacccaacgtcagatgatgccctcgacatcggcgaaggcaggatcgcgttcgggaatctcgcggattacatgcgccggattgccgactgcgatcgaattggcgggaatgtctcgtgtaaccacagaacccgcgccgataatggaattcgagccaatcgtgacgccaggcgtgaccgtaacgttcgcaccaaaccacacgttgtcaccaatcgtcaccggcgaagcatgttcccagccagccagtcgcgttgccgcatccaaggcatgattcggcgtggcaatggtacaacgcgggccgatcaggcaatcctcgccaagcgttacatatccgccgccgcacaccatgaaatccttgttcaagaacgtgcctcggccaatggtcaggccgatgccataatccacattgaacggcggcgtgaattgtacgccctcccccgcgtcgggaacgagctcgtggaacaggcggtaggcctcgtcaggatcatcgaagaagatgcggttgatcgtggcgcaggtacgcatggcctcgccagtaaacttcggcagcgacttcgatttgcggtattgcgtcggcttgccggcgaacagcctagtcagatcctcgtcggacgcgatcagcgtctccgtctccttcgtcatgcccgtctccttcgtcacgatttccaccacgctatagtgaacgctcacactatactatattcatctacttgacctggcatacgacatactatccgatgtatcgtggcatccgccgagcagcatgtatcgttggccattgggtccgcatgccggacattcgggcaatccggaaccgttcggatcgcccgtcgccgcgaaattcgtccaataccgaatcatgacacgagacaaatcgtaatgcgccaacgggaaggcttggcataggggatgccacgaaacacggtaattacagagtccgtatcggagaatccatcgacgagtccttgtcgaagcgcgacctgtctacgcatgaatccccttatcatcgtccgtgggcaatgtcaggcggaacggcggaatcagcatgccgtcgccgtcgcatatgagtccggattccggattgttgctccacgcgtaccgcacctcatctggcctgcgcgccgtcatgcgcgccacgatatcacagccgtctagccatgcctcggcccgcgcggatgtggcgcagtcgcgccatagaaattcgatttcctggggagcgtcaccgtccaacgtcatcagccggcggccctccgatcggatccgctcgtccgagcgactccgccacacacagtgcatccgcaacagatctccgcagacctcgatggtttccacggccggttgaggctgagcctggcgaccgtataccaaatccatcgcggcattgaacacgcgatccgcgacgagcttcttgtcatacggatgcagatcgttgccctcgccggcgtcaagcgtcaccaccgtcgcaacgttttcaagttcgttcgcgacgttccattcctgttcgcggacgagtggccagcctccatcctcaatggcgtcaatgtcgaattttggaagctggacgatcagaaacggcatatccggctgatgccatttgacgcgccacaattgaatcatggccttcagctcgtcgccatatcgcatggcgcggtcgccggtgttcgattcgccttgataccacaacacagcgcgcaccgcatatggaaaacacggggcgagcatggcgttgtacaggccggtcggcttccatctgacgaaatcctcgaatgggcaatcgcggtcagcttcggcggtcacggcatactgccagatgccagacagatcgaagatatcgtctccgatggtcagagccatccgtttgccaggcgtcacacgtccgccgggacgctcaacaaccaggcgcatgcggatttcgttcgcgccggcgcgcagcacaccggatccgaccggataatcgcgcggttcgtacacattgcttcgcccaccgaccaacacaccattgacccacgtatggtcggcatcattcatggtgcccagacgcagtagagcgggcttgcccgcatccgacggaggcaggaacacggtttttctcatggtaatctcgccgcggaaaccggcaagtccgcgatccttgtaccatcccggcaggcgtatgtcatgccatgccacgtcgcgcggctcgatgttcttggattccggacagtcccacgcgatcaatggcagccattcatggtgggcatcggccacagcctcgtatccaagcgcttggtaccaccggtcccgttcggcaacggaatcgcggcttttcttcgacgccacgccatcgccaagatacggctcaagatcagcgagcgcttcagggaacgcccgcaatgcgtcggcatccatccaggattcaatcggcgatccacccaatgaaacgttcaacaggccgacgggcacattcagccactgacggatcctgcgtccgaagaaataggcgagcgcggagaaatctccaagggtttccgcatcgcacccctgccagaacgcatggtcatgatcgctgcggggaccgttgaagtcacaatcgggaatcgctttgtattgccgcagcaatgggtcaggctcacgatcccactccagcggatagtccgcacgcacccaagccatgggcagttccatgttcgactgtcccgaacacaggaacacttctcccgcatagcattggcgcgagatacattcggttccgtcctcataacgcaccgtcaaatcgtacggtccgcctgctttgattggaccgtacggcacgctccatgagccgtcgtcccccacccgcgtagtccgatccttgccatcgaggcgtaccagcacgccgcgtccaggatcgccggcgccccagatatgtatggtcgcaccggcctgcagcacgcaaccgttgtcaagcagtttcggcaattgcaaaaccatgctcgtccgctcctcattgcccatagaattcaatcccgtcgtgtatgccggctgacggcggacgctctgtcgccagccggcactgtctactggttatcggaaagctcccgatagtcgaagtagtcgaattcggcctgcgcgtcgtagccggacagatcgacgcaggcaagtcccacgaacgcgccggtaaagaagccgccgtaacgttggttcacgtaatcgtcggacaggatcttcgcatcgagcctgaccggaatctcggtgaaatgttccccgtcgaaggaatattcgtaggaatagtattccgtgcggaccttggtgcgcagccataccgcctcagcctcttcgggcactacgatggcgttatccttgaggaacgacgtatattggttgaaatcgttctgagccacttcgatgacccttgcgtgacgtttctcatcccaagtgataaacgcccatgaccagcataggtcatcgtaatagttggtcaggcctgccatctgcatgtaattcttcggatcgaaacgcaccttggtttcggcgtcgaaatcaaatgcctgccagcgacgagccacaagagacaagtcaaacaggttgcacagcgagccctgaccacgcaatgccagtttgccaccgcccaccgtgcccatggcgtcggtgaacgggacgcgtagcgtgttccaattcggaccgagctcgccggaatcgaactcatcatgttcgtcacgcgtcgttggggccaaagtctcgatggcatctttcggagcatcaacgtaacgctgtccgccgtgacctccgatcacgcgcggccagccgtcctcatcccattcgactttctggatggaggtctcgcgtccgagtgtgcaccatccgcgggtgccatgagccggttcggtatcatgacgccacggacgaccgcatagggaggcgtaataccactcgccggacggggtgtccaccaacgctccatggccctgcttctgcaaataggtgtcaggagtgtcgaagttaccgatgaacgggctattcggcataacttcgaaggagtactcgtcaagggtatgggaacgcgccacagattcctgatgttcatacaccgtgccgccttctgcggcgaacaggtagtaccagccatccttcttgtataggtggggaccttcggtgatcttcaccgcagtgccatcccagatggtgcgggccgtttctggcttgagcttcatggtgtcgacgtcgaattccgtcaatgtgataccgtcgaactggtggtggtattcacggaaatcccatgtctgctgcaccaagtatttgcggccgtcgtcgtcatggaacaggctggcgtcaaaaccgaccccgttgatgcgaatcggctcgctccatggcccgtggatgtcctcggcggtgaccaaataattagtgcaatccttgaatgcaccattgaccaccttgacatcagtgtagatcaaccagaatctgccatccgcatagcttaggtcaggagcccagatgcctcccgaagaggggtttcctctcatatcaagctggctggaccggctcaacgggcttggaagaatgttccaatgcaccaggtccttggactcatgcaggcgaacgcctgggaaccattcgaaagtggaattggcaatgtaataagtgtcaccgacgcgaatcattgaaggatcggcatgaaaaccggtgagcaccgggttggaaatcttcataatgtacctcttgcataagagatgaagcccggaagacggaaaggaacatcttccgggcgtgggttgtcacattccgtcagcccttgaccgcacctgtcaggccgccgacgatcttcttctggaagatggtgaaacagatcagggccggaatcatagccagagaggtgaaggccaacacctgtgcggtgtcaacggagtgttcggagctgaacatctgtacgccaagtggcaatgtgtacttgctggcatcactgagcacgaacagcggcagcatgtaggcattccagcttcccacgaaggtaaggattccagtggtggccacgccaggcatggacagcggaatgaccatgcgccagaagaagccaaggcgggagcatccatcgagaagacaggcctcctcaagctcattaggaatcgactgtaggaacggcaccaagatgatgatggtctgaggaagtccgaaggcaatttgcggaaggatcagaccccacagggagttggccagacccagattgcgaatcagcagatacaaaggtgtaatgccaacggtcatcgggaacatgagaccagcagagaacaacgcgtacataagcggcgcatagcggaatttgtatcgggcgatgacaaagctcaccatgatgctaagcaccacgacgcctaccatggtggcgatacccacgatggtagaattcttcagttccgtccagaaaatatcactttcgacgaccgtcttgtagttgtcggggatccatgggttcggcatcccggacggatggttggtgatctgcgaattggtacggaaaccgccgaagataatgtacaacaccggagtgatacagatggccacaagcaccagggagaagaagtagacgattgggttgccccatggcgtcttggatgacttacggtaaccattcttcttgctgtactcgcttttgttggaatgtcctgcgattgttgcggcagtcatcacttcacctcacttgccagggcagcaacctcacgatgctgcacttcctttgcgcgcttcctggcacgcttctcggcttctttctgctcagtaacagcaccgtccaagtcacggttcagcacgaacttctgatagacgagtgcgatgatcaaagagatcacgaagatgatcagagcaacggcggaaccatagccatagttgccggctccacgaccttcacgcaccatgtaggtggccatggtggacacaccagcggtggtcgacacatacttgccccatacgatatagaccagatcgaaaagctgcagagagccaatcatggaaaggaacacccagatccgcaacgtcggagcaagcaacggcaacgtgatgctcctttgcatctgccagaagctcgctccatccaccttggccgcttcatacagttcatcgggaatggattgcatgccggcgagcatcagaattacggcgaaaccgacgtatttccagctgatcagcaacagcagcgtccagatggcgattttcgggtcggccagccaatcaggaccattgatgccgaagttggccagaatctcattgatggcgcccttcttctgtagcaacaggctccatcctgtgccgacgatgacctcggaaacgacatacggcacgaagatgagggtgcggatgagaccacgccccttgaacttctggttcagcagcaatgcgaacaggatggcgagcggagcctggatgaccaacgagccgatcacgacctcgaaggtatgcagaatcgccgcctggaacgcgggatccttaagcgctgtgatgtagttctggaaaccaacgaatttacctgtcttggagggaagtccgtagcccttccactgatagaagccgtaataagcacccaagacgataggcagaatcacaaagcagacgaacagaagaatcgcaggtgcggacagtacgaaaatctcaacattacgacgcattttgccatcggacggtttcttggaccgcttagcgcgcagcgtcaccgcgtctttgcttgtacttgacatggttttctccactaccagatacgtttctcgaataggaaggagggcagatgaagatctgtctatccaccctcctttggccgtcaaccagccatgttcactatcagcccttggacgctgcgtccttcatcgccttgacgatatcggcggaagtgccctggcccgagagcaagttcaccactccggagttgagcgcgttgccgatgttgccgccgagagcggtatccatccacagctgcatgccatcagactttttcatagcttcgaggatagccttaagattttcatcggtaaccgcatcgtaagcttcggcggaagccggaatggtgctgaacgcagtggcgtatttctcctgatttgatttctcagccatgaaattgacgaaatcaacagcagcgtccggagcctcgggattgacagcgaaaccggtcacagcgcccatcaaagcaccttcctcgccttttcctccgtccacggtcgggaaggcgaagaagccaaggtcagccattggcttcttgtccggagtcaggtccttgagaactccaggctcccatgtgcccatgagctccatcgcagccttatgattggccagcagacctgcggacgagctggcgccctgctgggccgtcgtggtgaggaatccttcgttaaaagcattcgcatccaacaaatccttcagatcatctccggctttgacccagcaggagtcggagaagtccttgtcattaacgcccttggcgtaggccttcggagagcattcgcgcatggacaaccagtagtaccagtgaccgaccggccaagcatccttgccaccgagtgcaatcggctcgatgccagcgctgcgaagcttctgcacatcggtcttcagctcgctgaaagtggtcggcacggcatcgatgccagcctgcttgaacaaatccttggaataccagatgccaccaggctggacagtgaccggaacggcatagaccttaccgtcataagacacggattccaatgaggaagacatttgctttttgacggtatcgctaatcttatcagaaatatccattacctggccggcatcaaccatgtccttggtcttggcaccaccaagggtcatgtacacatccgggccggaggcgggatcctgcatagcggtggtcagcttgccttcgaaatcctcgttctggatggcctgaatctgaaccttgacaccggtcttcttctcaaacgctttggccagatcctcccaatactgcttgccgtcaccagctgtggcgttatgccagaacgtaatagtcttatcgtctttggcgccagcgctggagccgcaggcacccatgcccaacatggtcgccaccgcaagagtggcagctgcaatggttttgaacttcattgtcttctccttattgaccaaatcatcatcgacaaaatgatggcaacgacaggaacgacttctctcgagtgggtcgaatcgggaagcatgaccgcaacgaatgctgctgcagctcccctagcagacagagaatcagcctttgactcccttcgaaagtctccatttcgttttcgttgtacctacagactaccgaaacaaatcacacaaagttaagttttttgcaaaatcagaaaactaactatttttcgttgattttacaacgtttttaagcattgccaacatatcgaaagtttcgaaaaacgtaaaccgaaactttcgtttgcattttcggatatgatgaaaagaagaaggagtgactcatgcgcaatacgacaaagaaagctacggtacgactctctgacatagctaaagagaccggttattccctttccaccgtatccaaggcgctcaacggcagagccgacgtttccgaagagacgcggcaaaccatcaacgcggtgttgaaacggtatgggtattcccgtaaagcgacaggtgcaaaaagccaacgaattatcgaaatcgtgttccaagatttcgataatgtttgggcccttgaagtactccgtggcgccattcgcgaagccaagttgcatgatttgaacgtcatcaccaccgaaggcggcaatcgccagcacccggactcatcctggattgacaacatgctgcgtcggcagacggatggcgccattcttgtcttctccagtctgacacgtatcgagcggaacaaactgcattccagaggtattcccttcgtcttgttcgatccattcggtaatccagatccagacacgctgtcggtgcaagcggacaactggaccggaggcgtaatcgccaccaggcatctgctcgcactcggacatacccgcataggcatcatcaccggaccggaggagatgatgtgttccaaagcacgtctggacggatatacatcagcgctcgcggaacatggaatcgaagccgatcccgaacttatcaccgaaggcgatttcaccacttccggcggttacgcacagtccatctccctgttgaaacgaccgaatcgtccgaccgcaatcttcgccggcagcgatctgcaggccatgggcgtctacgaggcggcaaggcagctgggattacgtattcccgaggatttatccgtggtcggattcgacgatgtgcagactgccgcattccttggcccggcgctgaccaccgtacgacagccgctccaagacatggcaagggccgccgtacgcatgctggtcgaagcgctgtccaccgacgtgatccaaccgcacatcatcatgccgacatcgctagtggtacgcaacagcacacagcaactcgaaggttaatcagcggggcaaacctcacaggcacaaccggagggagaacacagcgctcctagcctttcgacccgttttcaactcgttctaagacggcccgtcggaacaccagcagtgaaccatcctgaaattccgtagaaactatgccatgaagccggccatgcaaccgacgaacccaccggcccattcggtgctgaggaaacgagcatcgacactcagcaggacctgcccctgacgcacgaacgtcgcagaatcaaccaaaccatgcatgccagtcacgatgaccgacaagcggttgtcgtcgaaaagtaccgccggacgcactccgtcagcctgtacggcaacagacccagcttgcgaatcgtctccattcaccatctcgtagcgcacatccgtgccatgcatcgaaaacaccgcgtaatgtgtggaattctgccggatcactaaagaaccggacatgggaatcggcatgagcgtcggcagtttcgctattctgcggtagctgacatcacgctcatcgcgcaccaccacatcgctcgtcgagccatcagccacatccaccagcgcaggttccacgtcaccggcgagcgaggatttcaccctaggctcgatggcgatgccatcgtcttcagtagtaaccgtgatctcgtcggccaagcggccaagaccagcgcaagtcactggccatccggggtcaccctcatgcgtatatggtgcaccgttgccgtccagcttccaatcggccggattatgttcccaggataccggagcgacaaagctctcccttcccaagtagctcaataattcgccgtcacgctttccccgtgtctctctcacgccgagacacaccagccaccatcccagttccggatgaagcaacaggtccgcatgtcccacgcattgcagcggttccgacaaacccagatgtcggtgggtgagaatcggattcttcttatccgcgtggaaggcacggattgcggtgccaagatagcagcgttccccgtcacgaacctgcggaatgcactcacccaattcggatacttcccgttcgtaagcttcgaacgcccgaagcagtccatgcggcgcatagatgcgcatggccatttcgctatgttcgaaactggtgcccccctcagcggtcatcagatacacataatcacccacgcgatagagatgcggcgcctcagcccacaccgattccataccgtatccgcgccatattaccgtcttgcccgatcccgcaggaagaccgtcatcgacaaaagtccaagtctccggattaatgcgttgggtccagacctcggtctggccttcccattgcggattgaccgcaggacgggtctgagtccagtacacgttgccatccccgtcctcgaatatgtctggatcgatgccttcagcgccctcaatccagaacgggccatgccatggcccttcgatagactccgcttcaaggataaaattgccctccgcggcgtggaaccgcatcagctcgctttctgtgcaaccaccttccatagcacggcgatcatcaagacgggcaatggtgcatgcaatcacatatttgccatgaatcctgcgcagcgtcggcgcatagacaccgcccgaatcatccacgaaaggaataagcaggcgccttgccaggtcagcatctaccacattcgacacatgcttccagcacgtcatatcctcggaaacgtaaatgggaagacctgggacaagctcaaaagtagaagtcaccaacacaattcgctggaactcatcatcccaaatccaactcggatcaggattcattccacgaagaatgggattggtaatggtaatagtcgcggtcataaatacaccttattcagaaacgttcgtgagcatcgcatcattgcgaacaatcgagactttcgtttggcccaaaaacgcaaacaagccgtacaccggcgacataaccggcagacgacttgcctgcgaaggaaattctaggaagaaggaaggaaagatgagtggtgtgccggaacgccgacgcttcggcacaccacatccggctctgtcacagccgagtctcactgcttgatccagcgatgaatcaggagccctaacggaaactccctattcggctcacgcctcggccagggcgtcgatcatgtagttgttgatcgtggccttgacggactcgaggtgatcggacttggtggcctcgatgagcttggactgcgggatatccagagcgtactcttcgagggaagccagcgaggcggtgccgttctcgacggtcgcgccgatgccggaatcgaaggagctgtagcgctcggcctgcaggttctcgatgaccttgtcctcgtgcatcttggccgcgaccagcaggccggccgcgaaggaatccatgccggcgatgtgggagcggaacagatcctcggcggcgaaggaggtgcggcgcggcttggcgtcgaagttcaggccgccgtgagggccgatctgaccctcggcgaggacctcccacatgacggtggaagtctcgtacaggtcggtcgggaactcatccatatcccagccgatgagcttgtcgccctggttggcatcgagggagccgagcacgccggcctcgcgggcggtgcggatctcgtgctggtaggtgtggccggccaggttggcgtggttgccttcgaggttcagcttcatgaagtcgatgtcgtaggtcttaaggaaggcgatggctgtggatgcatcgaagtcatactggtgcatcgtcggctccttggccttcggctcgatcaggaactgagcgtccaggccgatctcctgagcatactcgtggcacatgtggaagaacttggccatgtgcgcctgttcgcgcttcatctgcgtgttccacaggttttcgtagccttcacgtccaccccagaacacgtagttctcggctcccaggcgctttgcgatctccaaggagtgcttcagctggccaccggcataggcgtagatgtcggcgaacggggaggtggaggcgccggacacgaagcgcgggttggtgaacagggaggaggtgttccacagcagcttgatgccggtggacttcatgttctcttcgatcttgtcgacgaccttgtccaggttcttgtcggtctcgcgcagggtatcgccttccggagcgatatcacgatcatggaagcagaagtactcgacgccgagcttctggaagaactcgaaggcatagtcgaccttggccagagcctcatcctcagcattggagtacttgccgtaccacggacgctgggcggtgccggtgccgaacggatcgaccagctcctgatcgaacgtgtgccaccaagcgacgccgaaacgcagccaatccttcatcttcttgccggcgacaaccttgtcggcatcgtagtaatggaaagccagaccctcctgcggtcccttttcacgaccgacatacggaatcttttcaatatcccacagacccatgggttgctcctttgctattggtttttactttcgtaagaccttgcttttcccgtcaagcggattcccgcctgtcttgatgtacataataaaatcaacttcctaagtttgtcaattcagtgaactattcggcgtttccattgaaaaatagtcaattgtcaactcagtgataaggtgaacatgtttgttgcatcgcagcgctacgcaacgaagcgcgcaatcgaaagaaggaatccatgagcgaaaacgtcgacaccatctgcgtgcagggaggctaccagcccggcaacggcgaatcccgcactcccccgatcattcaggcgacaaccttcaaatacaagtcaagcgaacagatgagccgactgttcgacctatccgaatccggatacttctacactcgactgcagaatccaaccaacgacaccatcgcagcgaaaatctgtgaaatggaaggcggcgcggccgcaatgctgacctcatccggccaggcggcgaacttcttcgcactgttcaacatctgcaacaacggcgaccacatcgtcgcatcctccgcgatctacggcggcacgttcaacctcatcaacgtgaccatgcgcaaaatgggcatcgaatgcacgttcgtaagcccggactgcaccgaagaagagctcgaagcggcattccagccgaacaccaaggcggtcttcggcgaatccatctccaatccggcactcatcgtgcttgatttcgaaaagttcgcgaacgcggcgcatcgtcacggcgtgccgctgatcgtcgacaatacgttcccgacgcccgtcaattgccgaccgttccagtatggcgtggatatcgtcacgcacgccaccaccaaatatatggacggtcacggctcctgcgtgggcggcgcgatcgtggattccggcaacttcgactggatggcccatgcggagaaattccccggactcaccacaccggacgattcctaccatggcgtgacctatgccaaggacttcggcaaggccgcttacatcaccaaagccaccgcacagctcatgcgcgatttcggctcaacgccggcgccgatcaactcgtggatcatgggcatgcatttggagtcgctgggcgtgcgtatggagcgccattgcgcgaacgcgctcaaggtggcgcagtggctgagcgccgacccgcgcgtcagctgggtgagcttcccaggccttgaggaagacaagtaccatgcgctggctgaaaagtacatgccgaacggcacttgcggcgttatttccttcggcgtgccgggcggccgcgaaaaggtgtccgcgttcctcgaccacctgaagatggtgtccatcgccacacatgtggccgacgcgcgcagctgcaccctatacccggcaggcatcacgcaccgtcagctcaccgaggagcagctcgtcgaagcaggcgttggcattgacctggtgcgcctgagctgcggcatcgaaaacgccgacgacatcatcacggatctcgatcaggctctcgccgccgtgcagtgattctcactcaaaatcacatcaggaaggccgtatctcccactcagaggtgcggtcttcctcctatccgagtggactcgcacgccatactcatcttgcacgggcacaccaatcatctgaaatcccttatatgtggcagattaaggcatcttcaaaatccgatttgcgctatatgtggcagattcacactacattcgagggtataaatctatagaaaaatcccgttaagaaatctcaggtctgccacatatagcgattttgacttttccagcaccgtggaatctgccacacataacggtttttattcagcctgttggtacgtccagcgaccggcaagcatagtgccaagcacatgctcgggcatggcacgcatggcctccggagaatcgattatgctcggatcacagtccagaagcaccaaatcggccgcgtctgcgtcccgcaaagccacgcgtccgaccgcggtggacgaagcgagcgccgtttcaaaatcaaggcactgctcaggttggaaaggctcgcggtcggaactttccgtaccgaataccgccgcggagatggccagccatgggtccagcggcgcgaccggcgcatccgaccccatgagcagtttggtccccgccttatgcagactattgaatgcgtaggggattccggcgggggtgccccagaatcgcgcgatgacgtcacgatcgtccatggcgtgctgcggttggatgcttgcggcaagtcccagctgcgcgagtcgcggaatgtcgcactccttgagcatttgggcatgctcaatggaaccatgcgcatgggtgcgttcggcacaatcaagcacaatggtgttcgcttcatcgccgatggcatgacaggcgatgtcgaagccatgttcgacggcgagtcgcatgtacgactcgatttgctcaggggcatagctcaatgtgccgtaggtttccggtctgatgcccgaatatggcatagaacagtaggcggaacgggtgttgagcgagccatcggagatcatcttcatcgcgccgacgtgacccaaaccatgacttccgggcaattcgtctccggtgtgccagccgtcgtcgatggcttgtcggagtctctcgggatatatgccagcctcgacacgcagaccatcaagcccttgcgagaatcggctaatccacgtgtcgatgttctccgccatctcatagtcgcgcacgccgaccacgcctttactcgcagcgtcgtgttcggcgttgcgcaacagatgcatcagctcattggccgcaccaggtcctttgtccagcttgcagtaggcgtcgaaccactcaagctcgccgacgagtccggattcgtccacatctacgccaagcttgcgcgcggcggcagagttcacccaaccgcaatgcatatcggcacttgacagcgccaccggctggtctcccgccaccgcatcgatcgcggccagggtcggctgggcgtcatcggaccacagggaatgccggaagcgcatgccgaccacatattggttcgggtcgagtgcgccgctttcacgacgctcctccaagtgtcgacgcaacatgtcgagcgcttcgccggcactgcgtgcatcaatcagatcgagccgtcccaacgtgtacgaccactgcgtgaaatgcgtgtggcagtcccacaatccgggaatcacccatatcttcgaagcagcatccgttggcctttccgaaggtcgcaccgaagctattcgcccgtgaccgacagcaatgtcgaccggcttatccgaacctacgaaacacacgttttcaatcacacacggctcgcccatacatcctcatttcaacgtgatgttctacccgtgccatggtatcccgcagcagcgcagcagcgcactttcgtctcaatcaggcatgccggcggccgactgtttatccacatttttttgcgcataacctcggttatccacttatccactgtttttcgaatgcgaatagacaacgtcccatccgaggaatcagaaaaatgcaacatgcgttacagttcatgcgcgaaggcacggattcctcgcaggaaagccgttgcaggattgctctgattcgcaatgggctaccatgtccgaaagtcaactggaaggttcgactgaacaatgggaaaatcgcgcttttggatatggcctatccagatataaaagtggccatcgaatacgacggaagacatcacgccggccaatggctcgccgacagcaagagacgtgaagccttagaagatgacggttgggcatacattcaagtgaccgccgaaaaccttatgaacgacttcgagaaaacgggcactcgcgcaacgagtggccgaccggatgagccaacgattaagcaagcccatcatgctctgtcaaagaatgccctcgggaaggatacacatccgcataacgtctctcgccaatggaagcagaaagattctcatctgaaagccactatatgtggcagatttgccatccccagacaaaccaaaaccgctatatgtggcagaccagaccggtttcaagcctcaaaagaccccaatcagtaccccctagacgagattttccttgggagactgccacatataacggaaatcatttttctgaaatgccaaaaactgccacatataggacatttcaaactgaaaacacggcataggcatatcacctttttcgtcagatcgaagacagcattccgaaaacgtcgtcatcatcgacgacgaggctatcgattttgcggcggccgagttcgcgcagccattcgtcgggttccgtatcggcgagcgcacggatgtcgagatgcaacggcttgtgccttccgaccaccacctcgttagcatccacagcttggaccggcccgtcgaaatgggcaaaggcaccatccgaaacatccagccgatccgcccgacccggaaggcgtgcggcacttcccaccgatccttccgtaccgttcgaatcacccggggcacccgcacggccaccagtcggacatatgcccaacaccgccgcatacgtgtcatatagcccgcgtcgacgtacagcgtattcggcatcagattcctccgcatgttttctgccgtccacaatgtacggcattcctgtggtgatgtagcggaagaaatggcgattgatggcgtcgcattccgcccgcatcacgtcatataccacttccacaccgttttcctcaagaatgcgaagtcctttgccggccacgatgggattcggatcgatcgaaccgaccacgacgcgcgttatgccgtgcgaaagaattagatcggtgcatgccggctgcgatccgacatggcagcaaggttcgagagtgtcgatgaccgtggctccatgcatgtcgacaccatgctcgtcggcatagtcgaaggccatgcgttccgcatgcggtccgcggtagcggtcgtggtatccggctgcgagaatctcgccgtcgcggaccaccaccgtgccgaccaacggattcggattcacccaaccggctcccttatgggccagttccagcgcctgcgtcatgtatttccgatattgaggcatgtcatccacggttccaagcatattgcgtcgattgcggtcccacatttcaaaatcgccacgagacattccgtaaatggataggcgcgaaccggtcatccgtcccatcgccgtacggcgtcgcacaataacgccatacaatgttggcagaccagcaaaggaaccagcgagaggaaacatcacatgcagcgcgaaatcatgacgtccattccgtttttgagccagccgtcgacggaggcgctcaatatgcccgaggatcttgccgtcgcgcaggatctcaaagacacactcgacgcacaccgcaacggctgcgtcggcatggccgcaaacatgatcggcgtctcgaagagcatcattgcattcgtggacgaggatttcggcggtcgcatcttcgtaatgttcaacccgacgatcaccgcgcaggacggcgcctacgacgcctccgaaggctgcctgtctctcaaaggcgagcgccgcacggtccgcttccagcgcattgaggtctcgtatgcggatcgcaagttccgcgagcgccatgccacattcactggtttcaccgcgcagatcatccagcacgagatcgatcattgcgaaggcattatcatttaacgactttttcaggcatggcacctagcggcttttcgggcgctccatctagcgacaggcttaggaaaaatcgtttgatgtaacaatcgtacgtaaccgccttacgttacagtttccgtaatgcaccgtagggcagtgtcaaaggagatttcatgggtgccatcgatatgttcaacgatttcgtcaaactcattgaaagcgagtccctgcccgtcgaagccgttgcgattgcggatggcgacgccattatcgcggaacgtcatttcgttcccgaccaggatcgcaatatttattcccatacgaaaagttatgtttcgacggctattggcattgcgattgaagatggcttgctgtcgctcgattcgcgattggtcgactcgttccccgagtatgttccctccgatgcgcaactggagttgggccagatcacgctgaggcacttgctgactatgtcgagcggtttcaatcatgcgtatttgatgaaccctgaccggcgcagtggtgttggtgcgcctgattatttacggtacatgttctctcgcagggttgaggtggagcccggcagcacgttctgctattcgtctgcggattctgatttggcgggccgcatgttggagcaggctgccggcatgcgtcttggcgagtatttgtatggcacgattttttccaagttggatcagggttggcctgtttgggaatgtgatccgcaaggtcatccgattgcaggcggcgggatctacatgtcgcttgcaaatatgttgaaacttggccaggtctatttgaatgatggcacttggcatggcacgcgcattgtcagcgaatcgtgggtcaagcaggcttccggtaagcagatcgacactccgtatagcaatatttggacgtgcggttatggctatcagttctggatgtcaccttatgagggggcatatcgtgcggatggtgcgtacggtcagattactacggttttgccgaagcagggtttggttgttgcgattcaatgcccggaatctggtgatttcgacaatatcgttcgtcctgctttgcatgagcatctgctgcttccgcttactgcctgagcgcacgactttcgcccataccgtcgtgtagatggggtatgggataattatgcacggtattgtgcgtgggttgcgttccggaatccttgattgagtttccgttgaccgctcatgcaacacgctggaattccaacgtttcttaaggatggaacacaacattggctgaattcatttaccagatgatcaaggcccgcaaggcttacggcgaccgtgtgattctcgatgacgtgactttgagcttcctgccaggcgcgaagatcggcgttgttggcccgaacggcatgggtaagtccacgctgctgaagatcatggccggactcgacaccgtgtctaatggcgaggcttctttgactccgggttataccgtcggcattctgcagcaggaaccgccgctggatgacaccaagactgttggcgagaacatcaagatggcgttcggtgagatcgctgaaaaggtggctcgtttcaatcagattggcgaagagatggccaatccggatgccgatttcgatgctttgatggatgagatgggcaagctgcagaacgatatcgatgccgcaaacggttgggatcttgattctcagcttgagcaggctatggatgctctgcagtgcccggatccggatactccggtgacggtgtgctccggtggcgaacgccgtcgtgtggcattgtgcaagctgctgctggaagctcctgatctgctgctgcttgacgagcctaccaaccatcttgatgccgagtcaattctgtggttggagcagttcctgcaccagtacaagggtgccgtcatcgccgttacccacgatcgttacttcatggataacgtggctgagtggatctgcgaggtcgaccgtggtcagctgtacccgtataagggcaactacaccacgtacttggagacgaaggccaagcgtatggagatccagggcgccaaggacgccaagctcgccaagcgtttgaagagcgaacttgattgggtgcgttcttcgccgaaggcccgtcaggctaagaacaaggctcgtctggaacgttacgaccagatggagcaggaggctcgtaacaataagaagcttgacttctccgagattcagattccggctggtccgcgtctgggctctactgtgctggaagccgagcatattcacaaggcgttcggcgaccgcgtgctcatcgacgatttgagcttcacgctgccgcgtaacggcattgtcggcgtgatcggcccgaacggcgtgggtaagtccaccctgttcaagaccattgtcggccttgaaccgttgacgtctggctcgttgaagatcggtgagaccgtgcagatcagctatgtcgatcagaatcgtgctggtcttgacccgaataaaaacctgtgggaggccgtgtctgacggtcttgacttcatcgaggttgccggcgttgaagtgccgacccgcgcgtatgtggcgtccttcggtttcaagggttccgaccagcagaagctcaccggcgtgctgtccggcggtgaacgcaatcgtctgaatcttgctttgactctgaagcagggcggcaacctgctgctgctcgacgaaccgaccaacgatcttgatgtcgagacccttgaatcgcttgaaaacgcactgcttggcttcccgggctgcgctgtggtgatttctcacgaccgttggttcctcgaccgtgtggccacgcatattctcgcgtgggaaggcgatgatgagaatccggccaagtggtactggttcgaaggcaacttccaggcctatcaggagaaccgtgtggcccgtctcggcgaagacgcggctcgcccccaccgtctccatcgcaagctaacgcgctaagccgttaagcagacagtcctgtggactgtctgtaggcttggcctgagtgaggcgacagccgaacgaaggcaacaatgagccttgcgaagcaagaccataattgcagggccacaggctagccgttaagcagacagtcctatggactgtctgtaggcttagtctgagtgaggcgacaaccgaacgagggtaacaatgagccttgcgaagcaagaccgtaattgcagggccggttaaccccatatttcagtaaagcgccgtgcttcgttacgaagtgtggcgctttgccgtatgtgaatcgtttggcgattacctgccgttcacgcttctcacgcattcgttacaaaacaatccggcgaaatttaccgcccttgcgtagactcgtttccagaacgaagcgtttatcgtatgcgactcaaagaatcgaggcccgttatgacacagacagcgcagacagcaataactccgttacaacggttggcgaaggtgcttcaactgggcacgccgtccatgtaccgcaatcatatgtatgtgaatggtgaaagcctgtatttccccactggccgcgtgtatggcggtcaggtgattgcgcaggctatgatggccgcatccaaaacggtgtcgccgtctcgtctgccgaattcgattcatggctatttcatttctgccggtgatattcgtcaggatttgctgtttgatgtggagaatctgcgtgatggccgctcgttttcggctcgtcgcgtgaatgtcacgcaggctcagggttcgattctgacggccatcgccagcttccaggagcagggtcaggatggcattgagttcgccgatcccatgccggaaggcgtgccggagccggaaacgttgaccagtgcgaagcagctgatggagccgtttgccgagaagtcttcgtttgccaaatattatgcggaaaagtcgccgttcgacattcgtcatgtgacacgcacgattatgttgggtgccgataagaagagcgccaacaatgattctggtaaacagatggtgtggatgaaggctgatggcacggttgatgttccgcaggttatgcatcgtgcgatgttggcgatgggctgcgatcaggtgatgctggagccggtgttgcgtcgtgccgggttaagtattgccacgcctggcatttcgttcgcttcgatcgatcattcgatgtggtggtatcgcgatatcgacatcaatcagtggcatttgtatgtgcaggatacgcctaccgcggctcacggccgtggcttggggcaggcgaaggtatacacgcaggatggcgaacttgttgcctgcatgactcaggaggcgatgatccgtgttcccgaagaggatttgaagaagtaaggacaatcaggctttcgtttgggttgccgatttggttgccgcggccgcgtaacggtttcgttgcgtggccgttttcattttcggactttccgggccgtcgattggtgggatttggcacagccactcccccgcaatgccaatgatcatatcgattatgcatacgattgccgcgatcgcgcattcgaggatggcttggctgtagaacgttgcttcgccatgcggcaggctcatgatgagctgcccaccataccagccggccaacgccgctcctgccacgcccaacgctttgcatgacaccagcgtggcgaacgctttctgcgggtccaaaggtttcagctgcgcgcgtttttcggaatctgtggtggtgtatttgtggatctgcaatgccatataaagcacgacgaatcccagaatcgccaacaccacgggcacaatccatggagcgccgaccaatgggaaacctgaaatctcgccatattttgccaatcctattccggcaagcaatcctaatgcggcagcgagaacgtagcaccaccaaggggttctgcgcgctttcatagcgtacctccgataatccaattgtcggtcagcagtcccacctgcgcggcatcgggggccatggctagtaggaatgataccggatccttacccagtcgtgcatcgggatccatgtcgagccatggcgcaagcactgcggcatgattgcgtgcggtgggccacggcaccttgcagtcaggctcatcgcattccacgccttccatgtcgatcaggtcgagatcaaggtcttcgccgacggaggcttccacattgcctaatgcttcgattagatcctgagcgcccatgcgcgtggaaatctggattaccgcggccattttgtcggggagtccgtcgagttggctcacatggtagaggggtgagatgccctcgacttggttgccgggaatgccgtccaacgtgacgatggccatgcggaactgctgttcggcatcggttgctgggctgtcgagtgagatcaccgcgcgtttcgatgcgggttctggctgtgcagaagcgagtgccgccgctttggctgcggcggttccttccggcaaatcgctggaatcgatcgcaccatacgcttcgtccatatcatccgcatcgcccgcattattggcatcgcaggcaaggtcgtcgataccgcagccggtcggttttcccaccatccaatcatcagcgatttcgtcgatatggtcgcggtcggatgcctcgtgcaatagctgggccacggaaccggcatgttcgcccggcagttcagcgtccggctcgagcgccagccacggacccagcacgaacgcacgctgccatgcgcgggggtgaggcagcgtcagatccggatcatcgctgctctgcccgtcaaaatcgatgatatccagatcgagtgtgcgcgaagtccaatggtcggtacgcactcgaccatgttcggcttcgatacgctgcagtcctcgcagcagttccattgccgacagtttggtggtcacggaaacaaccgcattgtaaaagtcgggggtaccatcgggcatgccccacgcatcggttcggtacagcggcgaaacgcccgtaacctgagtggatgccagtccgtcgatcgaacgcaccgcgtcacgcaaggtggccgccacatcgccttggttaccacccatggcaatgatggcatgatgcacttgcgatgcagccgaagttgtttcacgggaacgttccacggttacgctcacgtcgtcgaatggtacgacgattggcgcgctcggcttgtgcacggtcacctgcgtttgcgccacggctggatattcaagaatcatgctggcgatgcgatcagcgagtttttcgatgagatcgacatgttcgccttcgatgatggcgactattcctttggcgatggcaccgtaatcgacggtgtcccgcaggtcgtcggaatgcccggctggcgcaagatcaagaaacagcgtggcgtcgacgacgaacgtttgcgcacgctcatgttcgaaatcaagcactccgtgtttgccgaccgcgcgaacgccagtcaatcgaatctgatccatgccagcctttctttgcatatcccaaggttttagtgatgtgaggcgttgccgtgcctacgcagtcaagagcatacgaacgtatgcacccaccgcgcgtatcagacgttggcgaaggcacgccacgcgttgccgatcgccaccgcgtcacggcttttctccacgtcatgcacgcgcacggcccacgctccatgttcggcacatagggcgctgatggcggcggtcgcattgtctttgctatccatgtttggcttgtcaataccagcatcggcaagcgccgcgccgacgaatcgtttgcgcgaggctccgatcagcaccggatacccggtagcattgaacctctccaatgccgtcatcagcgggaagttatgctcgacgctcggtttggagaatccaagacccggatcgatgatgatttgtgacggtgagacgcctgcctgaagcacgtcgtcgacctgcttcatgagttcgtcatacacgtcatccaccacgccattggcgtacacggacgtatcagcgtcaggcacgtcgcctgcggagccggcaagccagccgcgccaatgctgcacaatgtaaaggctttccgaatgctcggccaccacatggggcacttcgcggtccagccgaccgccggacacgtcgttaatgatctgcgcaccgtgctccaacgccatgcgagccaccgatgcgcgtgtggtgtcgattgacagcaccgcaccttcctgaatcaacgcatccacagcacctagcacgcgggtttgctcgtcttcctcgctgacgcgtttggctcctccggggcgagtggattcggcgccgatgtcgatgatgtcagccccatctttcatcatcgcctcgccgtgcgctttcgcattcgcgggatcgagccataaccctccatcggagaacgaatcctccgtaatgttgagcacgcccatcaccagcgtacggtcactatcatgaatcgatttcatatcaatggtcatccggtttcccctcctatatccggttattgttattggcgattcgacttgctgcagtcgcgccgatcacgcatgctgcgacagaatcagactcatggcttcggctcgcgtcgtcgcgtctcgcatgcaaccgcgcaccgccgatgtgaccgtgcgcgattgcgccttcttcacgccacgcatggccatgcacatgtggtcgcattcggtgactacgatcacgccacgtgcttcgatgccttccatcagcgcgtcggccacctgttgggtgaggcgctcctgcacttgcggacggcgggcatacagttccaccagtcgtgcaagcttgcttaggcccgccacttggccgtttgacggaatatagccgacatgggctacgccatggaacggcagcaggtggtgttcgcataccgagaagagttcaatatcgcgtaccagcaccatttcgtcagtatcgactttgaacttggttttgagcacttcctcggggccgtggccaaggcctgcgaacagctccttgcaggcacgcccgatacggtctggggtgtcgagcaggccttcacgatccgggtcttcgccaatggatttcagaaacaggcgtactgcctggcgcacgccttcctcgtcatagccgacaggcccggccgcatgggcggcacgggccttgtcgtcgaagagggtatcgaattcttcggtatcgctcatcagttggtcaatcctgcgcttttcttcagggattcgggaatcggaaccggcggaatgtcggaatccgggcgcttgctgtcactcagccacacttcacgcttcggtgccttcttgacattagcgaagatttccgcaagttccttttcgttgagtgtttccttgacgagtagctgacgtacaagctcgtcaagaatctcacgattttcgttgatgacgttccacgcttcggtatgcgcggtttccaccagtttgagcacttcctcgtcgatgatttcggcggtgcgtgcggaatacttgtggttcagcgatccaaggtcgctctgctcgtcatcagaccacttgatggcacccagcttgtcggagaaaccgtagtcgagcaccatctgacgtgcgatgttcgtcgccttttcgatgtcgttggaagcaccggtggtcggatcgtggaacacgacttcctccgcggtacgaccgcccatagcgtacgccatctggtcgagcagctggttgcgcgacatggaataacgatcttcggtaggcattaccgcggtgtagccaagcgcacggccacgcggcagaatggtgaccttggtgaccggatcggtatcgttcatggcggctgccaccagcgcgtgaccaccctcgtggtatgcggtgttgcgcagttcgtcgagcgccatgcccttggaacggcgcttcgggcccgcctgcacgcggtcgatggcctcatcgatggcacgattgtcgatcagctgcgcaccggcgcgggcgcacaacaatgcggcttcgttcaacacattggccagatcggcgccggtgaagcccggcgtacgcacggcaatcatatgcagatcgacgtcaggcacgaacggcttgcccttggcatgcaccttcaaaatagcctcgcggccttccaaatcaggcgcttcgacggccacctgacggtcgaaacggcccggacgaagcagtgccggatcaagcacgtcggggcggttggtcgcggcgatgatgatcagattggtatcgttattgaaaccgtccatctcaactagcagctggttcagcgtctgctcacgttcgtcgtggccaccgctcataccggaaccgccacgcttacgaccgacggcatcgatctcatcgatgaagatgatggccggagcgttcttcttggcctcatcgaacaggtcgcgcacacgggatgcgccaaggcccacgaacatttccacgaagtcggagcctgccatggaatagaagggcacgccggcctcgcctgcgatggctcgtgccagcagcgtcttaccggtacctggagggccatacaacagcacgccacgcggaatacgggcacccaaagccttgtaacgagatggatccttcaggaagtccttgatttcttcgacttcctgcacggcagcctcttcgccggccacgtcggcgaacttggtggtcggggtctggccttcgagcagcttgccgctgttcttcttgccgcccataccgaacatgccgccggcaccgcccatacggctcatcatgaaccagaacagaccaaagataatgaggaacggcagcagcgaggtcagcagatacgtccaaatgctgctctgctgcatggtcgccgtccagcccttgaccggatcagccttctgcacggccttgaccacggttgcggactgcgcgtacgtgtagtagaactgcacgttttttccgtagttcttcatacgcccggtatccgggtcggtagcggagtagtcgctcttaagcttgagcttgacctgctgggtgttgtctacgatctgcgcgtattcaacattgttgccgttgaggatctgcagaccatccttggtgtcgatggtctgggaaccggttccggcgaaaatctggaacatggtcacggcaagcaatgccacaaccacaacccacagccatggggactgccagaacggacgcggaccgccattggatccgttgccgttggacttgtcacccttgccgttggaatcattgccattgccggcgttattgttgcgtccaaatggattggtgaacgggttattgccgccgccgttgttattcggcgactggcccggaccaggaaaactcatgcccgacctccttcatacacttccggcttcagtaccgcgatcgaatcgaggttgcggtatcgctcgtcataatccaaaccgaaaccgaccacaaattcatcgggaatctcacgtcccttatatttcacaggaacatccaccttacggcgcgccggcttttccaacagcgcaaaaatctccacggaagcggcaccgcggctcttgagctcatcgacgagccacgccaacgtgacgcccgaatcgatgatgtcttccacaataagcacgtgacgaccgcgaacatcggtggacagatcctgccgcacggtgatcttgccgctcgattgagtgccggaaccgtagctcgacaagctcatgaaatccatctccgcgtggatgctcatggcctgcgagaacgccgcaagcgtgttcactgcacccttgagcacgcaaaccagcagcgggttcttgccacggtagtcctcactggcctgggccgcagcatggttgatggtgtcggcaatctcttctttactgatcagctcgtgatcaatatcttcttgtacgtcagcgattcgcatgcccaccatcttggcacacgcgaatgacgtgtttctggcgatatgctgaatatccgctgggaagattcacacctttctggccgtgccagtcgcagatcagcctgtcgatcccctcaacctgccgtgccatgcacgaaatgcctgcttctgcaagcgagagcacaatcacccgtcttctgatggcaatgtcttgcgattgcaacgcacgcacgtcgatgattatctcgccgttgttcacggttacgccttgctcgcacacacgttgcgccacactgtcaagatatgcgcgatcgtcttcggcaagcctcgctccaagcgcaagtttcgacacgacgtcacttcccgcaaatgattcaagatatggcatgagatcgtgccgtattcgggatcgcagtggatagttcgcgggaagggactcgtttccatccgaattccccacatctggcccatttgtgggatcgtcccaccaggcaagccgcagatcctcgcagatgccggtggtttcttcacgggtcacattcagccacgggcgtagaaaacgcaccccgtctcgtatgaaggaaccgttcataccgcaaaccgcatcgaggcccgcagaacgcaacaaaccgatgattacggtttccgcctgatcgtttttcgtatgagccagcagcacggccgaagcgtcggagcatgcgtcgacaatcgcatggtagcgtgcttcacgtgccgctgcctcaacaccgatgccgcgggagtcgggtacgtcaatcgcacgaacacgaactgggtcaagacccaacgcaacgcaacgatcggcggttgcccgcgcaacaccggcagagccttgctgcaactggtggtcgatgataatcgccccgcatcgcaatcccaatgaagcgcacgttttcgcagcaaccgcagccaacgccatcgaatcgcgcccaccggaacaggacaccataatcagcggagcgtccacatcgggcgcgtgctcgccatgacgggcgaaacgggcatcctgcaatcccaaaccggccgattccaacgcggcgcgcagttcgccgattcccttgcgcaaacgtgacgaatacaccatggcgtcacaacttcggtagtgctgccacaaatgtgtcgatagctgatttcgcggcttcggaatcatcaggatcgttgacgatcacggcaaaactcaacgcaccgccattatggcgcgacacattgccggtcatggaagtcacatctcccaaactgccggttttggcacggataagaccagcttcgtcagcatcgttcaaacgattcgcagcagtgcccacaaatcctacaatcgacagcccctcagtggcggcggaaccggacccgctcgtcagattacgctgctgcacgtcaagcagggtatgcgcggtgagtttggaatcctcagccagtcccgagcagttaaccatggtgaggccttcggtggaaatcccccgctgagccagtacctgttcaaccgactgcaccgctccggccggtgaattgccggcgttaaggtgcaaagccagcagtctgccgaattcctcggccagcgaattgtcggaatgccgaagcatgaacgccatgatctcgttcagcgatgcggagctcaccgtcgcaatggggctggtcccgtcgggaacggctccctgtttcacggaaccgttcaccgcaatgccccgctcagtcaggcgttgcgcgaacaccagcgcggcctcgcgagccggctgcgtgctcaaaacgggatatgtgctgaacgtatcgggatccgtaggattagcaccgttccagttgcgcccgccatccacggccatggatgcggtcggcgcgtagtacacgtggtccggatcgagttcggcgatgccgttgggccaacggtcgttgccgaacagggaatcatcgtagacgagcgtcacggaagtgatgccccgctgccgcaacgcttgggccgtgtttgccgcaagcgttcccagcccggcacgcccattgatgtgcgccgaatcagattcgccgacgccgagcagcatgtcgccgttgcctttgagcaccaatcgcgaagtgccatcttcgcgctgctccaaataagtctgcgtctccaacgtcgaccccatgtcgagcgtggccgcagccgcatacgccgtcagcgttttcatggtggacgccggcgtatacggcgtgtcgagattctgctcggccaccacattgccagccgcgtcggcgatggcgatggcgtattcaccgccaaaatcggaggcagccgtctcaaactggctgatcagagcctttgccgcaacggcatccacggttttcgaagcgtcaagccctccgaccatcgtcgcggccgcaatggcattgcccggcgttttggctgtggcatgctcgacttcctgcaatgtgagaacacccggcaacttgtcgaaaatgtcggccacgacatagccgacgcacaacactgtggtgagcgacacggaaagcgccaccgtgatgtatcgacggcgtttcacatgccggtattcagccgaatcatccatggaacaacaacactccagtcataagaggaaatcgaaatgaaaacgaaaaggcaggaacgcgcaagccagcgaacgaacgtcatcccttatgctcgatcggcttccattcggacttggcgaacatcgcctggaacgagatcggcacataactgaacatgtagatcgggaagctcagcacatacgcgaacagctccttgttggtggcgccaatctgatcgcgttccacaataatcgtcaacgcggccaacgccatcatgccgatcaccgacgtcacaatgccggacgtccaaccggtcaacgagctcaactggctctgccatgtcacgaatccgcaggtcgcgaacaacagtcccagcagaacgcgcgcaataccgatcaccgtgaacggacacaacagcagcgtgaaatcaacggcggaaaaatcgcgttccctgatggcgcgtttgaccaaagccggcccgtaataacggaacacttgcaggaagcccttgctccaacgcaaacgctgacgccagctctgcgcgaaggtgacaggctgctcgtcatacagaatcgcggtaccgcagtagccgatgcggtcgccgtgcagcaaggaatccatggtgaattccaaatcctcggtcaaaaggtggaatttccaaccattattgcgacgcatgatctcctgcgagaacatgaagccagtaccccctacatgacagctgttgccgagccacatgcgtgaggccgacaggaatcgagattcacggatgaaccacaatgcagaaccggaagagacccaattgtcagacaaattcacggaattgcggtagctggtgagaatcttgaatcccgactggaacgccttgttcatctcttcgacgtaatgcttgtcgagcttgttgtcggcgtcgaacacgaagaacgcatcgtacgggtcggatgcaccggaatcgttcatctgatcgagcagatacgtcagcgcgtagcctttgcccacaagctccttgttgaagcgttcgatcacatggcagcccatattgcgcgccacttcggcggtattgtcggtgcaattgtcggcgacaagccaaatgtcgaccagttcggtcgggtaggtctgcgtttggatgcaggtaatgaggttgccgatgacgttcgcctcgtttcgtgcggaaatcagcaccgcgtaacgcttgtccatcggcgcgtcgggaaatttgatcggcttggtgaacagggagatgagaatgcacaccgcctgatagaccacccctgcgccaccgacgatgaccagcagaatgtcaagtacgctcagcagtaccattaacgccacctacttcttggattgtcatccgcgtttttcgtacttccttcagcttcccgcgactcgccgttcttccgttcattgccggattccggattttcgttggattcctgagatgtgttttcactctcaagaccctgcaatggcttgcgttccgttttgtccaacacgtgcttcggaatggcgacggtttcgtccgattccagcgattcctcggaacgggtgatattgtacgcctgctcctgcaactgccgcacttcgtcgggaataggcacatgcgcactggatccctgcaccgcgcgaggcatattgtgcagatgctcgctgagcacttcggcaccttccaccagcttcgacttcttttcaggcaccggatcgtccatcagcggggaatcgaccagctcgtaccgctttgtataggtgcggaagatcgtctgcacggacgcgaccaccggcaatgcgaggaacgcgcccaacgcgccgaacagcgaggtgaacgccagcaccgcgaggaacgccacggcatcgttcacatccatggtgcgctgggagatcttcggcgcgaaaatcagattctcgatctgctgatacacgcagataaacaccagcaccgccacggcctgccacaatccgcagctaccccatgcgaacagcactggcaacgcgccgccgatatacgtacccaacataggaatgaactgcgaaaccacaccgcagaacagcgccaacggtagccaatagggcacgtgcagcagcatcagacagattcctgtgaagaacgcgttcagcaacgcaagaatggcgcgggagaacaggaacgacgagatctggctctggctcaccgtccatacgaacaggaatcgccgctgagccgccggagccatccactggcatgcggcacgacgcagtttcggaccagccgctgaaatgtaatacgtggtcatgattatcgtcatgaggttaatcaggaacgaaaacaatcccgacaccgtattcagcgcggtacccgcgaaatcagtgacccacgacgtttgaatgttcttcagaatctcattgccgagattattgatctcaggaagctggaaattcgcgtattgactggcgaactggcacatctgctcatacaggtcgggcagaccgttcaccaaggcgatcatctgctgcacgaacaggttgccgaacagtgtgaacagcacgccgagcatcacggccagcatcagcagtgagaacaacgacgcgaacgaacgtttccagccatgcttgaccagcggcaccaccaccggttccaccgcgagcgcgatgaacagcgagacgatgatgtcgatcaccaggtattcgattttgccccagctgcgccagcagaaagtaaaccccacaatggctatggcgatgtatagcagcgcacgccccagccattccggtggttttcggggatctcctttggctggaaacagggtgccgaggtcccatcgctgttcgctggtgttcgcaccgttttcgctctgcgtattgttcattcgctgttcgctgtcgctcatggctccctattgtagcgataggcgtcgtgtacaggctgagctattgtggtagttatgctgaacgtttcaattgtcatccccgcttggaatgaagaggagcgtatcaacgattgcctgttgaatgccactaggcagaccgtgatgccccatgaagtgatcgttgtcgacaatcgttccaccgattcgacggtggccatggtggagcagttcatcaaagaccacccggaggcacccatccgtctgctgcatcaggatgaggagcaggggctgattccgacgcgcgattatggtttgaaccacgccaccggcgacattctgggccgtttcgacgccgattgcatgattcgcccggattgggtcgaagtggtgtccggcattttcactgaggacccggaggccatgggtgccactggtccggtgatgtattacgatctgccgagccgccattttggtttgcgtggggataattccacacgcaagcgtatttacaaggccgatggcggccagccgttgctgtttggctcgaatatggcggtccgcgcttcagcttggcgcgaaatttctgacgaagtgtgccgagacaaggccgatgtgatgcatgaggatatcgatatttcgctgcatctgctgggcaaggatctgaaaaccgtgtactgcccgcgtatgatcgccggcatcagcgcccgccgtatggacacgtcgctcacgtcgttcaacaattacatgcgtcgtttcaagaacacgttcgacgcgcatccacagcattcgcgcaagcataagccggagattctgctcaccgcgctatatccggtgatgcatctgctgtatccggtatggcagaaggtgcttgacaccgccgatatcaatcctgcggaggcggcgtggatcaacgagcagatggaattggccgagcaggaaggccgcgaatggtacgatgacactcccaccgatgaggagtggagcgaaaagcacgagtaattccaatacttgcgattgataatcacggattattgtttacattatttcgattaatccgtaatttatgtgcagatataaaaatcgtggtgcgaatgctttgtgaagtttcgcaccacgatttttaatgctttcagcgatgttctctcacaatcgggtttcactgcagattcgctgcatgcgattgccgattcgtgagagttttcgcattacatcaggctcttgtagatggcgaggatgtcttcttcggtggtctgacgcgggttgcccggggtgcacacgtcgttgaaggcgtcgtgggccagtgcttccagatcggcttcggttgcgccgacttcggagatggtggtcgggttcttcaggtcgacggtgagcttgtgcacagcctggacggcttcttcgcgaaccgtctcgagatcgccggtgtaggcatcttcgacaccgaaggcgtcggcgatgtcacgatacttctcgccggtgaagtccttgttgtattccatgaccggtgccagcagaatgccgttggcaacgccgtgggcaacgccgaggcggccgcccagcgggtgggccatgccatgcaccagaccgaggccgacgttggagtaggccatgccggtgatgtaggaggcgtaggccatctgctcgcctgcaggaacgtcgccgtcagcgctcttggcaaggttcttggcaatcatgcggatggtctgcatgctcaggcagtcggacaggctccaggcgcccggagtgatgtagccttcaatggcgtgggtcagggcgtcaagaccggtggcgaccttgaggccgcgcggcatggagtcggtcagatcaggatcgacgaaggcgacgatcggaatgtcgtgcgggtcgacggccacgaacttacgcttgttggcggtatcggtgaccacatagttgatggtggtttccgaagcggtgcctgcggtggtcggcacgccgaagatcggcacggacgggttcttggtgtcggcaacgccttccagggagagcacatcggcaaactccgggttggcggtgatgatgccgatgcccttgcaggtgtcttgcggggagccgccgcccagaccgatcaggaaatcagcaccggatgcggcgaacttggcaacgccatcctgaatgcattcgaccggcgggttcggcttgacattgtcgaagacctcgtacggcatgcctgcctcatcaagcacatcggtgaccttcttgacggtgccggtttccagcagtaccggatcggtgacgatgaacgccttggtgaagccatgggacttggcaacgcccgggatctccttgatggcgccgcgaccgaagtatgcagtctggttgaaaatcatgcgatagaccatagatgtctcctttaagcgactgtgcttgttcgccgtgtcatagcaaccgttgccatgaccaacgattctcatcatagaccccatgttgcgattcggctggaaatcgacacaaccttttctgtgagcgttctcacaaaatatgcgaacgcatcacacaaaaacgcataaaaccagacaatacggccttatgactcgaataattccagctcgacctgcggcagatcatccttggagaacacccacatggtctcgtctttggaacgtcgatcggcgaaaatcgtaagcaggaacttctctccgtcgtttcgcgtgtacccgtactgcaacacgccgaccgactcgacgcgggcatgaatgaagtcgtaatccataagcagggagaaactgtctttgcagaacggcgccaccaatcgttcgcaatagtcatgcagcgcgcttttgaacgaaccgtcatgcgcgtcaagcatcttctggaaatagtcgggcaccatgatcgcacgctgtgagtcagtacgcagattcaccatgcatgcgattgaatagcgtccgttcaaatgccgcagcaacgattccatatcctgattacgcaccagaatgtcctcaagttttttgttgagtccgcgcagctggcgtttgccgccgcctcgcacgtagtattccttcttttcgcggcgcatctcgttttcggcctgttcgatgattttcggcagatcggaagtcgactcgctcgacgctacgcccactgatatctcgcagccttgcgtatgcaagcgctcacgcatgtagttcagctgcttgcgtgtctgcgcttccgtatgcgcggaactgattatcacgaattcgtcgccgccgatgcgatacaaccggtcatcgccgaagaacgcgcgcgccgcgtccgcgaactcacacaacatgcggttgccctgcttatgcccgagatggttgttcacctcgtgcaggccgatcatatccgcatacacgcacaccaccgccccgatgtcggcgctccgcagctgctccacatcgctgtcgtatgcattgcggttgagcaatcccgtcaaggagtcctgccgatagatttccttcatgttcttgacgattaggtcgagcgacaggtcgaatccgatcagcaccacggcccacggattggcctcactgcaatcagggggtaccagcataccgaatgcgatcacgctggttttcgcctcgacctcgcttctaaaatatgtgaattccgattttttcttactgaatagttggtcgcgcaaatcagacaatcgcgtgtgtttcaggaattctccggcatcatctggatgaatgatccgttttgaaaccaatgcatggcagtaatcatgaaaatcatccgcatacacgtccggaagtttcggatcgcgtttgatggtgcgatattctcccgtgatgagattcagtcgggacagttccgcaacgcccttgttaaggatttcaaaaatatgcgccgacaatgacgacgattcgagcatgctgcggccgttcgtcgacatgcggtagtcgcgatgcatcagatctttggagatattccagaaatgctggtcatccgggcggtgttccagcaaatcctccatctttcccacagtgagcggacggtagaaataatatccttggatgtacatgcatcccagctcacgcagcttgctcacctgttcggcggtctgcgcaccctccgcaatgatcgacagtctcagctggtaggccatgtcgatcacggattcgatgattttcaaacctttcgccgcattgtcagcattcaggtcaacgaatttcatgtcgagtttgatggcatcgacgttgatgtccttcaacatgttgagtgacgaatacgccgacccaaaatcgtccatcagcacggcaatgcctcgcgcatgcaggtcccgaatggtctcttcgaccacatccatgttatgtgcgatcgcactttctgtgatctccacctgcagcaggcgagcatcgatgcagaaccgatcgagcaggtcgccaagcactcgcgccacatcgatcgcctcgatatccgtcatcgacacgttgacggacaccggcaccagattgcgcccctccccatcccaacgcgacagcatttcacacacggaacgccagatgaacaaatcgaaccgcgtgaccattgactcacgttcaagcagaggaatgaattcgccgggagacaccaagccatattccggatgattccaacgcaccaacgcctccgcacccacgattgcgccggtttcagcattgcatttgggttgcaggtagaagcagaattcgttgttgtcaaacgcctggttgatgtcgtcaagagagaatctgggtacgatttcgtcgttgctgggcgccctgcccgtggattccagccgcgcgcctgcggcaacatcgaattgattacccatgatactcaccgttgtactgtatcagcgtcacgtcttcgacaccctcaatggcgcgaacgcgttccgcgaacgtcatgtccttatcatcacagaatacttcaaccgccatttccgtgcgttcgccacgcatggttttggatttgacgaagaatttggtgcgtccgaacgcgcgcgtgatctcatctcccactacatcgcccacatagtggatcaccgcaatgtacacgcgccccttgtcttgacgcgagtagaacagcgccaacatgccgatcatcaccaatccggcaacaatcaccagcacatacatgccggcgcccgccgcaataccagacgtgatcgcccagaacaaatacaacagatccatcggatccttgaccgcggtacggtagcgcacaatcgataatgcaccgaccataccaagcgaaatcacaatattcgtactgatggccagcgtgaccatgcaggtgagcacgcacatgcccaccaacgtaacggcaaaactgcgcgaatacaccacacccgtgtagaaacggcggtacacgcagtaaatgacgatgccgacgatcaacgccaccagcaacgccagcgccattttgggcacattgtattggccgaaggatttcagcaccgactttttgatcatgtcattgacactcatatggtttctttctctcctgcttccttgattcgtaacgtttgtttttgctggaatgccagtcaacatgccagctggttacagacttggctttacaggctcggcacgctccaaccttcctgccagtagccgaatccccgcaaatacgaggctttgtcataacagagcacgtatttcgaagccgatgtcaactcctgcgccttgccgggcagcagatcacgcaccacttgcggcaggaattcggtgaatttgacctccatcaccagttttcccggctcaagcacgggcagtaccggcagtgtggagtcgaaaacatcgaatcctccaaccgccgcacgcacgttcatatcgaaggtgacgcgcacggtaccggcgtcaagaatccacggttcgcgctcataatcgacgatcacgcgagggcgcatcacattgcacatgcattccacataaaactcacggcacaactgatactcgctgtcacgcagaaattcataatcgccggcaagaatacggtcgaactgctcgtgcgtgagcggtgcatcctccttgtagatccaactgtcgcttttgcgtttgcgttccagtttgatcacacgatcgctgtaatcgtagatgcgaatacggtatttcctacgcagcagcacaccgtcgactttttcctgatatgcggtgttccaataatcgtcgaaatacaggctgcgaatcatatagccgccgtttttcgcatgcttgtcgaggccaagcagcggcgccatacgcacgttcaagtcggctttttgcgcgtatgagatcagatatttgagctcatgacggaaccgttccttggctgtgcgcggtggaacggataattcctcgccgacgcgatgtttgatacgttgcagcagcgacgttccgcgattgccaccatcactgcacattggcatcctccacaatgctgccgtcggctttcacatagaaacacttggtgccgtagaccttgttgccgtcggtgacgtagtagtcaaacgcgtcctgcgtctcgcctgatgcattgcgcacgctcaccttgatgaagtactggccttcaccaggcatatccatcacggcttccggcaatacgaggtcgctctgtgtgaacaccacgtctttgccttcgtaatccttggccacggtaacgctatagcgcagatcctcatcgttgaaatcataggagacatcccagctgagtttgagcttgccgttggtaggagtcggcttgccgatatagaacggcatgggcttattgaacccggttcggtacgtctggtagttctgttcgatttcgctatgcaattggtttgccaccgtgtcgtattggcttgacgtcagaggctcatgcatgcagtcgggcatcttccgcacgtatggttcaacgatggaacggtaccgccgcaccatggaattgatgcgatcggcgctcatatacttgtattcgtctttcacggccttgccgagcgcggttcggaacgacttggtttgcagacaacgtcggaacagtatgttgccccaatagttgctgacaccgttctcccagctttggccctcggaacgttgcctgatctcgtattccttgcgcatgagcataccatcgttatcccagtcgagcaggtaaaacgtatccgaattcgtgggactatacaggtacatattgcggctttgcgtatcgatattgccggtcagcaattggaatgccatccaatatgcgagattttcggtatcgaaatatttgccgaggatttcgcccatcggcactgaataatcattgagatcgttcagcatggcgatcagtttggtatggtcgttgtcgcctttgatttccagtttttcttcgaatttcgcttgatcgtagtcaggatcatcggcgagtttgatcacgtcttcgtctcgatagaattcgaaataattgactttgtacagctgtccgtttttatcgagtccgtgcacctgcaatgcggttttgttgagctgttcgacttgcgtgtacagaccgtaatcgtcgaaggaatccgatccgctggtctcgtctttcacgtacaggtgcacgaattgcgtgcgcagtcccatcatctggtcgatgcctttgatgagatcgtacgccattttgttacggaaacgcagaccttcgcccatatgcttgttcaatgcgatggtacgctgcccacgccacttgcctttgccgcttttcaactcgatcttgtagttcttctgctcgtttttactcgatgactggccacgtatctgcacggtggcgttcggcgcgctttcaccaaaaccaagctccccggaaaccggtccttgttcgtcgccgacctgcagcaaaccattgaccttgtagcggtcaacgcccatggccgcatagtcatcaacagaatactggttgatttcactccagctatggtcggtgccttccgacgaattaccgcgcgataccgtcaaatacatggtttcgacaccgctgtcgtcatacaccttgtataacgattcgttgtcgcgcaagtgtgcgccgtcgatgctttgttcagcgcttttcttgacttgctcatgcgtctgtgacgaatccgatgattgcgattgttcattatcgttgggtgatgaagtcgcacatccggcgcaggaaagcaccgtcagcattgccgtcaatgccgttatttgcttgacaagcgtggtaatggcttttgtgttgcgtcggttccaccatgtcatgatttacgattcctcccgattatgacatccgtttctgcaatattcgccttgtcagaagaccgtgcatgccctgagcgatgcaatgattggtcgacccgctgttcgccatgttcaagcagtatgcccagttcggtgaaacgtccacgtttcgtttgcgccacaatcggctgctgccccagcactcggtatggcagattgtcggtgtatgaggcgagccggaatgtcgcatatatggcgaacagcgatgcccccatcagaaaaccgaaaccgaacagcgacgtagtgaagaactgtccgattactgtgaacacaaccgtcgaacccgcaaacaatgccgacgccgtcaatgcaccggaataatcggtaaaatacagcagaatcagcatcacggtgttgccgaccgcataaagggcataccccacgcagagcacacggaaatatccgtgcatcacatcgctgaatcctaaaggaagcgcgttcagcaccgttttttccaatgaaatcacggcagcggtcaccaacaattgcttcaacgccgtgtaatgcaattctcgattgagcacagccaacatttcgttttcggcaacggtaatgtctttgaccgtgcctccatcattcaacagactgtaatacgaccgatatgttgggtagaaattgacctccaccgacaccacaaaattcaccgtggtgatcagaatcgtcaaaaacgccagcatggcgggcacatcgtaatatggcgcgccataaaacaggcccttcaccttgatgccgagcggcccacaccaagtgatcaccaaatgagcgaacaggccgatggtggtcagcaatccggtcaacgccaacggcagaaactgatcgacccactgcaaaaacagccacggatgcttacgactttgcggaaaataacgatgcaacaagagcacatcccacaccagcatcacaccatagccaagcaccaccgcaaacaacagcgactccacaggagggcaggccaacgcaagcaacacgcatgacgtaacgaacgccaccaacaccgcagccacgaaagaatacagaatgcttttgtaatccttgatggccgtcaaatagctcatcgcattccagttgacgatcatttcaagaaacagccacaaacacaacgcgccctgcatcaacgtggcaccggaaaacagcaggaaaaccgtgtacaacaccgcgcccaccaccagcatgatgccagtagacccccagaacgacggcagaatcatcttctcatcgtgatcaaacaacatatccgccagaaaacgggtgaccggcatcgacagaaaactcgtcaacaccaacgaggcaagcagcgtgtaggtgatcatgcatacgagcagatcgcggtcggggcggcccacctgccaccagctgctcacgatcagcacgccgaactgcaggagtacacccaacagcatcggaccagcgcaaatcacgccggcatagccgtaggctcgcagcatcgccatcaagcctctacggtggaacagtttcttcagttcaaatccaataccggccatatcagcgctccaatccgaactgattcaatccgaactgatccgcggtatcgctatacagcttgcgataatcgtcaagcatgcgctcatgccggtaataggcgttcacacggttacggccaatctgccccatggtctcacgcagcgtgcgactggaacacatgcgttccatggctcggctcaggccctcgcggtacatcgggggcacgtagaagcctgccgtgccgaaatcgtcgccttcctcgccttccaaaagctcacggcagcagccgacgtcagtggtcacgcaggggcgtgcggctgcgaacgattccagcaccgacagcggctgaccttcggaaatgctggtcaacacggtgaaatcaagcttgcgcatgtattcgaccacgttcacacggccggtgaactcaagattgcgcacacccaactgttccacaagctcatagcattcgtcggcatactcctgatcgtcaacaccgccgagaatatgcaagcgcacattgtcaacgcgagaggaaagctcatggaacgcgtgaatcagggttttcacatctttgatgggcgccatgcgcaccaccgcgccgatatcaacccaaccgtcgtcgggcttcaggggaatatcgcagaaacgttcgtattgaatgccattgggaatcacttggcaggcatcggcgggcgcacccatgccaatttggataagacgggcacgaccgaacaagctggtgatgcgccacgcacgatggtagatctgttccgaaagcatgtagaagaagcggatccaacgcggccggaacgctggcgacacccattcggcggaaatgatttcctcttcgcgttcacgcgtataaatgccatgttccgtaagcaataccggcgcatggttgatgcccccccccccaaacaagccaacaatccgccatatccagtggaaatcgcatggtagatctgcgcttccggcacttcgcagcccatcaagtacaacaccggcagcaacatggagcgcacggtatggaaagcgtcggcgtaggccacatacggatattcttccatgcagatttgcgtaaacaagtcgatgaattcacggctttgcaggaacgacagcggatgcacgcctctggtgtggaacaggttgaacagcacatcccagtccgggctgccaagattcaccagttcgcgcaatgaccgcaattcctcttcggtgaacgacacttgcgctcgttcaccgctcagacgcaaggcgtcgtcgaggaacacctcatgcacttccaccacattgtcgggcaggtcatatacgaatttgccgcggtcttcggctttggcgccgatcacccacaatacgaactcgtgctctttcatcgcttcgatataactgtgcatccacgtggacacgccaccatgcacgtacgggtagcatccttccaaaaccaggcagattctcatgcctctcccccagtcttgcgttcgatatgaaccgtggcgttcgtggctttgagcagatacaagttgccggtcagcttggtgaggcttccgccacgaaccctgccaggcgtgccattgttggcacggaacatgagccacccttgatcggtgaggttgccaagtttcagatcccaaccatcgtcggacgtttccatcgaaacagtcaatcccgaaaaacgttggatggctgcggcacattccgtgcctgtccgcatacgaatggacggtgccgacgattccagccagtcaagatagttttccaatccctggtagtacttcttccatccttctttcgctccacgatcttcatcaagcaaatcgtcgggatgcatgaagtgcgtgctcacatagtgcatgttcagttcggaaaccgcggcaagacgcatgtacatgtcacccaccatgccgccggacacgatacgtggagcctccaccacgccatcggccgcaacaccgaactcctgcacgtacgtcaaggaactgtcggaaggcatgtacgtactggcgatggcgcgaatctgcgacacatcctcgcctatgatctttcgtccttcttgggagaggatattcgacggcggcacgtataccgacgatgttgcggcaggcaatacgtctttctggaatgcgatcagttcgttcaacgaatcgacgatggctttgcgattcggccactgcacatacgcgtattccttaccgtaatccgtattcggcaacaccaacggctgatggttgtacccgtgatatccgatttcgccgttttgccgaagcagcaatcctccgtaatactcgaattgtgcgccgtccgtctgccgtaccggatcatccttggtgtcatcgccgtaattctcaatcatcacaccggtgaaacgaataccgtaccgttccgcaagacgcaccaaatccggccaccatacttgagaatagaattcagcaatactcatgttgtagtcacgtttgatgtatttgccattgccggacggtaccggagagggaaaatcatccaagtagaacgccgcgctgttgatcaccggataggccgtggcagaaccgagcaggctgaacgccgaagcgtaaaatcctcgaagcaccttgccgtaaataccgatattgcacaccaccgccgaacctgaattcacgaacgtgctccaaatcaacggtgtgcgcccattactgctgacggccttgacctgtgcgcgatcatgcaatgcgacactcagcgacgattcaaacggatcgctgaacgtgtatgtctggccgccgcccaacatgaaatccttggagggtgtaatgcccttagtcagcacatattcgtatgcggacgattcaatgccgatctgcgggccgatcacatccaaatagccggttttttcgggagtcatggcaaacatgactcctccgccttttttggcccattgcatgatttgcagcacatgctcgcccagacggtcgagattaggcatggccaccactatggtgctgtagtgagtcaacgctggaaattcagcgttttcgtcagccacgtcaaccgtagtggtggggactttcatatcaagcagaatctggtcgagcatggcttcggcatcgctgacgccctcttgcgaactgtcgaccaccaacagattcgtagctttttcgccagcgatggcattggctgcaggaatggctttgtttcgatccaaatacgtgatgtcgaaccgcgtgacaccgtaatgcacgcccaagctttccaccagcaacaccaatgcgatggccatgaacacggcccacactttgaccaaaccttgccagcggaatcgtttccacttggccaacacgtctgacaggaatcctctgatcatgcgcgttcagcctccttggttccggtccagaaccgcagcacacgtcttccttggccaccgagataaatatgcttgctttcgatctgctgaacagtgtggcgcaacgcatcgccatcattgcgtgcggcatcgagtcgtagacgcatcagccatacatcgccttgatccggccactgttccatagcgccgtcaatggtgtgcgcggcatcatcaaagagtccaagatcgatttgcatttgcgcaagacggcacgcaacgtaataatcgccatgttggcgaagtcgttcctgcaatacttcggcatatcgctgcttctgcaactgcaatgcgtatccttgcgcaataccggaattgatatatcgttccagcgcatcgcaatagcgttccaacatcgtttcggaatttcgatgctgcagataatcgttgcggcagcgctgcaatgcaagatcttccttggcactgatctgtgccaaggcggtagccgcgtaatgcacgacctccacatcctcattcagtcgggcctgcgacagcacatcgatataatggctgggattgtcgttgagaatggacatcaccagactgcgacgctgactcgaatcgttgacgatcaacgcctcttccagcggcacagtattggcgaaatcggctcgttcctcaacgagaatgcttcgacgttcctcatcgtccacgcgcatctgttcgagatctggagccgtatgctcgcccgcacgaatcagcgtacgcacatgcagcaagagcacgcataacggcccccacagcggcaccaacagcataaaaggaagcagacgcccttccacacgaagcacgccaaaacgagacaatacgcacatcagcacgcataccagcacatgtatgacgataagcagcatcgtcactaccgttgtgttcatgccgtgccgccttcgtgcgattcggcggccacttgttccgaagcctcatccagcagcgcgtcttcctcttgcccggaaacgcgtgtcacatgcaatccagcttgggccaaacgcttgttgatgataggcagctcatgcttgccggcctggttcatcaacacatacacgttgccgtcttgcagtacacccgcctcgtccgtctgacgaatggcccccatgagacggctgccattgtcttgccaagcatcatccacacgcagcagcaggtgatcgcccatatggtcgtgcttgagttcgttggcggcaagcactttgggtagaaacgcccgagtgttcaggaattcggtgcccggcaccagcatcgcctgacgcgccacattctcatagtcgaacgcacgcaccatcgcggattccaccaagccgcacatgatggtgaacaggttctggaagtacagattcatttggtcgggctgcgctttggcaagcacaatcaccacggccagcttgccatcggcatgcacgcctgccgcatacatcggaaggtccggttcgagattgcggttcacccacaatccaccatgatccaaagctgtaataatgttggcataattctcaagcagcgtcgacttgctgaacagggattcggtttgcggactcgcagccatcaaacgcgcgaatcgaccgccgctgtcaatgcggtaaacaccgaaactatcgccgcccaatgtgtcttgcataatgcgaatggtcgtgtgatacagcttttgcggctgcacttcgtccaattcacgtgtcatcgcatacattttgccgaaactgtcacgcctgccgataatctgcccgcgcagcatacgacgatcatcgagcacatcgtggtacaggtcacgcaggaacgcaagtcgttcacgcagcaaactgttttcgtcacgcatgaatcgcaggttttcgcgattacgcagctgcacatacccgcatactgcgccggcaacgaaatacaccacaaacgcaagccagttcgacgtgtcgtaaaacagcggagcgaatgaagcgcccttcgatgcatacgacaacgccatgccgacacatgcgagcacggccgcgaacacgcctgcgttcagtccgtgcatcgtgccgacgatcaccacgaaaaacaggcgcaaatccacggttcccaactggctgttgccttgtaccgcggtgcgaagcagttcttccaatatgaacgcgatgaagatttcgattgcgatccatggttttgaatggttgcgtagaaaatcccagaccgggtgcttcttggattgttcctgagcacgcgcttctttccagcgctgaagcacagggggaagatcctgtttgagcgaatatcgcggcgaccagccatagcgcaatcgcagcacatgatcgtctgctgggtaatgttgtggtctgtcttcgccaaaagtcaccgataatccgggaaatgccgcgctgatcgcatcagccaaatcaccgtatgtgaagtcgaacacgttgggcacatggaagatttcgctttcggcggtccaatcgtcgaacatgcggtagatcagttcggcaagatcgtcggcgcagagaaagcatgtctgttgctgtttgcgttcgcggaatgagatcgaccctgccgatgcctgttcgaacagtctgccgaaatatgcggttgctccattgcgctcgggtgcatacaagtatggacagcgaatgattttcgcttccagacggtaggtgcgcgcgtaatacaggcagagttcttccgacgctcgagacatcagacttttgctggtatcacgtacgtcggcgttttccggataggtgaattcggattccggtccgcataccatcagcatttgcgtggatctgttacgtatggcgtgcagcaatctgcgaagatatccgagatcgccgtcacgctcacttcgcggggtgaggccttcggaaaagaatacgatgcgatcgaattcgtatgtggtaagagtttcggcaagggtgttggcgtcagacatgttgacgattctgagacggtcattgccgtctacggtgccttctcgttccgctatcaccacatggtctcggggaaaggaatgctgaatccactgcttggtaatgaagtcggtgttgccgaccagaagcacttccatgccgccaccccagcgaatactcccttaacggggttacggcataactctgcccacaaacccccattgttactgccttacggtgttccagtgtagccaaacagcagacagactccccctctaacggaggttttcttagtcatttctcagtaactcgcaagtcaacatgacttgcgtcgaccattttagggggcttacccgcaatgcgagcgcgtattcaaccaacagccggcatcagtggcttggcgctagacatacggccgcaatcgtcatacgtgtgggcaaaaacaaagaaacctcggatgtttccgaggtttcaaagccatggtggctccgagcggcatcgatccgctgacctaacgattttcagtcgttcgctctaccaactgagctacagagccatgaacaggaatctgttcgagcgaccccggccggacttgaaccggtgacctccgccgtgacagggcggcgctctaaccaactgagctacggggccattgccaccttgttaccaaggtaagtaccccctgagagagtcgaactctcgttgtcagattgaaagtctggtgtcctaaccgttagacgaagggggcgctttcagcgtttccgcgtgacaactcgcttaactatacgcgaatcctcagaacatgcaaatctcggcgtgtcgcagcgtcgcaaaatcgccatcaacccgttgccaaagtgctgaaaatcgttgaaatcaagccatttcagcacttcaacaacagaccaaccggcactatacgcaacgataggtgaggtcatgaatcacacgaccggcagcaagtccttttttctcaaaattcgtgagaattcgtccggaaaaacgctcggattcggtgaaatcggcgtgtcgcagaccggccgcttcgtcggcatttcccttgccaacatgctcgaccggcaaactcaccgtaagcatgccgtcattatggaatccttcaagaccatccatcacctcatgcacatgcaatgcatagtcttcgatgtcggtggcgatacgccacactcccccatcccgcaacgtgcgatgaatctcgccggcaagctccggctgcacgatacgacgcttgtggtggcgcatcttgggccacggatcagggaagaaggtccatacttcagcgatcgatccatccgccgcggctttgaagagctcaggagcgttgacctgcgcgatgcgcagattggtcaggccctgcttgcctgcgagcagcatggtatgcgccacgcccggatcatagacctcaagcgccaggaagttcatatcggggtgttcagcagcggccgcaacaacgttttccccctggccggtaccgatttccacaatcagaggattgacattgccccacacatccgcgatatacgcccgatcgaacaccagatcgcctcgcacatcaagcgacccctcgcccgcgttgattttcagcagatacgtatctgcataggcatcccatgcacgctgcaagcgtgcgtcgagcctggcggaacgacgcacgaaggacaacaccttgcgcccatacaaggcaggacgctggccagcatcagcccgttgttcatcttgcgtttttgacatgttttgtccgttttcgccgttaacttgattttcagtcggcgtgttcacatcttcttgcataccctaatttatagaggaaacgcaggaaagggtcgattatgtgcgttactgttcatgtgttatactcaaattgttcaaaaagtaacaaactagagcaaaagtgaacaacgttcgttgaacgttcgtttttcgaacaaagcgctttatcgctcatttggaggaaaggccagaacatgacagttctcgtcactggtgggtgcggctacatcggcgcccacgtcgtccacgctcttcaccaggccggcgaacaggtcgtcgtcgttgacgatctgagctacggcaagccaacccgcatcgaaggctcccgcctgtacggcatggatatcgccgcaccgggtgccggcgaacgcctcgccgaaatcatgaaggccgaaggcgtcgactccgtcattcatttcgccgcccgcaagcaggtcggcgaatccgttgagaagccgctgtggtactaccagcagaacatcaacggcatgctcaacgtgctcatcggcatgcgcgactccggcgccaagaagctcgtcttctcctcttccgcagccacctacggcgttccgccggtcgacgtggtgccggaagacgtcgttccgatgctgccgatcaacccgtacggccagaccaagctgttcggcgagtggatggcacgcgcctgcgaagagccatacggcattcgcttctgcggtctgcgctacttcaacgtggccggctgcggtccggtcgagctcgaggatccggcaatcctgaacctcatcccgatgctgttcgaccgcctgaagaagggcaaggctccggcgatcttcggcgacgactacccgactccggatggcacctgcgtgcgcgactacatccacgtctccgatctggccgacgcccacatcgccgccctgaagtatctggaccgcgatgaacgcaagtacgacgccttcaacgtcggcaccggcgaaggcacctccgtgcgtcagatcgtcgatgaggtcaagaaggtcaccggcctgccgttcgaagagaccgtcatggcccgtcgcgcaggcgatccgccgcacctgatcggctccccgaagcgcatcaacgaagagatgggctggcacgcacagtacaacgtcgaagacatcgtgaagtccgcttgggatgcatggcaggccaatccggaacaccacatcgacgtcgagacctggaaacagaccgactgattccaccagcaattcgtagtgtcgtgagcgacaacacggcaccgcaacggtaacggccggtcacatatgagaagttttcccctcatatgcgaccggccgttgcttttcttccctactactgccgcagtttaagcaaatactttctttcagcaattcatacgaatattcatcgatgacacgccgaaatttgcacgatagcgactttgccgtaatatatctatctgttgccagtcgcaaggctgaaacaacggccccgtagctcagttggttagagcgccgccctgtcacggcggaggtcaccggttcaagtccggccggggtcgcttttttatttttcatttctatttttctctgatttacatcaattgcgcaatattacttttgcaatctcttgcgatttcttaagatctttcgaaatcattgaaatcatacggatacaagaaagcccggctcttgcgaaccgggcttttcgacggaaaaatcgtatgcaatcgtcaaagctgccgctcaacccaatcaacgatgaacggggccacttcctcaatctggtcaatcgccacttcgaattcgcgggcgccgccataccaaggatcgaccaaatcaatctcactttcgtagcctgcgacaggcttggcaagattcggatcgaaactacggtacatatgcacgttctcacgcttggcctgcggcagctgacgcagtagcgcacgcatatgcgaagcggtcatcggcagaaacaggtcggtacgctcgatctcatcgcgggtgatgcgatgggcgaaatgatgtgccggcagctcatatccacgctcacggagcaccttgacggcacgacgatcgatcggattgccatactcttcgtcgctcacgccactggactcgacgttgaccttgtcggcaaggccacgacgctcgaattcagtgcgcagaatgatttcggccatgggagaacggcagatattgccggtacacacggtcatcacggtatacatacggttactcctcgcgattcttcgcatacgtcatgaaacggaatccggcgatatctccggaacccttccgcgtgttctgccacacgccctcttcaagcaccttccaagcgccggattccaccagcgacttcacgtcgggcgcgtaggtatcggcatcggcatgcatgctgatctgcgtcacatacgccttgtccgcaaatggcatggcctcgcggaacagctggccgccaccgataatccagatttcgctgcggtcaagaccgtcatccggaatggcttcctgtcgtgccagatcaagcgcatcatccagactgtcgaccacggtcgctcccggcgcagtgtaagccggatcacgcgaaaccacgatattgtcgcgattcggcagcggacgatacttcgggctcagggactcccacgtcttacgccccataatgaccggatgcgagacggtaagctccttgaaacgcctcatatcctcgggcagatgccatggcatgccacccccgaatccgatggcgccgtcatgaccttccttgtcacaggcctgcgcccaaatcagattcaccgagaacgtcttggggaaatcatcgccccaatcctcctcgtcctcaagcccggcaagtccgggctcgggttcgtgatagccactgcggctactgtcatgctccatttcactcactccttgcagtcgaactagggtcagtagtctaacgtctggcgacgactctcagaccgccaccggcgccttgatggttggatggtgctggtagccgacgatttcaaaatcactgtaatcgtaatcgaacagcgaatcggctttgttaatacggatctgcggatacgggtatggatcgcggctcaactgctccaacacctggtcgatgtgattgtcgtacacgtggcagtcgccacccgtccacacgaactcccccggctgcagtcccgcctgctgagcgatcatcaacgtcaacagcgaataggatgcgatattgaacggtacgccgaggaacatgtcgcaggaacgctgatatagctggcacgaaagtttgccatccgccacgtagaactggaagagcgcgtggcatggcggcaacgccatattctccacttcggcaggattccaagcggacacgaccatacgacgagaatccgggtgattctcgacaagatcaagcacattgctgatctgatcgatggtacggttcggatcatcgggcgtgggcgccggccagctacgccactgcgcgccgtatacgggacccaaatcgccgttctcatcggcccattcgtcccaaatatgcacattgcgctcctgcagccaacgcacgttcgtggaacctttcaggaaccatagcagctcataggcaagtcccttgaaaaacaccgtcttcgtcgtgagcagcggaaaatactcgctcaggtcgaatcgcatctgctggccgaacaggctgacggtaccagtgcccgtacgatcggacttcaacgtgccttccgtcaggatcttgcgcacaaggtcttcatatggcatgggaatgtcggtttccgggcgtgccggaatacgggtacggatatctgcaagttgttcaggtgtcaaagccatggttgcaagcttaacagtacagaacggcaggtcaagcatatgccacccgcgcgttgattgtttacgcttttcggaatgcctcctagcgaacaggcatcaatggattacattaggtatgtaggcgaggagcgaacggcgctcccggcaagacgatgaggagttcaccatgggcaaaagactgtgggtcgagcgtaacaaagacggttcttgggatgctttcggcgaggatggcgcgcatatcaagttcggcaagggtcgtggacagttcacgccgggcgacctgatgaagatcgcgctggccggttgcgccgcactgtcaagccagttcgccatcgagcatacgctgggcgagggcaagggcgcgaaaatcgttgtggacggcacctatgacgccgacaatgacgcatacatcggtttcgacgaacaggtggtcatcgacgccaccgacgccggtctgagcgatgaggatgcggcaaagcttaaggaacgcgtcactcgtcatatcgacaagggctgcacggtgaagcatacgtacgtggagaagactccggtccgcatggacgtcaccatcaagcactgacgttttctttttttaaaaaaaaaggcgattgcaacgcttttcgcagtgttgcaatcgcctttttatatgtacctgttgaatttactgacgatcgggatcgatcttggtttcgatggcttcgaccacatccggctcggccttggaaaccggcacctcctcgacacccttgatatcgtcaagagccttcggcttgacttccgccggcgagctcggaaccgtgtcaagacgggtttccgcagcctcgacatacttgcggggcaccacatacaccgggccgaccgcgtgctgcagcaagccctggctggtggagccgagcagcaggccagtgaagccgccgcgaccacgggaaccgaccacgacgacgtcgtgatcatagctggccttggtcagcgcgccaaccgccgggccaggcacgatctgcttgttgatcttcaaatccggatgggcttcctcaagcggcttgatacgcacttccagatcatccttgaacgaggccatcacaccttcgtcgtcggaacccttcatgttcggcaccgcggaaataacatccagctcggcatcccatgcagcggcgaaattcgccgcgatctccagcgccttcaaaccccacttggattcgtcggagccgacggccaccttggtgatggtgttgttcaagtgcatcagattgccgtcatcgtcagtgtacggcaccactacgatcgggcagtatgcatacgccggcagactggagctggtcgtgcccagcagacgttccgccagaccgcctttgccgcgattgccgatgacgatgagattgtagttacgagacagttccacgaatacggaagccggatcgcccgtaacaataagcgtggtagcctcaacaccctgctcgtcggcgatggccttggccttcgaaagaatctcctgcgcgtcgctatgggccgcattgtcatcccccatggcggtgtatgtcgcgtcgaaggaaacagcggcatagctcggcaacgagtatgcgcatacgatctgcagcgtcagtcccgcatgcttcgcatagttcgcagcccaccaagtggccttatagctggcgtgggatccatcaacaccaacgaggattgccttgtcgttaatcatggacgacctccttgaatcacctcggcaacgcgaccatgcgtcgcctctaggctccaccataccgcgcgacatgcggttttgtcagtaacgactcggtcttttccatacaaaaaggcgtatccccgaaaggatacgccttaaaaaatcaaaccgtatgttcactcagagcacacgacgaatcgcatagccacctgagaacacggccagcgaagtgacctgcgttccctgagccggattcagcgcgttgatcaccatgccgttgccaatatagatcgcggcatgctgagtattgacgatgatatccccaggagctgcttcggcaatgcttccaactgccgttccaacgctcatctgggcaccagaataatgcggcaggcttaccccgaactgggcgaacacccactgtacgaaaccagagcaatcccagccggacggagtattgcctccggccacgtaaggatagccttggaactgcagagcgtagtcggccagagcctgcccagtggcactcgcgggagccgtaggaacgctgatggaagcacgatcggaagaacgactggcagcctgagattcagcctgtgcctgagcttgggccgcctgtgcttgagcttcggcctcagcctgctcctgagccttctggtccttttccgcctgagactcggtctggggaacatccaagctttcgatgccaccccaatcggcgttagattcaacatccgtggatgtgtgctcggcgagaaaatcacgcttagccgcggtggtcttcgggaaagaacgtgtagcggttaccgtggtatcagccatagcaccgcctgcgcttgcggcgggaaccgccgcacccaacaaggcagatacagcaacaacggcgaagatactcgtgaaacgtttagcaatattcatcgtgtctgaagctaccatacacgttcccccgcagcagaacagcaagataaccagaacagtgtcatatcacgcgacacgccgacgcaatcacgctacgccaaaaaagtgacggcaagcgcagattaacgaaaacagagaaatcagtaatggatatatgtcaactgcgaagcttcctgcgcagtgaacgtacgatcggaaatcacgccaagacccttgacgttggattccgaaatcttaatcgaaccgtcggcattcactccttcgacaatcgcgacatgcccgtaatagctgtccgcgcccatttggcctggagcgaataccacaatatcgccaacgtgacgtgccgtattgtcaacccaatagccgagagcgcgagcggaatcaccccaactccgcgcatcaccaaaatggcttccggcaggcaggccaagctgtgcacgacgggtatacgcccaccatgtgcactgaccgtatggatagtcattgccggtatcaccggtgccgtggttcggattgaagcccgaaggaagaagaccggcgtcctgatccatgagaacggcgacattgggattgtcggcaatggactttgacagaagattcgtgtccatggaggaactggtttcgccaagctgccaatcaccgctattgctggtggaggccagagcgtctagatcgctacgggactcggaacgggatgccgcatcgtcggagacacgcttcatctgcgtggtagtggcggcattgtcggcaaaagtcatttcagacgcattctgctggccgaccgccatggcagtggccgcggtgccgaccagcgcggccagcgatgcggaagccatgaatgcggagcgacgaccggccgcacgagcggcttcacgcatggcgcggcggctcatcggagccacttcattcagcttttcggcaaccgcaggctcaagacctacaacggcacccccaccatttgccagctggaccatacgaacggccttggcggtgtgggaaccgcggctcgaggtgaacagcgccttggcaacgctgaaacgctcattcgaaaccttggcagctttatgcgccgcatgcctcatatatcaacactccttgcggattacttcaaccacagcaggcttatgaccgcgtggttacagaaccgtcacggaagctcaggctacaccgacaccgggatatcgcagtcatcatcgccacgtcatggttccgaaaagcggtcatcaccacgcacaatccgaccatctgactaccctaggttgtcatgacgaacactgtgaccattccttccaacgtgcttccggaagacggacgtttcggctcagggccgaccaaaatccgcccggagcaaatccaagcgctcgataagggagcccgtaatcttctgggaacctcccatcgacagacccccatcaagcaggtggtcggctcaatccgcgaaggactgtccgaattcttccagattcccgatggctacgaagtggtgctgggcaacggcggagccagcgcgttctgggatatcgcctgcgcctcgctgatcacccgcaaggccgcattcggcacgtacggctcattcagctcgaagttcgccaagtcagcgcaatccgcaccgttccttgaggagccggagattttcgcaggagagccgggaacatatcgcctgcctgagctcacggaatacgtggacacttattgctgggcccacaatgagacttccaccggcgttgccgcaccgatcaaacgcatcgcaggcaccaaggagcagggtgcgctcacgttgatcgacgccaccagtggcgccggcgcgctgccggtcgacaccagccagaccgacgcctactatttctcgccgcaaaaagctttcggatccgatggcggactatggattgccgtactctcccccgctgcaatcgaacgcgcctacggcatcgccaaaagcgtggatcttccgggcgcacgccgctggattcctccgttcctttccctgacttcggccatcgagaattcccgcaaggatcagacgctcaacacgccggcagtggcaacgctgatcatgctggaaaaccaggttcgttggctcaacgacaacggtgggctcgcctgggcttcggcccgctgcgcaaggtctgcgtccctgctgtaccagtgggcggagaagtccgattacgcctccccgttcgtaaacgacaggaacgcgcgctccaacgccgtgatcaccatcgatatcaacgatggcatcaatgcatcccaagtggtggcggcattgcgcgaaaacggcattgtggacaccaacggataccgtaaactcggccgaaaccagcttcgcatcggcgtgttcccgtccgtggaacccagcgatgtggatgcgctcacccgctgtatcgactacgtggtggaacatctctgatgcaaggtaaggtgtggcgatatgaagattgctccgattattgatcccagcgtgaggaaaccttcgccgaaaccggtgcgcgtcgacctacgcaaggtattcatgtttggcaccgcgctatgggccatcgctttggtggtctgcatcgtacttatcgcattcggcatcgacgcggaacgcgcgcaaaccgtctgcgaagcgggtacggtcatcggcgtgctcatgctggtttgggagcatttcgaccgttgggattatcgccgtcttggcgagtaatcggcaatatacccccgaaaaatcctcaaaaaaatatgatgcccgtctcgccttatcgaaaacgagacgggcatcgcattatctccatttgagatatttgcaacatctgccgaatgtcttacatcattccccgcccaacggcagcaccaaggcgaacgtgcttccctgccccgggctgctccacaccgacgcggaaccatggtgggtcaacgcaacatgcttgacaatcgcaagtcccaaaccaatgccgtcaccggaatgctcattctgattgctgccgcgatagaaccgttcaaaaatacggttctgttcgccgatggcgatgccgttgcctcgatcgagaacactgattaccgcttccgtatgctcctcattggctttggcgacgacattcaccgtagaaccgtcttttgaatacgtaatcgcgttttcaatcaattttgcgagcgccgcctgaatctgatcggcttcgccattgatgcatagcgattcgtcaccgccggtcacgatggtgatgccgcgttgcgcagccatatcgagatgcgcctgcaccacggcttgtacctgttccatcacgttgatgcgattgtcggcggtcggcaggattggctcctgcgctttgatcagcagcagcagatcggaaatcatatgctcaagacgggaacaggattgacgcagctgcgtggcgttgcgttcgacgtcctgttggctggcaccgccccgttccacaatgtccgccagctgttccaatgattgcgtcggctcaagcaattgttcggaaacgttggtgatgaacgaatcgcgcacctgcgagaatcgtacgctttcgctcacatcgctgatgagcacaaccatgagattctcattgagtttgccgacgatgattttcagccagttgggtcgggaaacggttgcgccggaagtattggggtttgactgccctatcagtgcctggcgcgcgatttcacgtgtggttggtttgcctgccttcggcacttgctgggcgacatattgggtggtggtggtcaaatcaaattgtttgttgccgccacaggaacgcacctcatgcactgcgcgaagcacggtctcttccgcgatggcatcatcgcgcaccacgccaagcgcatacgccgacgggtgcgcgcgaatcacttcgtcatgctcgtcaactacgacggatgccaacggcagcatggaaagcaacgcgttggtggcatcatccaatgtgtcgtcatcggcatcatgctcatcatcgtcgttgcggtgcgtcagcgaacgccaccacgaacccaaagattcaaccatggtttcattgttgcacactcttgaggctccccaactcgcgacaccaccgctcgttcgtgaacacaaggtgaacgcgttggtgaactttgacggaacaacacgagcagtggttacgaatatggcgtttgtctaatagacttgtgagaggttatatcgaacccagatatatatgaagcattgaaaggcaagtcacatgcgcgttattttcaacgaggagctcaaggctgttgccgatgatctcgaccacatggtcaaaggcgtgcgcaaggcgatcaacggtgccggcgacgcgctgttgaaccagaatcttgaagccgcccaggccgttatcgacggcgacatcgaaatcgatgccctcgaagccagcgttgtcgaccagtgcgtgaagctgctggccaagcagaacccggttgccaccgatctgcgcgtggttgtttccaccatgcgtttggccaccaccttcgaacgtatgggcgatctggcccgtcacatcgccgaagccgcccgccgcacctacccggcttccccgctgccggccgaagcccaaccgctgttcgccgaaatgcaggcgttcctgaacgacgtcgccgaccagaccgtggccatgctgtctgaccgcgacaccaagaccgccgaacagatcatcatcaacgacgacaagctcgacgaactgcacaagaagacctttgaactggctcagtccgcggattgggctggcaccaaccagcagctcatcgacgtggtgctgatcggccgcttcatggagcgtcttggcgatcacgccgtgtccgcggctcgccgcgtggtgtacatcgtctccggtttcgacccgtccaaggagccgacccgcgacgaagacaccgacatcgcctgatttttttcttgcgatcttctttttcatcttctttttgagaaggcggcttccgttccccactgaagccgccttcttgttttgtttttgcaatctttcagcacgaatcgtcaagcactatctcccgcattatttcactttcgtcaagccgtaagaaaaattaaacaatctgtctattttttgcccatatacttttacgcaatgtcgcggcacaatatgtgcagtgacatccaaaggaggcagtcatgtattattccaacggcaattacgaagcattcgcccgaccgaagaaacccgaaggcatggacagcaagaacgcgtacatcatcggcaccggcttggccgcactcaccgcagcctgttacctggtgcgagacgcgcaaatgccgggcagccacattcacgtattcgaaaaggacgcggttccgggaggcgcctgcgatggcgcaaatattcccggcgttggctatgtgatgcgcggcggccgtgaaatggacaaccatttcgaagtgatgtgggacatgttccgttccattccatccatcgaaacggaaggcgtttccgtacttgacgagtattactggctgaacaaggaagatcccaacttctcgctctgccgctccacgaaagcgcgcggcgttgacgcaggcacgaacggcaaattcaatctgtcagacaaagcctcgatggagatcatgaaattgttcttcacgccgaatgaggaactgtacggcaagaaaatttctgattatttcgacgatgaggtcttcaattcgaatttctggatgtactggcgcactatgttcgcctttgaaaattggcatagtgcgttggaaatgaagctgtatattcgtcgatatattcatcatattggcggattgccggacttcagtgcgttgcgtttcacccgttacaaccagtatgagtcgatgattctgccgatgatcaagtatttggaaggattcggcgtgcagttccactacaacgcgaaagtggagaatgtcgatttcaagattggcggaggcatgggaccggtacgttcgcataccggcaccggtcaagacacgattttgaagaagcaggctgaatccggcgtgttcgtacgcaatccgtacagttcgccaaccaagaaaatggctacgcgcatcgacctgaccgaagcggatggcaccgcgcgaagcattgatttgggcgaaaacgacttggtgttcatcaccaatggtggctgcgtggaaaactcgaccatgggctcgcaaaccgaagcggccgcatgggctccggaaatcaagcccggcggcggctgggacatgtggcgtcgcattgccaagcaagacccgagtttcggtcacccggacgtgttctgcggcgatccggagcattcgaagtggatgagcgccaccgcgaccacgcttgacatggaaattccgccgtatattcagaagatctgcaagcgtgacccgttcaccggccatgtggtgaccggcggcatcgtaaccgttgaggattccaactggctgatgagctggacgttgaaccgtcaacagcagttccgcgaccagccgaaagaccagctgagcgtatgggtgtacggtctgttccccgacaagcccggcaactatgtgaagaagccgatgcgggagtgcactggcgaggagatctgcgaggaatggctctaccatatgggcgtgccgaccgacaagatcaaggaactcgccacgaaccatgcgaacaccgtgccggtgatgatgccatacatcgacgcgttcttcatgcctcgttccgccggcgaccgccctgatgtggtgcctgatggtgccgtgaatttcgcattcctcggccagttcgccgaaaccccgcgcgacacgatcttcaccactgaatattcgatgcgcaccggcatggaagcggtgtacaccttgtgcgatgtggaccgtggcgtgccggaagtgtggggttcggtctacgacgtacgcaacctgctcaacgccacggtgatgctgcgtgacggcaagccgattaccgacatgaaactcaaccccattgaaaagaccgtgttgaaacagattctgaagaagctcgattccaccgatattccgatgttacttaaggaatacggcgtgatctgagccgattgcgattgacgtccgtctgccgcacatctcatgttccgtattccatccggcagacggacgtaataacccaacaaagataccggacgcaaaaaggtggaaacccacatactgtggatttccaccttttcatatacgttccgtacgattgaacgcgattacctgcgtatcaatcgcaacaaactcacttctggccctgggcggcgacagcggcggcaccagcagcggcggcttccggatccagatactcgccacgcggcttgatcggcttgaagttctcgtccagctcgtacagcagcggcattgcggtcgggatgttgaccttggcgatctcctcttcggagaggttgtcgagcatcttcacgatggcgcgcagggagttgccgtgagcggcgatcagaacggtcttgccagccttcagctccggctcgatgtcggacttgaagtacggctcaacgcgcttgaccacatcggccaggcattcggcttccggaaccggatcgccggtgtagcgcggatcgttgttctgcgcatactcgtcgttcggatcgatctccggcggcggagtggcgtaggaacggcgccacagcatgaacttctcgtcaccgtactcctgacggatctcggtcttgttcttgccctgcagagcgccgtagtgacgctcgttcagacgccagctgcgcttgaccggaatccacagacgatctgcctcatccagagccacgttggcggtgttgatggcacgacgcagcatcgaggtgaagacaatatccggaaggacattcttctccttgagcagacgaccgccgttcttggcttcctcgacaccctgctcggtcagcgggacgtcgacccagccggtgaactgattggttttattccatgcgctctgtccatgacggagcagtactagtttgtaagtcatacctgccagtctaccgcctagcacgcccaacacaaccgtcgatgacgattatttggttacgttcatgcaacaattttcattctgttgcatgccgtttgcatcatcaggcaatcgccggtgctcaatgacgaaatcgtaaatgcagaatgcagctacgccatgaaaccggcctgacaggcattgagcacgaacgcgccggctgcgaccaacgaggtcatcgagcacaatggcaacgcccgacgccactggtcatgccggacggccgcgacggcacgagtagcaatcgccacacaccctgcgatggatgcgaacgccgcaaggctcatccaatcggcgtttccccacgaccagtcaccgcatatgccatattccgtgcatgaacggtcgcgatccacctccgcaggcagctttatgagcagatccagaagtttggcatacaccgataatggcatggcgaaaaccaccgtcagaccagcagcccatcccagcgcacgcatgcaccagcatttgcccttcccactgccgatgcgcaccatcagcgtgcgcttgccgtgcgcggcgtcatcttcgagatcacgcaggttattcaccatcatgacgctgacggacagcaggccgcagatcaccgaaccggccacccccgtcacggtgatcgacccgcttagcgcatactgcgtgccgagggctggaaccaacccgaagaatacgaatgccgcaagttcgcccagaccccgatatccgtaaggatgccgaccgttggtatatccccaggccgccaccagacaggttgcgccaagcgctatcagccaccagcgaccagttatgacgacagcgaccagtccggcggcacaggcggctaaagcagcgaccgcggcagccagcaacacgtgactgggatccactccggaagcgaccaaccgccgaggtcccgcggcgtcactgcctcgtcgggcgtccgtgccgcgtacaccatcggcataatcgttgagataattcacagcaatctgcagaccgaccgccaccacggcgcacaacatcgcaacgaccgcaaaccacggccgagaaaacgcacaataccccagcacatcaccagcatcatgctcttccagcaatcttcccggaaaagctgggcacgaccgcaggccacccaaagcctcccaccgccaactggcggcaacgccgaccagaaccggggcaagacccagcggcagcgtttgagggcgagcgccacgaatccaaatcgtcattcccatgaacgccattctagaatcacactcacgattcgccttccagccgcctacccgcattccagattcacaacctgaccatactcattgatatttcatctgtttccagaaatcgatacaataccggagaatgccccagaacgtcactcatgcgaaatatcatgaaacccgtgggatttcttttttgaaaacatggagagcttcaatcgcaccctgcgattcagcatcctcacgcccatgtattctgcggtaggcaagctgggtggtacgaaagggatacgggaaaaagggcattcgcgaacgaatgccccaaatctgcgaccaggtcacaacactacaggtcgcagattattcttgccgtgcactgacaagaagtccgatacggcgcaaagccttccggccttacagacctgcctgctctgccacaaaatcaccgagagccggcataaccatttcgcgatgcttcacattgccgaaaccatggtcgccatcctcgatgaccttgagctgcatattttcgccatacacatcctcgtaccgacgaatatagtcaacaggaatgaaatccttggtgccatggatggcaagcaccttaccgcgatatccgcaagccatgccgtaaggatcggtacgacccgcatcctccaccatggccggtcccatggcaacacccataaagtcaagatagccttgctcttcgatggcagacagaggcttaccctgaatatgcccaccggcaatctcatcaacatacgaagtggccgtagaacacagagcgatcgacttgggctgcccaggcaccttcggtgccaacagcgtgcaaatcaccgcgccaaggctcagtccagcgaaatgcagattatccggatcgcagccgctcatatgacgagcctgctccactacctgcaaggcgtcttcgacatcgccactaacggtggtatcgaagaaagtaccatcactttcgccatgaccagcacgatcgtaagtaacgaccacgagaccacgagaagcaagttctcgcgccatttgcacgacaaatccggaaaagtcgatgcgattgcccccgaagccatgaaaaagcaccgccaccggcgaatgtccgtcttccgaaaaaccttccggcagataacgggtacctcgtaacgtcaaagaagtaccgtcggcacgttccactgtgaaaacagcaggttccataacactcatgatgatttccttattggtttgtaaaacgaatgttccgggcttcgaacggaaaagggaattgggatcaaaccgtttcgaagcccgaagcgcgatacgcagggtgcgtttactcagcaacgacctgattacgggctgcgagttcctcacgaatagtgccgatctgatcatcgaccttgtacagcagcatcagcacagtgccgatagcgcagcaggcgatcggaatccacacgaagttgatgttgatggcgttcagagcttgcgccgtctgctcttgattaggcacaaaaccgttgatttccagcacaaaactggagagccagccggcgatgcccgcaccacaggtaacaccgatggccgcgcaggaagtaatcaagccctggctacgcacaccggtcttccattcgccatagtcaaccacatcggccaacatcacgaagcccatgctttgaccagtctggaacaatgccgaaaccgccatggatacgaagatcagcggaatggacatgatcttggcaccaacgtacagaccaagcagaccaataatgccgaatccgaagaacatgatggcgatattgcggttcttcatcttcttggcgaagaacggagcaagaatcataccggcaatcatgccagccgaattgatgccattagccaaagaggaaagagtttcgttgccgacgttgtacttgaagaagtacacgatggacgaggccttggttaccacaccaatgaacatgacaaggttgagggtgacaagaatccaccatggcccattgtgcagcatggccacgaaactcttgatgaacggcggctccttctccttaggggtaaacacacgttcacgcgtattggcaaaagtcagcagcaacagacccacgcagatcacgccatagatgatcatggtgacggtaaagcccaactgctgattgccaccaccgatcaggttgaccaacggcagagtaagcataccagaggcaatcacgccgatctgaccgccgacattacggaaagcatttgcattgacacgttcctgggcgttggtggtgaggttcggcagcagcgcggtgcacggcgtggtcaccgtgacggcgaggaaattcatcatgatgtacgttacgtacacataaatcatcttgattacgccgccgaagttcggcaccgaaaacgccatgacacctatgatggcaaatggcgcaccgaaccacaggaaccatggacgcaccttgccccacttagtatgcgttttatcaataagcgcacccaccaccggacctgcaaccgcgtcaagcacacgcaccaccaggaacagcgtaccgacagacagcaggctaatgccggccacgtcggtgtaatagaacatcatgtacgtggtgaccacgttgaacaccagattgtacgcgcaatccgacgttccatagctgagcttctccttaagggagagcttaacgtttgcgttgtccacaacaactcctttgtcgagaatcccgaacagcccgtgcaatacgagccatcatgccattcgcagcaacgcgatgacgatgcttcttatccctgacggccgattcgcacctgcgctcattgcgtatgctgcatttccaccgtctgatgtcaaagtagagaaaatgaaatgcaaattcttgagatgataaggaaatttctttcttgcaaatgtcaatatgcagcaaacaaacagcaattatcatgcactccaacgcaatgattacactacatagcaatcattagaagaaatttctctactatactgctatcatgacactgtcttcatcgcaaaccaatatgcgtaccgccagtcaacgaccgaaactgtcacacatcgccaaacttgcgaacaccacgccatccaccgtctccaaagtcatcaatggacgttccggagtctccgacgaaacacggcaacgcattgaagcgctgctcaaagacatggaatacagcaaaccgccagtcaaacacgcgctgtccacaaccatcatgttggtgctcgaatccatggaaaacccatgggtgctcgacatcatgcaaggagccaccgacgccgccgtcaaacgaagcatgaccgtgaccatctgcgcgaaaaacgcctccgacggcaatcccaacgacacctaccggcaagcaatccgccgagccagacccaaagcagtgattttcgacaacgcctacgtgccaatgcgagatcgaacactttgccaagaacttggagctcgatatgcggtaatcgacccatccggaacaccatgcaaagattgcatggacgtgcgcatcgacaattggacaggcggattcgaaatcggcagccatcttattaacttaggacaccgccaattcgcggcaattaccggcccaatgtccaccacctgctaccccgccagattggctggatttcgtgcggcattagcacagcatgacatcgttctcaacgacactcaagtgcgcgaaggcgactactggtcggaaaatgcacgcttgcacgcgcttgatctgctgcagcaaaagaatcgtccaactgcagtatttgcctgtagcgatacgcaggcattcggcatatatgacgcggcacatcagttgggactgtcgattcccgaagatctgtccgtcaccggattcgacgatatcaacagcgcacggcatctcggaccgccattgaccaccatgcggcagccactggcagaaatgacccgagcaacacttgccacattactatccaagcatcagtccgaagacgcgcagcgcacgctattgtttccaccaacgcttgtcgtgcgcggaagcacaggaccagcgccagaaattagggaataaaacagaattggagaataaaaaaacgcggggctgcctggctatacccaagcagcctcgcgtgaagccgatattgaattaaggctttgccttaattcagcggcaattttataaggatggctccggctggagaacagtccacaggactgttctctttccagcctcgcgtgaagccgatattgaattaagactttgccttaattcagcggcaatttttatgaggacggctccggctggagaacagtccacaggactgttctcttttcagcctcgcgcgaagccaatatgaattaaggcttcgccttaattcagtggcttcactagtgggaaggtgatggtttcgcggatggtggcgccggtcagagcaatcagcagtcggtcgatacccatgcccatgccgcccgccggaggcatacccacgccgagggcctcaaggaagtcctcatcaatatcgcaggcttcttcgtcgcccgcgagcgcatccttggcctgagccacgaaacgttcacgctgcacaaccggatcgttcaattcggagtagccggtggccagctcgaagccgcgcacatacagatcccacttttcgaccacgccgggcttggaacggtggcccttgaccagcggggaggtttcgaccgggaagtcacgcacgaaggtcggctcgaacagcttgtcttcgtagaagtgctcccacaggtgttcgacgagcttgccgtggttctccacatcgtcgcgttccacaccgagcttgtcggcaatggcaccgagatgttccacggaagtacccggattgtccgggccgccattcggcacgatttcctcgccgagcgcttcggaaagggaatcatacatgctgatggtcttccattcgccgccgaaatcgtattcggaaccgtcgagcaacgtcaccttgtgggtgccgaacacgtccatggcggtgtcttgcacgagctgcttgacgagcgcgccgatggtgtcgtagttgccgtaagcctgataggcctcaaccatggtgaattccggagcatgggtggcgtcaacgccttcgttacggaagtcacggttgatctcgaacacgcggtctatgccgccgaccaagcagcgcttgaggaacagttccggcgcgatacgcaggtacaggtcaaggtcgaacgcgttcatgtgcgtggtgaacggacgggccgcagcaccgccgtgcacggtctgcaacatcggggtttcaacctcgaggaagtcatgatcggcgaaggtcttgcgcagggaagcaacagccttggaacggttacgcaccatgttgcggatcttctcgtcggcgatcatgccgatgtacggcttgcgggtacgagtgtcttcgttcaggtccttgtgcagggccggcagcggctgaagcgccttggcggcaatagcccattcggtggcgaacacggacagttcgccggtcttggaggcaatcacacgacccttgatgaacaggtgatcgcccaagtcaaccagctgcttgaaccgcttcaaggaatcggcgccaatctccttcttggaaatcatgccctggatcttggtgccatcgccagcggaaagctgcacgaagcacaagccaccggcgttacgcaggaagagtacgcgaccggcgatgccgaccacgtcttcggtttcgtctccggcttcaagcttgccgtcatacttggcgcggacctcttcgatggtggcggtgacgtcgagggtcaccgggtacggctgaatgccgtccttaagcatcatggcacgcttggccacgcgcatctgcacctgttccggatgcgccagcggtccgaattccttattgcctggatcaacggcctcatccagggtagcgccgtcattgatcttggcgtagatagccgcatcctgctgcagcagcatttcggcacgttccactgtggtcatagcgggaacggcagcctcttcgttctgattttcttgcgattcgatggtctcactcataagcccacagtgtaccgagaagccactacaccacacgcgacacgccgtatttgcattacctaagcaatcgtgtaatatttccaactgttgcaaaacgggctgtagcgcagcttggtagcgcgcttcgttcgggacgaagaggccgcgggttcaaatcccgccagcccgacaacttaaggcggaacttcggttccgccttttttatttccagcgcatcagcggtgcaaaacagcatatgcgagacgcaaccacctgaaaaatcaaaaaacacgtaatacacaagcgcgtaaacaagcgcacaccaacacgcttcacattcatggaggagagactgtgaaaagaagcattctggctttggcttccggcgcctttattcttggtgccgccgaattcgtgatgatgggcattttgcctcagacagccgccgccatgcaggtcagcattcctgcggcaggccattatatttccgcatatgcgatcggcgtgtgcgtgggcacgctgattctggtgttcggccgtaaggtaccgccgaagaatctcattattctgttcatgatcatcgcactggtcggcaacacgttgagcgcggtttcgttcaattcccccatgttgttggccgctcgtttcatttcgggcttgccgcatggcgcgtttttcggcacggccacgctgatcgccaagacgttggccgataagggcaaggaagcgcagtccgtgtcaatgatggtgacgggtcagacggttgccaatatgttgggtgtgcctgcgggcacattgctttcggaaatgctgtcgtggcgtttggcgtttgcgattcttgccgcttgggcgttgatgacgatgatgttggtgattgcgtgggtgccgttcgtcgcgccgattaaggacgctggcattaaggggcagttccgtttcctcactcacgccggtccgtggtttattctcatggcggtgttctgcggtaattccggtattttctgctggtggagctacgtttcaccgtggctgcagaaggtcggtggatgggattcttcgctggttcccctgttaatggtgcttgccggtttcggcatggtgatcggtggtattgcgggcggtcgtttgactgatttgtggaagcctggtgccaccgccgggctttcgcaggccattgccacgcttggcttgttgctggtgttctttgttcctggcaatcatgtgaccaccgctctgctgacattcctgattggtttcgcactgttcttcaactcgtctccacagcagctgctgatggtgcaggccggtgagggcggcggcgagctgattgcgggcgcggccgtgcagatcgcgttcaattttggcaatgcggttggttcgatcgttggtggtgccgcattgacggcaaacaccatgaactaccattacaccggtttggccggtgctccgatcgctttgatcgcggtgattatgctggtcacctattcgcgtcgttacgaaacgcatacgggcgctacggagcgtatgcgcgaagtgcatgtctgacattcgacagtcagttatttcgattatttctgttatgcaacgggatatctcatcacaattattgtgatgagatatcccgttgttctttgtacgacgtatcgcatgttccccatctttcgttgtttcgccgtctgcgatgccgtctgcagttcgggagatgatggaagtcaccgatgaagggattgcgatggcagacagtgatgtcaatctgaatatgaataattgcgatgacggatgcgcaacatttgatgtacaacgatttttgcgtggtcttgatgcgattttcgatgcgcataaggctcctgaacaggctgaaccgtatctgcagaaggcgcggaccgaagccgaacacagtcataatgacgccggtttgctgacggtgttgaacgaaacgatggggttttaccgttcgcaaggtcgccataccgacaatctgccgattatccgcgaatcgttaagcattgcggatcatttgcatcttcaggaaatcgacccgcaggcgtgggctacgacgctgatcaacgcggccacgggcatgcgagccgcaggccagtacgaggaggccgaacagctgtaccgtcaggcgcttgacgcggccacgtccgccttctcccccaccgaccgacgcctggccgcgctgcataacaatatgtccatgttgtacagcgaaaccggtcgtctcaatcaggcgaagcgcgagctggaacaggcgctggacctgttggagcaatcttcccccgatgcgagcgctgacatcgacgttgcctccacacacaccaatcttgcattgctgctcctgcagatggaccggtattgggcgagcgatgccatacagcatgcccagaaagcgttgacaatctaccgtaccgggcatttggaacatagtgcgcattatgcttcggcgctggccggctatgcgcaggcctgctatatggccggctgcctgcaggatgcggtttccggctatgagcatgcgttgagcgtgattgaggaatgctacggacgcaacaccgactactatcacacgactgcagtcaatcttgaagtggcaaaacaggcgttgcataagcacatgccatcatctcataaaacgcgggaatcgcaagaatatcaagaatcgcaagaatccttggaatctcagcattcaccgaaatcaatcgaatctcagcaatcaagtgaaccgcactatatgacggaatccggcgcatcttcgcttcctgcgatttctcaccatatttcgggacttgctttgtctcgcgcattctggaatgatctcggcaaaccgttgcttgccggcgcatattcggcatatcaggggcggattgccgcaggtttggtcggttatggttcggaatgtttcggtttcgacgatgagctgtcgcgcgatcatgatttcgcgccgcgtttctgcctgtggcttaccgatgaggattatgatgcgattggcgagcaattgcaggctgattacgatgcgttgagtcgcgatttcactgttgccgagcagggcaagccgcattttgcagggcatggttcggccaattccgacgctcttgccgcatctcaatcgccacttacgccgcgtgcgcaaggcgagttccgccgtgatggcgtgtttcgtatcggcgattttttcgagcggatcacgctgtttcgtgaggctccggcgcagaacgatgttgcatcttggctaagtttgcaggaagatacgttggccactgccacaaacggtcaggtgttcgctgatccgttgagggtgttttccaagactcggcaggggttcaagttcatgccggaagatgttcgactttccttgatttcccgccgtttgggcatgatggctcaggcggggcaatacaatctgccgcgcatgctgcaacgtggcgatggtgctgctgcgatgttgagcattcatgagttcgtgaacgccacggcttcgttgatgtttctggtcaatgagccggtgagcgttgggtacctgccgtattacaaatggcagtttgctgccatgcgcaagctgagccgccgtatggcaacaaggcttgccggcgtgtgcgaacagttggaagacatattgcgattgagttccgccgcatgtttcggtggtgtcggtttcggtgagggcggcaagggtgcgaagcctgcggcggagcgcattatcgccactgttgagcgcatctgcagtgatgttgtggatgaattgctgcgggagggattgaccgaatcccacgaaacgtttgtggaatggcagcggccgtatgttgagaaccatatcaagtccgacgcgagttgtctgcacagcctgtgacgtgcctgcagccaaaaaatccatcgcaagcattgcaaatcagagcaataatcagacgaaatcaagaatcgaaatcatatgaatagcagcgtaatttcagatgtaatagacggtcacgatacagcaaatcttgttgaatccattatcaaactggagtggaatcagtttcagcaaaccaataatgagggcggccgcgcgtcctgccaaggcaattggccgatgtttcatcagatgcgtgccagtcagttcatgacgtggccggaggaattgctgcgcagttaccggtcggacttgcaggaagccgaccgtgttggacgtaatttggtgacggaaaagtatggtcgcatgatgcaatccacatatccacaggagtattgtgcaaacattgcgccgtatattccccggatttccgcgaatcgcaacgtcttgcaggaaggcatcataacagttcaggtgtcgtgggcgcatgattttcgtgagcgttttcctcatctcggcgaggcgatgcgtgtgctgaccactgtcgaagatacgccagagaccacgtcgttcgaaacgtatctgcgcggcgaattgggcacctattccgaccgtaccgtggcgttgtaccacgattttgtggagcgtttgcggcatgagcggcgcaatctcaccgaagagacgattcgcaatacggttcgtttggctggatttgaggatttggcacaggctgaggccgcacagtaaacacagtgaaaacacaccgtgacaattactgaaaactgcagtaagccccgtacatcaccataaaaatgaccaccatggtacgaccaaaatccaacgtcaagatggaaaagcaagtgttggatttggtcatgccatggtgatcacgtatttgtttgcgatgtcagcctcgatttcgttggtgcggctgatatcaggggctattcagctgattctcacgatcgttccgaaaccggcgacttatccgaatcagtcgaaaaggccgtggcatccgagctatggggagcgtcgaatggatcgtcgctgtccgcatcgcctccattcttggatcggtttgaacgcaccgcgctgactatcgcccagatcacggcgacggcgataagcagcacgccgatgcctccgagcaggaatacgaagaactgtttcggatcgctggcccaccaccagagattcattggcacatgtatgccgcaaagcagcgtcaccacccccatgaagcacgtgaacacgccgagcgcgatggtcgaaccgcttcttccggaaggtctgatgatgtcgtctccagtctgccgattcttgcgcccatcattcgcaccggctaccgaagcggtataggtcggaacgccttgcgctggagcggattccacgcgcggcttatcatcctgcgttgcacgcccactgcgctgcgactggtcatacgtggactgcgcatccacggtatgcaacgtttcggtaggcatatctccggcatcagccatgaccggcatttcctgggtcttgtcgtcgctcatggtcactcctttcccgctttgcccaatgtgttgtcggacgcatactgcaccgcgacgctgccgccgaccgttgccatagtattgatccgcagtccggttggcatgaccggagccttgccatcatcggtgaagcacggccaatattgatgattgtcgtagatttcgcggtaggccttatctacattcccgtctttgaagggggaatcggtcctagtggaatcggcgccggtatccatgccatcttccgtatcggtctcatcatcgaaatcctcgatgccggattcgtctccgtacgagccgcaactccgatcgtaagttcccagcgcacgctttttcactaccgatttcgtggaatcgttgcccataagcgagacatagatattgccggaatccaacgtgagcccgtccgaactgccgacgaaatcggtgatgttgtagaaattaccgtcagacccgaacgcccaccagcagccgttcggcaaggtcaccacgacctgtgcgcttgaggccaccacattcaacgttcctgtagggcaggaagtcgtgccctgtgtgccatcctgaagatccactttgtgcggaccgttgtttttcgcgtaatcgcttaagtcgatatgcagcacgtcggtggcgtaatcatcgccttgcgcgacgatgccctgctcgtattcgctcatttcactggcggtggagcccatggtggtcattcccgacacattgacccttttgtaggatgagggaatgctcgtgtcaatccgatagctgaacagcgaataacccgccaaagccatcaccatgaccaacgacatgaatacggatatccatgtcagaggatgcaatcctcccgttcttctgcccgcgaatccgagcgcgacaataacgattcccgtcaccagacagatgccaccgacgaatgccgcgcatgcctgcaacgtgtattcggtgccccgctgcccgccttgaacgccgtacgtcataatgcaccatacgcatagtgcgcatgcgatcatcgtgagaccgaacatcatcaataccagcagtggaccagccggcttacggcgcccccttcttggctgcgtaggcgcctgcgccaccggggctaccggagcggtgaatgttggtggaacattggccgtggcaaaagcggccggaccattggcctgctgttggtaggcatgatactgaggctgttgaggctgagggcgctgaggctgaggcgattgcgattccggtgacgaagccgtgttggccaccccgttatatgcgccgctcgcctgcatcggctgagtataaggattcgattgcgctggagacggcgatgcaggaggcaccggctgtccgtacgaaggacttccatattgaggctgaccatattgcggttgaccgtacggagcctgaccatacgggggctgctgccactgatttggaggaacattcggcgcataaatctgcctattgagcagaagccacagcaccaacgcggccaacgcgaaagcaaaccatcctgcccccggcaaacagatggcaacaaggcagcacaacagcgcgccaatgcaattccaatcccacttgccgttaatcaaatcctcagcaagaatctgattgtcgcgctcatccggcagcacaaaccacgccaggccatagaacgcggcacccgcgccgaaaaacagtgtggcaaccatcataagcgcacgaaccaacgtggtattccaaccaagacgacgtgctatgccatcgcacacgccgccaatccaacggtcatgtccacgcttgacctggctggaacgaatccacgcgaagaaacggccgccgcgggaaggttgcggcgaaccgtacgcaggctgccgatgatacggctgtccagcagaaggctgcggccctgcgttgccgcgatcgcccagcggaccattgtttgcattgctcatggttccattacagcaactcgcgcatgccacacgtatcggggaacaccctgaatctgccctgaacactatatgaatgccctgaaacagcgtccttcacagggcacaatggaagtatgaaatccttaggaaaaccgtggtacacgcaaagccagtacgaccaggcgagcgccgtatatatgcgctactgctgcgaccaagccctgcatgagggacgtccgatgccgacacagccggccaaactgccgttgatgcgtcctccatacggacgcatgggagccggcgtatgcaaggcgatcagcatgcatttgggcattgccgtgctatgggtgcgcctgtttttcctcgccaccacatgtctgttcggttcagggctcatcgcttacattttcctgtggatggcacttcccgtaggagaccccatacagcagacgtacattattgccggcaagcgttcgccatggcaggcaccgctttcccggggcaacatgccgtacgggacatatcccgtttccctggaatatcaatcttttacagctacgcaagatggtcagcacacgcaaccaccatcttttgaagatacgactgaacgcaacgacgaaacgcatggtaatacgcaatcttccagcgaaaaccttgaacagacactgaagaaagcaccaaaacccgctttgcttgcattagctggtctgatactgctttccatctgtttcgtcatgttcgcaggcggtgttgaacgcactctgattgtgcccctgctgcttggtctggtcggtatcggcgtctcttggttgcgtttcaacgccgaagaaggtcaattatggacgatgcttggcggcattgcgattattttcgccgcatacgctttgtacgtcagttcctgcatgcattttgacgcgttttccatgattcgcatactgtgcgccggtttggcactgctgattggcgcattgcttgcgattgtgccatggatcatggcgctgattcgcgatttgggtacggaacgcgcatcgaaggaacgcgaagaggaacgtgccgacatgaccgcgcatctgcatgatggcgtactgcaaacgttggcgctgattcagttgcatgccgacgatcagcagacggtgttttcgctggcgcgttcgcaggaacgcgaattgcgtgaatggctgtatcaggaacgcaccacgtctgaccgttccgtgaacgccggcttgaaagaaatcgccgcacatgtggaagacacgcatggcaagccgatcgaagtggtgacggtgggcgacgcacgtccaagcgcgcaaaccgatgcgttgcttgacgccacgcaacaggcgcttatcaatgcggtagcgcatggaggagagccgatttccgtctactgcgaggcaagcagcaaactggtggaagtgttcgtgcgcgaccatggcaacggatttgacgtgaatgccatccccgcgaatcgccttggcattcgtgaatcgattatcggacgaatcaagcgtcgtggcggtacagtggagattgtatcgagaccgcaatggggcacggaggtacgcatgcatatgccaatcgcagacatgcccgcatccgcagccgccgacacgaatgcgcagcaatcgcacgagccgcaaagcaactcacaacaaaccgattttcccaatcaccataaccgtcaatccaacaatcaacgtaccaatcaattcagcaatcaacctaccaaccatttcgaggagcagcaatgaacgagcaggaacagcagatccgcatcgccatcgttgacgatcatgaaatgttccgtgcgggcgttatcgcaacgctgcagccgcatttcgacatcgtcgggcaagcggccgatgtcgagggatcggtggcgatgatcgcgcagacgaagccggatgtggtgctgcttgatgtgcatgttcccggtggcgagggtggcggcggtgccgagattctcgtgaaatcgcgcgcatactcccctaataccgtgtttctggcgctgtcggtgtctgattcgccgcaggatgtcggttcggtgattcgtgccggagcgcaaggctatgtgacaaagacgatttccggcgatgatttgatttcttccatcaagcaagtgcatgagggctatgccgtgttttcgccgaaattggcgggattcgtgctgtccgctttccaaaatggctcaccggctggcatgggcggctctgcaagcggaccgatccacgatgacgagctggaccgcttgtcgaaccgtgagcaggaagtcatgcgcttgatcgcgcgcggctacacgtacaaggaagtggctgcggaactgtttatttccatcaaaaccgtggaaacgcacgtcagctccgtactacgcaaactgcagctgtcaaaccgcaccgaactcacccgctgggccgccgaccgccgcatcgtataaccgaagaatcttccggcttatttcgtcatattctgcgtagacgttgcggacaggcgtacatagccggaatgatgcatggtgaatcgcatgcgatcagcgatatacacgtcagtggcacgctcgaacgggcatccatccgacgcataggcgatccggtgaatgcgcatcagcggagttcccgcctcgatctgcagcagctcgttctcctgctcgtcgccgaccaccgattccaatgtttcgtcgacattgcacggatacacgccataatcacgttcgaacatggtgtagaacggggtcgtcaaatcgcgtgtaaggaacagaggaaacagatatgccggcaaatgcgaccgttccaacgaaagcggccgattttcgatataccgcaatcgcgtaatgtcgtagatcatcggatgctcgcccggcaatcgcagcaaacgcacgtcggaaacggaagccggggcaatcaccgcctgcaatactttcgacgaaacgcgcatgccttgtcttcgcgcgatcgtcggcaatgattccaccgtgttgatattgcgttccaaacgtccgtccgatatgacgatgcccccggcacgaccgattttgcggatgatttcatgatcggattccaacacggtcaacgcattgcgcaaatcggaacggctgacgccaagactgtcggcgagcgcccgttccgatccgagtttctctccgggaagaagctcctgttcacgaatgcgagcgcggatacggtagaccagttcgctcgtagcgcttcgcgtgcgcccgatgccggtatgatcttccatatccgcgccctttctttatggttatctgtcgttttacagcttcaatgtttccagagtcttcatgaatccatccatgaaccaatccacatcggattcgctgaacaccagcggcgggcgcagcttgaggatattgccgtaacggccgcatacggaggtgaggatgtggttgtcacgcagggtttcgaggatatcgagcgctgcctgctggtcgggatccttggtgcccggcttgacgatttcgcagccgatgtacaggcccgcgccacgcacgtcgccgatgcaggggtgtgccggcataagcgacgcgacggcatccttgaatattgcgccgaccttcttggcgttgctcatggtgtcttcgtcacgcatcacgtcaagcaccgcctgggccgcggccatgcataccgggttgccgccgaaagtgttgaagtaaggaatggagcctgcgaacggttcaagtacttcgtgacgggcggccatcatcgacgtgggcagaccgttggccatgggcttgccggatgtgaccagatcgggaacaatgccttggcgtccgaatccccagaatgcgtcgccggtgcgagtgaagcccggctgcacttcgtcggcgatccatacgccacccagttcatgaacggtgtcgatcaccggcttcagatagccgaccggatcggggtacacgccgtcggaggagaagatggagtcggcaagcaatgccgcaaacttgatgccatgacgttccatatcggcaacggccttgcgcacttcgccagccatccagttgccgaattcctcggcggcgcattccgcggcaggcttgccgtcaatgaccaagcggtaagtgtccggcgtgggaatcatgcgcatggtcaagccaagcgtttgcgcggtgccgagcgctggggaaagcttggaggtgagtgccgaattgccatggtaggcctcgctggtcacgatcacgccttcgccgccagtgtaggtctgtgctacgcgaatggccagatcgttggcttcggaaccagtgcactggaacatgatgcggtcaagttcgtcaggcatggtggagaggatatcttccgcataatgcaggatgttctcatgcaggtagcgcgtgtgggtgttgagcatcgaagcctgctgggtaagtgcatccaccacgcgcgggtgacagtggccgacggatgcgacattgttgtacacgtccaagtattcctcgccgccggcatcccaaagatgcgagccacggcccttcaccagatgcactggattgcggtagaacaaacggtaggccggaccaagcacgtcacgctcttcggttagtttgcgtgtttctgggtcgagcgcggccgccatttccggacggaagctattggtgtccatgatggttgatcgagttgccatgattccttctttcgttggcttcctgtggcgttacccacacggtaacgcagtaatgttgagtggctgatacagcgcagaaacaaaccatttccgctgttttccacctatttggttgacctttttacatatttccgatgattgaaaaaggccgcatcccagatgaacacggccttggcaatatcgttttatttcaagaaaacgaaacgataatcgcagaaaatcagtcagtcttcagtcttatatgcgacctttccgccggaagcggcgaactcttcttccggagaaagcaccaggtgcttacgtccgtaaaccgcgaagaagatggtcgcgagaacgtagatgaccaccatggcgtagacggccagtcgataatccgggttcagcagcacggcaacgaaaatgcagaatgcaagcaaacctgcgattaccgcgcccggcacgccgaacgggctggtgaacggacgcttgatatcaggcatcttcttcctgaggatcacataggaaaccatctgcagcagatatgccagcaccgcaccccacacagcgatgttcaacaccaccgaaccggcgccatcaccgccgtacgcgatgatgaacagggctgcgaaaccgatgatcgcgccgacgaccagaccccagtacggcgtcttcttcttaccggtcagcgacaggaacgccggataatagcctgcacgggacagtgaatacaggttgcggccatacgcgaacataatgccttggatggaagcgagcagaccgatcaacgcgaatgcggacagcaccgcggcgagattgcccggcagaatcgcacgatagccatccagcaacggctcatcggaaccagcgagcgcttcggaaccgaccacagccgggttcaggaacacgatgatcagcgcggacaatcccagcgtgaaaatgcacaggcgggacgacttcggaatgttcttttccggctcacgcacttcctctgcagccagaggcagctgctcaataccaaggaacaaccacatggcgaacggcatggcgtagaagatggcacctgggccgaacggcaggaacgcggagttgccttcggtaggcgtgatattgagcagcgtggagaaatcggccttaccagtggcgaaagcgccgataccgaacagtgcgacgatggcgagcgcggcgatcgacacgacttcggcgaaacggaacgacgtttcggcgcccagccaattgaccactacgaaaatcgcatacaaggcaagccaccaaacccaagccaagccatgatcgtcaagcgaatatccggtcaggttcgacaggatcgcatcagcgtatgccgacgagaagtagacgatggtggctgcggtcatcacatactcgatggtttccgcaaggccggtgaagaagccgccccacggacccatggcggcacgcgcgaaggaatacgcgccacccgtgtgcggcatggccgacgccatttcgctgatggagttgagcataagcacgtacatgaggtacaccacgatggcggccaccagcatgccaccccatccggcttgggcgatgcctccgttccagccggagaagtcgccggagatcaccgcggaaatgccgatggcccatagaccgaacgctcccgcggttcgcttaagctgtcgttttgcgaaatagtccttgtcggtttcaacgtaggtcacgccgcctatcgatcgtcccgaaacagttgacgcagtcattgtaatcgccttcctctcttattgttcggcgagttatgccattgattcctcgtttggttggttgcggtcagatgttgttaagttataaaaattgagattttcgtaattgcgtatttttacgtgcttacgattggatttcttggattgtctggtttctgcgtaattacgcttgtttcatgcaacttgcctaatgcagcagccagagcggatcctcaagatagttttttgcgcacatcacgctgccgggagcctgctgtgcagcgagaccgtcgggcagggcatcctcacggtggctggtggtccagccgagcatctgcatgcgtcggatcatggaaagcgcggacatgatacgcagttcctcatccgtgaacgaacctgcgacgcgctggtatcccttgacccacgccttggcaagatcgggagcatacggttcatgttcgatgaaactcagcgatgaagcgtaatcgtagagataccagctgtatccggcatcgtcgaaatcgatgacggtcagtctcccgtcattgccgcgaatcacgttcgacgggcgcaagtcggcatggataagcccccaagtttcgttggttctcggcactttcatcaccacgtccatggccttccacagcgcggtgtcgcacagctgcttctcttcgtcggtgagattggcgttttcccaacgtccccaacgcggtgccggaccaaccatgttcgaaagatcccaattgaagcgggtgaaaccgtacggtttgctccacgtgcgcgactgctcatggaatttcgcagcccattcaccgatcgtctcgtaatacggtgcaggattctcaagatcttccagcacggttccttccacatatttcgtggagatcaccgtccagccgacaccgttcagatcagtgattttcgttacgaacgtgccacggatggtgggaaccggattgatcaggctgataccttcgatatcatgcaacgcattcaaccagctgatttccgacgccaccgcctcgggacctcccacatagcccggctgcgagacacgtaccacgccttggggctcgccgtccagcaacagcaggaacgtcgcgttctcggatacggtgatgaggttgagttgcgcccgctggtggtcgatgccccaagccgcgcaaacgccttggaaaagccagaatggtgcggggcatcctttggtgagcccactgaaagtgtctagactgaccgcttgcgtaggatcgtcaagcaagcgagtgatctgctgtgccatggtggcctcgattcatacatgggatttttcctgtgagagacatgtccgtcagtaaaacctcttcacgaaactgtcgatacccacgattgtgccggaatcgtccgttacaatcaccaccgcactgttacgccgcagttacaaaagcgcaccgcaagattaatggctcattaccgatgccagccgagcatcatccaagttttggcgcaatatgcacgacatacaaaaaagcggggcttgctgagcagaactcaacaaaccccgcagaatcaaagtccttacctatcctacgatggaatcagtatcagtgacggtgaccagcggcgtgaacaatgccatggcgctcaatgccatctgatggttttctggcgaactgcctgcacaagcgtcagcagcaacgcgtaccgctacaccattgtcagccgcggcgagcacagtggtaagcacacagcaatcggtggcgacaccacataccgtgatctttttagcgcctttaatggcttcgctcagcacgcttccccacttgccgaaagtgtcgcaactgaccacggcatggccttgcgccaattccgcggtatccgcggtgagatcgtacatcggatcgtcgggagcaaccaaaaactgcggccaatctttgaaataatcaacccaagcgttttgcggtgactcaggcgcaacatatcgcgtatagaccacacgatcgccgaacgccttagccaatcgtgcgaacgcttcatcagtagtgtgataggagccgtccgggcaagcccatgcggaccattcactttccgcaaaaacacgctgcctgtcgataactaccagccattcatcttccgcaatcatgacttttcctttccttgtattatcgcaataagcaactcatgcttccgaaaccggcagatcagcttcctgcttggcaatatcgccacgctggaacatcaacgatcccgcaagaccaataatcagcgcaacaatcacaccaagattggcggcagcccaactaccttctttgccaccgataaggaacagcagatacccctgccagttcagccagctggcggcagtgttgaccaccaatccccaaccaagcacggtaccgacgacaagaatggcgaaagacttaccgttccacgcaccgtaacgccccttcggatcatacaaatcagcggtgctgtaatccttcttgcgaatgatcacatcggccacgaacatgccggcccatacggccatcggcacaccgagcgtggtcagaaagccttggaacgggccaatgaacgtgtcggagaagaaagtcacgtagaccacaccaagcacagtcaaagcggcggtgagcgcggcagccacggtacgcggcaacttcacaccgaacgacagcagcgcaagcccgttggaataattgtccataatggagccggacatcaaaccgagcacggccacaatggtgtacggaatcaagtaccaggtcggcagaatggaagccatggctccaatcggatcatttccaacgttttccgccatgtcggcattggaaaccgcgagcagcagaccgtagaaaatcaggaacacattggcaatggacgcaccgaatgtggtccagaacacaatgccgccattggaggagttgcgcggcagatagcgcgagtaatcggcagcgatattcacccagcccaagccaaagccggtcatcacgaagaagcagcagccgagcatggccggcaatgatcccgccggaaccgagtcaatggcggaaaagtcaatatgtccccagccgaggataaagaaaccgacggtgatcacaccggtcacgatggtgatgacctgctgacaacgcataatcaggtcgtatccgaaaatacctgcgaccaccacaaggccgaccaccacaatggtggagatgatcttgggcgcgacaccagagccccaaccgattttttcgatggtgcttgataatgccaacacagcggtggtggtcagtgaaatctcccagcctaatgtggcgatccagctcagagccgctggcactttggcaccttccacgccgaatgtggcgcgggtgagcaccatggtgggcgcgttgccgcgtttgcccgcgatggaaatgatgccgaccagcaggaacgagatgaccacgccaataatggtcatggcggtggcctgccagaacgaaatgccgaaaccgagcgcccacgcgccgtacgacatggcgaacatggaaacattggcagcgaaccagggccaaaacagactggccggcgtgcccttacgctcctcttcggatatggtgtcgataccctgctcctcgatggagagggtccctttctcattgctcatgtgaaactaatctccttgaatctgccgagcaacgccgcgggcaagcgacatgcacgccgcgtcagcgcaatcgtgcacatgatataaccacttatagtcatttgtactataagtcttagaacgcccttcctaggagccgctcaacctcctttcgatcagggcaggtagccggccctgatcgcgttacagacaacgccgaagcagcattggcgcaacgtacagcctcctccaacggcacgccttcgcacagcagggcgcacaacacacccgcgtgacaatcaccagcgccattggtatccaccgctttcattggaaaacctggaattcgcagcacttcgtcaccgggaatcgccgaccacgcaccatccgcgcccacgcgaacgattacaggagattgcaatcgatcgcacagccacgcaaccgtctcctcattgacattcgcactctcaatctcttgcagcatatcccgcgaaaccttgcaatcgcaagaatcgccactatcgagcgccgccaaacgttgcgcaatcaacgttgcctcgcgttcattgcacgaccatatcggacgatatgcgagcatcacacggaaaacgtcatcatcaactgccgagatcatcggagaaggatcgaataccgcagtgaactcacgatgttcagtcgttcttttcacaaaagcaagcagcgcgtccgcagtgtgatgcaccaacgtgtatccgctcacatgcacgacatcccgcttttctggattcacagaatcgaacgcatcggcactgccgtacgcttctgcgcccctcgtcgaaatgaacgtccgttcagcattcgcgtcggtcaacgccacgcaaaatcccgaatcgtgcacggcatcccgcttgccgatatgctgaatttcctgattttccaacgtttgcagaatctgcgaagcccacggccccgtaccaatcacaccagcatgagacgccttaacgcccatgcggcgcacggcatacagcgtgttgaagctggcaccaacctgcgtttgcacattgccggcgaacacatcttcacccgcacgcggcaccgcgtccacattcatggtcagatcgacaataacctgcccaagagaaataacttttccagtcattgcgatgcctttcgcacttccgtcatagtttcgctaactacggttcctgcagatcaaacgatatttacatcattaagcgcactatcatcgcgtaacgcgcgtagcgacgtaacagtgccgaccaaatcaaggtgattatcttcagcaagttgtgaaagcacctgatcaagcatggttttgtcgaaaccttgcataccatgccacgcccccagcatcgcgcccgcaatagccgcaatggtgtcagtgtcgccaccgatagaagccgcgaaacacaaagcatgcgtgggatcgtcaaaaaagcgcgccgcaatggcgaaagcggcggccacggactcgttcgattccacgctggtaccgcaattccgttgcagcacagcagcgaattcgttgtcattgagcctgcatccatcagtttcggcccaattcatgaaatattgcacacgcgcaagcaccgaagcctttgccgaccaattgccacgctgtggaagcttccgtacgaattccaccgcgaggtgcaaaaagtcacgttctccttcaatggcaaagctcaccgccgcagccaccaaagtggtcgcttcaatgccctgcaccgtgttatgcgtcaccacacaggatcgccaggcggcgtcggcgagcgcttggcctggacggaatgcgatgcccaccggcgtggcacgcattgcaccgccgttggtggtgccgaatcggccggtctcttccagacttacgccttcggtaagtttttgcagcgctgctttggtggaaggtcccagcaggtcaagcgatcccttggccttcatcgcagcttcccattgcagcagatcgtgggcgtatcgggtgttatcaatgcagccgttatcgtcgataagtcgccgtgcgagtacgaaagcctgttctgtatcgtcggtgacggcaccagctttcatattcggtgcgatcggctgctgcggcacggcattcataagtttcgtgatcggaccgtcgtaataccggcgaatctgcttgtccgacatgctttgcgtaggcattcccaacgcatcgcccaacgcaagcccagccatagctcccatcgctcgttccttcatttgcatcccattctcacgcatagtcacagcagcctttctcacaactcagcctgatcgtacaccgaacaacatcacaatccctccccaatccttccagtcactggaagaaagtggacatttacaagcctctcaacgacccaaatcctccacccactggagaaaaacagacgcccacaagccccccccccagcgggaaaaatcccccagtcactggaagaatcgccccgccacagaccatcccagcgacccaaatcctccacccactggaagaatctggacgctcacagggccaacagcgggaagattgttccagtggatggaagaatacggactttcacgcgctccctagcggggagaattattccagtggatggaagaattgagacttggacggtgctgagccgaacttgggtggagtttacccggattgcagcaacaaaaaaggcttaccgagtgcttagagcgctctcagtaagccttataggcgggtaaggcgagattcgaactcgcggaggcttgcacctcaacggttttcaagaccgtctctttagaccgctcagacacctacccatgtgcatcacgcacgaaacgctaatatagcacaacccaaagaacgaggggaagaaagcgagcaaggacaaaggaaagaacgcggcgaaaacaaaaaagaagggacccgctcaccgcgagtcccttcctataagccagaaaagccagaaatcggcaaatgccaaatgccaggcatcctcagacttccatatttcgtattgcagaagtccgtttcagcagtttagtagctcagcaactcagtggaaccgataaacaaacccgagttaccaaactccacgagcaacccaagctatcagactctgccaagcaaacccaaattctatcaggcttcccacttggtcggctcgatgacttccttgccacccatgtaggcacgcatggcctgcgggatgacgatggagccgtccttctgctgatggttctcaagaatggcaaccagccaacgggtggtggccagcgtaccgttcagcgtggaaacggcgcgggtgccaccatcttccatacgttcgcgaatgttcagacggcgagcctgatattcggtgcagttggaggtggaggtcagctcacggtagcgaccctgggtcggcacccaagcctcgcagtcgaacttgcgggctgcggaagagcccagatcgccggcagcggtatcgatgatgcggtacggcacctcgaccttgccgagcatttcctgctccatggccagcaggtgctcatgctccttgtaggagtcctcctgcttggtgtaaacgaacatttccaccttgtcgaactggtgcacgcggatgatgccggaagtatccttgccagctgcgccagcctcacggcggtagcaggagctccaaccgcagtaacgcagcggaccgtcagacaggtcgagaatctcgttctcgtgcataccggcgagcgccacttcggaagtaccgaccaagtactgctcgtcaggttcgcgcagacggtagatttcgtcggcgtgggagttgaggaagccagtgccgcgcatcacttccggacgcaccagcgtcggggtgatggccagcgtgaagccgtgctcttcggcctggtccacagccatggtgagcatggcgatctgcatacgtgccacctggccgcgcaggaagtagaagcgggaaccgccgaccttcacgccacgttccatatcgatgccggcaacgccacgaccgagggtcaggtgatccttcggctcgaaaccttcggctgcgaaatcgcggatctgtccaaccttcttgaccaccacgtaatcgtcttcgccaccttccggagcttccggctcaaccacgttggagagcttccacatggcggtggtgtattcttcggctgcggcgtccgctgcggccttgtattcggaaaccttctgggagagttccttggtttcggcaatcagcttggccttttcgtcggccggagccgcggcgaccttcttgccgatttccttctgctgcgcacgggcagcctcgaattccttcagagaggaacgacgaacctcgtcggagcgcagcacctcgtcgaccagttcgaccgattcgccacgcttgcgctgggattccttaacaacgtcagcatgttcacgaatgaattggatatcaagcatgcctcctagcctagtgctgaaagccgacacccgccgcagtcctctcatttttgtatacaacgtgcaggaatcgtcgaataaatcagtcttgattcgcttttttcgcatcttccgtgaacaatagatgacatgcctatgcctgttatcattctgattgtcgttcttgcggtcgcagcggtgtgcgcggccgcctttttcgcagtacgcgcgtataagcatcgcaaacttgcggaacagctcgacaagcgcgacgatgatcaggtgcattacgcgtttgtgatcaatccttcgaaaccgcaggcggaacaacgcaagcagcatattcaggagttctgcgaggcgaagcatctcacgcaggttgaatatatcggaacgcagcttgataaggatggtcgcgcctgcgcgctggaagccttggagcatggcgccgacgtggtggtcgcggtcggcggcgacggcacggtgcgcacggtggcgagcgcactttcgggaaccggccacgcgctgggcatcatccctattggcaccggcaatctgtttgcccgcaatatgggcattcctgtggatgatatcgatgcggcactgaccgtcgccacatctcatggttcgcgtttggtggatgtcggccgactgacgctgctcgatgatgaagccgccgatcacggccatgcgttccttattatcgcgggcatcggctttgatgcggtgatgatcgacgacaccgatcctgagttgaagaagaacatcagctggctcgcctatttcgtgtcgggcgtgaagaacctgttcgccccgaagtacaagggtgatgtgaccattaccagcgccgacggcagcacgcacaccacgcacggattgaccttccgcacgttcatggccggcaattgcggccagattccggtattttcgctcatgcccgacgccgtgtacgatgacggcattctcgattacgagatcattgacacatccggcggtttgatcggttgggcgaatctgttcggcgatgtgctgcatcagacgatcaccggcaaggcccagcagagtccgctgtccacgaattccacggttgaccagattcagggcgtcagcgcggaaatcaagttggagaaacccgttttggcgcaggttgacggcgatatgcttcccgaaacgcagcatattcgtttcagtgtggagcgtaagtctttgtgcgtgcgcgtgccggaagcgcccgaagccaatacttccaatgtaaataactattatcgtaattattaaattatttattacgatgattatgtattttatgcagattatgcattggtatcgtcattctcatgcgattccgtcgcatgagaagtcactcgtgcgacatgcaaggtgagataggcgatttccgcttccgaaagactcacgttcaatcgcattttgacgatgatcgcaagtttgttcgcacaatccgatgctttcggatatgaggttttgatggattccacgattggttcaggctcgtcatcaagctgttcatgttggtggatgcgcacgaaaagatagcgcagatgcgtgatgaaacgcgccacattgacgctgttctggtcgagagtgatgccgtaatagccttcgatgaccgtcagcatttgctggatgacgccggtcatggtgtatgtggcggaaagatcgccggtagagaagcccgcattgaccaagtgcagggccaaagccacggcttcgcaatccggcagcgcaccgcccagatacgtgttcatggcatcgaccagagctttgcctttggcatattcgctcgcgtagagcgaacgcacttcggcttccagcggatattcgatggtctgcttgttttgcgatcggcggatcgcaccgcaaatatggtcggataatgccagcaccaatgcaggctgtctgtcggcctgttccttcagaccggtgcggttcatggcgtccgtaacgagacgaatgatttcgggcggaatcccggccacctgttgggccatatggtcgggatccttgccatctgcgggaacgaaccgacggacgatcttcgcgtcgtcaacatgctggccgggcttggcttggaaacctatacctcgaccggtgagaatcacctcactgttgccgtcttttgccagtacgacattattgttgaatacgcgaagaacgtccacgtcggccccttccgactatgcgattggtcagcgctgaatgtcgatcaccgactcaccggccttgacgtcgacgccggtctttggcgtgacggacgcgaaggccactgtgttcagcaccgtcatcaatgtggtggtgctgtatccagcttccttaaccttatcaaagtcgacgacaacgaggttgtcccccgcgttcacgtgttcgttggccttgaccttcacatcgaagccttcgccgttcatcttcaccgtgtcgatgccgacgtgcacgagcacttccacgccatcatcggttttgatgccgaatgcgtgaccggtttcggcgacggtctgcagcacgccggataccggcgcgacgacggtgctgtctgccggctggatgccgacgccttcgcctagtgcgcgggatgcgaacaccggatcgccggtttcatccagggaaatcacatggcctgcgactggagcgttcaccacggtggtggtggcggcagcagcagccggggcttcagtcttggtggcggcaacagtggcagtcgcggtggcagcagccggagcgactcccttggcttcgaccgacgagacagcggtcttctgattggcagccgcgcgggccagcacttcggccttctgttccggagtgcggtagtcgaaggtgatgatcagaaggaaggaggtgaggaaggacacggcgatggacactgcatacacccacatctgattgaagaccggaatggtcagcaacgaggtgaatgcgaaagcggtggtggtcacgccatgcacggtctggccggcggcggtgacggacgggaagagccaaccgaggatggcgatgacgacgccaccgagaccgcagcccaccagcatgcgcttgtagatgagcttgtaacgcaggtgaatgccgtacagagacggttcggaaacgccaccgagcaggccggccgcaagtgcgcccaaagcggtctggcgcatgtccttatccttgtcacgcacagcaaggaagagcacgccagcggtagcgccgaagcaggcgaagttccacacgcccatcgggccttggatgaagtcgtagccgagagtctggatgttcatgagcatcagggcgttgagtggccagtgcaaaccgagcggcacgaggaacgggtacagcatcggaatgatgatggcgaagatgaacggggcatgggtgttcatccaggccaagccgacgccgaggccgttgccgacccacacgccgatcgggccgatgatgaaggcggtcagcgcgccaacgatgatcatgcagaagaacggcacgaagaccagctggacgctttccgggatgatcctcttcaatccgtggtagacgagagcaagcacggcggccatgagcagcggcacgaacacgttgccggaatagtcgctcaatgccatcggcagaccgaatatgttggccatgcaagacttggtgcccagagcggcgttctccacgcacgtggtggtcttggcgtccatcaagccggtgaactgcggggtcatgagcatggccatgatggcaccacccagccatgggtcgactttgagcttcttggacgcgttgtaggcgaccatgatcggcaggaagtagaatacgcccttccagatggctttcacgaatacccagcctgcggaaacctcgtcattcggaatgacgttcagcgaaataagcaggttgaccagcgcgatgatgatggaagcgccgagcagcacgcccagaatcgggcggaaggaatcggagagatactcgaagaaggagtccagccaagccaccttgccgcgggccttggaacgggcttcggccttgacgtcggcattgctcttctgaccatcgtcggatgcggaggcaccgccgacaccggccatttcgggcagatgcatgatgttttcgtacacggtggcaacgccaccgccgatgaccacctggaagcggtcgccgctctgcggcaccgcgccgagcacgccctgcatgtgctcgagactattctgatcgaccttggatgcgtcaaccagttcaaagcgcagtcgagtggcgcaatgcgtcagactgcgaacgttttcaggaccaccgattgcagtgatgatctgcgatgcgagtgagtcagccatcctgatttcctttctttcccttacaaccgattcgatccgagcaacaccgcttcgggcaacaaaaaaagacctgagatatggctatagttcagccacatctcaggtcttgcgtctttatgttgactagcaaccctgcatcagtcgaatagcatggaactatacaccatcgtttgacattgcgcaactcggctaagcgcagaatccgccattttcgaaaattcatgtacacacatccgaacatgcactaaacagacaacgtattcatcgcgcataatgggacaattacgcacatctgacgcaaaagcgtggcagaatagtgactatggttgcaaacaatgcgggaatgcccgctaccccagcagatctgatcaatgtcgacgaggtcatcggcaagtactatgacgtcgtccccgaccccaacgttccggaacagcgtgtctccttcggcacctccggccaccgcggatcgtctctgaagacctcgttcaacgaggcccatatcgtcgccatcacccaggccatcgccgaataccgcaagaaggccggcgtgaccggcccgctgtacatcggccgcgacactcatgctctgtccgagccggcttggaagaccgccatcgaagtgctcgtcgccaacggcgtgaccgtgcgcatcgattcccgcgacgacttcaccccgaccccggttgtgtcccaggccatcctgacccacaaccgcgcagcggatggcacccagcgcttcaccggcgaaggcctggccgacggcatcgtggtgaccccgtcgcacaacccgccgaccgatggcggcttcaagtatgacccggtcaccggcggcccggctccgtccgacgtcaccaacgccatcgcggatcgtgccaacgagctgctcggcgatttcaagaacatcaagcgcgttccgttcgagcaggccgtcaagtccgacctggtcgagcgcttcgacttccgcgagcactatgtcgccgatctggagaacgtcatcgacttcgatgtgatccgttcctccggcgtgcgcctgggcatcgacccgctcggcggcgcttccgtcaactactggccgctgatgaacgagaagttcaacctgaccatcgacgtggtgcgcccgcaggtcgatccgacctggagcttcatgaccatcgaccatgatggcaagatccgcatggatccgagctccccgtacgccatgaagggtcttgtggactccctcaacaacggcgcttgggacaagtacgacctggtcggcggcaccgatccggacgccgaccgtcacggcatcgtatgcccgaactggggcgtgatgaacccgaaccactacatcgccgtgtgcgtagagtacctgttcggcggcaaccgcccgggctggccggaaggcgccggcatcggcaagacgctggtgtcctcctccctgatcgaccgcgtggccgcttccatcgacgccaagctcgttgaggttccggtcggcttcaagtggttcgttgacccgctgttcaagggcgaagtcgccttcggcggcgaagagagctccggcatgagcttcctgcgcaaggacggccgtgtgtggaccaccgataaggatggtctgatccctgacctgctggctgcggaaatcaccgccaagaccggcaagaacccggcccagctgcatcaggagcaggtcgatcgctttggcgaaagctggtacaagcgagtcgacacgccgaccaccttggagcagaagcagaagttcgccaagctttccggcgacgacgtcgcggccacccagctggccggcgaggacatcaccgccaagctcaccgaagccccgggcaaccacgccaagatcggcggcctgaaggtcaccaccgagaacaactggttcgcggcccgtccttccggcaccgagaacatctacaaggtgtacgccgagtccttcgaatcccccgaagccctcgacaaggtgctcgccgaagccaccgaagtcgtggacaaggccttggccgagtgatcattgacgaatcggcgtaatccagccattcgccaatcattcgcaaactcactgagaagcccgctttcctgaaaaaggcgggcttctcgcatatccgcccgaatacgaatcgcaacgaacacgaatcgtgcgatatggcacgaaacgccgaattctggcatgacacgccgaattctggcatgacacgcacgctatcaccctcctgccggccccgcttcgcattacgcttgaatgatagcgacacaacactcagtccagcggtccccgccaatcttcatgggaggtgaacgatgcgcatcgccatcgtcgaagaccacgccgccgaacgccaactgatggccgtcatgtgcgcggaatatttcaaacgcacccgcgatatcggcgtggaatgcgtgaccttcgccgatgcggaatccttcatcgaaagctggaaagacgcccgatacgacctgctgctgctcgactgctatctgtcggacgacgaaaccgccacgcatgcggcgaccggacttgatatcgcacggacgctgcgcagacaaaacgacgattgcccgatcgtgttcatcacgtcaagcactgatttcgccgtgctcggctacgaggtgcaggcaagcggatatctgttgaagcccctgaatcacgacgcgttccatgcgaccatggaccgcgtcgcagcgcagctcgacacgaaaacaccggtcactcatctgaaaaaacatcaatcgacgggcaatgcacaaagcagcacggacgccgcatggcaggtggcgttcggcaatcccgccatcaccatggaccgtcgccttatcgcctacgcgctttccagcgcgcattatgtggaattcaccttcgccgacggcacctgcacgaaaatccgcaccaacttctccgatgtggaacatcgtctcaccgtattcagcaacttctaccgcaccgcgcgaggagtgctcgtcaacttcgactacgtgtcaggcatcagcaacaatgaattcgtgatgaaaggcggcaagcacattcccatcacgaaaaccgcggtgaccaccacctgcagaaaatacgcggaatacacgttcacccgcatgagaatggaagactagccatgcttgacgcactcgcatcgatcgcgccatcatgcatgctcttcgccatcggcgagcagctaaacgcgctaacgggcctgcttctctgcctgtacatgacctggcatcatatggagaattccaagcgcgacggccttattctcatgatttccggcgtgattgtcttcttcctgtgcggcatcgcatgttgcctcgcccacgtcccctcgctctggtccgtgattccttcggctccggttgtggtattggctttacgtaagatgacgaatcttccttgggggcagcttcttttcgtcgtttcaacagtcgcatatatcgtcgcgatcgtttattacctgtctttggccgtggatttagctgttctgaatgagcagtccatgaatttacgtgtcggatggccgggaatgatcagtctgctgatttttgatttgattgcggcgactacacttttccatccgttccatcattcattttccgcaacattcgattcaccttccatcagcaggaatttttggagggtcatctggctttttccgttcatttccacagcaattgtggtgtggtgcatgcccgccgacaacgcatcgctgctcgacacccgcgtgcttagcatcgccttcaccgtatccatcgcatattccggtttcatggccatggcctacttcctcatctggtatatggtccagcaggcggaccgactgcgcgaagccagcaaacgcgaacattacgaagccatgcagaccttgcagctgcagcatatgaacgaacgcatcaacgaagcgaggcagatcaagcacaatatccggcatcatattcagacgttgcaggctctcgccgcggccgacgatatgcccggcatcacctcgtatttggaggagatggccaatcataggctgttgcaccccatccccatgcagtattgcgaacatgcttcgttgaacgcggtgctggtctactactgtgactggatccgccatataggggctgaagtcgatgtcaaagcgtcggtgccgcaatatctcaacatcaataatgccgaattatgttccatggtcggcaatctactggaaaatgcgtctgaggccattatgaaacaacaggatggggagaaaaaactcagggtgcgcatcaaatatcgcactgggccgcccgcatcactgttcattgtggtcgacaacacgcacgattcctccattatgcaggttggcgacgctttcgcctcaaccaagcatgggggtgaaggtttgggcaccgccaccgtgcgcgaaaccgcggaacggcatcatggcgcgacctcgttcgattatgacggcacgctgttccgcgcttccgtcatgctgtgtttggatgattgagattcccgttcgacgtcgcccgatcacagttcgcagttcaccacgtatggcagcgtctcacggctttcgtagggtagagatatgacgattacggtttctacagacggttccgctttaggcaatccgaatggtccgatgggttggggttgggccgatcatgagcttgccacaggcggcaagccggggcatcaccatgacagcgactgcgatgccggcggagctacgaacggcaccaatcagattggcgagctgtgcgcggtgctggaggcgttgcgcgcgcaccccggctccgaaccgttggtgatcgaaaccgattcgcagtatgcgatcaactgttccaccacgtgggttcacggctggaagaagaacggctggaagaactcgcagaagaagccggtaaagaacgcggatctgattcgcgcgatcgatgccgaaatctccaagcgccccggaccggtgaaattcgtatgggtcaagggtcatgccggcaatgccggcaatgagaaggtggacgagctggcgcgcacctatgcgggcgattgccgttcgaagatccgtgaaggatatcttcctttggagggttggcagtcgctgctggcttccgaatattcgcaaggtaccgatgttcccgatgatgcccaaatgctgcttgacggcaaaatcactacggacgaataccatatggggcgcgggcaaggcaagtccgctcaaggatcgttggccgatgatctgatgggcgcggccgatccggagccgcgtccgcgttccatcgccgatatgctggtggagccggaaggctatccagcgcccgacgaggcgacattgccgttgacgtccaacgaaatgtcggtggaatccgacgacatgccggaaccgaccaccgcgcttgatacgaccatgcctgatggcacgacgcctgacgccgaggcaccgcgcaaatcgtatgccgaaatgctgctcaagccggactgttttccccacgagcatgacgagcggcagccagccgacgatgcacagaacgaacaatccgcgaattcctcggaaaacacgccggcgccaacgagcgaatcagccgaatccgcaaacgcgtcggcgccaacgaacgccgtcgccgacttgccgaaactgccgcatcgcgccagtccttcgggattggcggtgtcgggcaccattcgcttcactcccccgccaaattccagtccgacgttcgacggcaagccacgcctgatccgcggttacatcgcggtggaaggctacgtgcaaggcgacggcacgctcgtcctcgacgaagcgccatttgcagtcaagcacaactaacgagccagcactttcgaccttaacgcctcgaaagtgcgtgaaacatcctgtgaaaacatttgctgaccaccaatggcacaccttcgttcatgacatgtccgcaaacgcacaaaaatcaacacatccgataatatggagacggtcttaaccccatatcgaaggaggatcatggacaaggcacagcaggacgcattgaagaaggcagccggcatcgaagctgccaagctgattcagaacggcatgatcgcaggtctgggcaccggctcgaccgtgcgcttcctggtcgacgagctcggccgccgcgtgcaggaggaaggcttggagttcaccggcgtgaccacctcccgccgcactcaggagcaggcagaaggctacggcatcaagatcgtcgacatcgatgacgttgatcacatcgacgtgaccatcgacggcgccgacgaggtcgacaagaacttcaacggcatcaagggcggcggcgccgctctgctgtgggagaagatcgtggccaccaactccaacaagatcgtgtggatcgtggacgagtccaaggttgtggacaccatcggcaagttcccgctgccggttgaggtgattccgttcggcgcaggccaggtcgtcaagaagttcgaatcccgcggctacaagccggtgcttcgcctcgacgccgaaggccagccggtgcgcaccgacgagaacaactacgtggtcgatctgcacctcgaatgcatcgaacacccggaggctctggccgacgatctcatcaacaccgttggcgtggtggagcatggcctgttcctgcacatggtggaccaggtcatcgtgggcgatcccaacggtccgcgcgtgctcaccaactccaacaagtgagtttgaagtagcgtaagttccgcattttccgcagattttcgcgaacctacacgaaaccatatgaggctgtgcgttcaacttcgaacgcacagccttctttttgcatctattgattttcgattctcgtacttttcgtttatttctttgcaatatgcaaaaatcccgcatacctcaagaagacatacgggattttgtttaagcgacgcttcaaccgcgcctgaagactacttgcgctggtggcgagtcttacgaagcagtttgcggtgcttcttcttgctcatgcgcttgcggcgcttcttgatgaccgagcccatctcagcctccgttcttaaactcaaagggtaaaagtttgcaacttgcccaatactacactgcttcggggactaacgcacacaaccgcattcatatggtggaagcacgcacctctttatcggaagatcaggcaaacgcagtccgcatggtccacggctgaatcttacgtgaatcatgcatgaatcataggatcgcacaaccagccgtaggcagtatcacagcgggaactgctggtagaagcgctgcaccgaatccttggctcccgtggcttggaacaccacggtatcgttgcgccagaccgcgatggccttggtttcgtcgtccggatcggttttggcgctataggcgccggtcgcttcaccggaaaccttcacattgccgccgcccagctccttgccggtcatggcaccggtcagattgtcatactgactttgcgcatcatcagactgagaccattgcgccactttcaaggtgatatcctgaccgtccttgcccgtggaatacgtcaacgtgtactcctcgaccggggaagcgccgctccacgaagtgctggcatcggccttggtgcgcgcgaaattcaacacggaatcaggcatggccttcaacagttcgctggcgtcatccggcaacgccacagcgtcaatggacggcgtggtcggctcagaggcatcctgcgacgcgccctgcgaggtggtggtgccctgagtggacgcttcatcgcccttgttcagagcccagccgggccagatgaaagcggacaccaaggcgagcacgaccaccaaagcggcggcaatgacagccacgatcagtttgccatgagaagaggaagtttgcgtagtagacatggctgttattctttcatatccgtgagacgctcgaatccagaaaccgtgatctcgccatcatcccgcaccagcacccccttaatatctccgaaaacgattgtcccaaaatatccgtattgtcggcgatatggcaaagacgtcctcgcaatttgtatgttccgaatgcggctggagcgggccgaaatggctgggccgctgccctgaatgcggccagtggggcaccatcgaggaattccatgaagcgcgcccctccgcatcgtcacgcaccgccgctcccggacgcacatcgcgcacgctatcgcatgcagtgcccgattccgcggcgaaaccgatcacggaaatcagtacggaaaacatttccagaatcgacactgggttcacggaattcaaccgcgtacttggcggcggcatcgttcccggttccgtcacgcttatcgcgggcgaaccgggtatcggcaaatcaacgctgctgctggagaccgcaggcaatgttgcccgtctttccgcagcacagcccgaacgcaacacggtgctctatatttccggtgaggaatcgcaggcgcaggtgcgcatgagggcctcgcgcatcggcgcggtcgaaccgaatctgcttctggccgccaccaccgacctgtcaaccgcgctggggcttatcgaacaatgcaagcctgcgctggccatcgtcgattccgcgcaaaccatcgtctcgcaggaagtcgatggcatctccggaggctcgactcaggtgcgcgaagtggcgagcgcgctgatcgacaccgccaaaacgcttgatattccggtattgttggtcggtcatgtcaccaaagacgggtcgattgccggcccgcgcacgttggaacatttggttgatgtggtctgccagttcgaaggcgacaccgaaaccgcattgcgtatgctgcgcgcggtgaaaaaccgtttcggccctactgatgaggtcggctgtttcgatatgagcggcgaaggcatcgaagaggtgacggacccgtccggactgtttctttcctcgtccaattccgcagatccctctccggtggagggcacgtgcgtgaccttcacgttggacggtcatcgcagtcttcccatcgaagtgcagtcgctggtcaccaaatccgtactgccaacgccacgacgtgccgcgaacggcgtcgacgccaaccgcatcgccatgctggtggcagtgctatacaggcatggcaacgtcaatcttctggcaaacgatctctatatttccaccatcgccggaggccaggcgcgcgagcccggatgcgatctggcgatcgtcggcgcattggcgagcgccgcgaaatcgaaggcgatcagccgcaccacatgtgcgattggcgaaatttcgttgaccgggcaggtgcgcccggtgccgcgactggaataccggttgcgcgaagccgcccgtcttggcttcaccaccgctgtagtaccgacattacgtagagaaatcgcaattcccggattgtcgatcgttcaggtcgacacattgcaggatgcgcttggcgccatgttgcgatagcacacaccctacataccgttttcgcatgtatgcacgcgaagcatatacattatgttattttttaacctatacaagtggggctcttacgtaaatgcttacgtaagagccccactatttttgaatactgatacgtttttactggaaatatcagcattcattaatcactgtcattatcgtaattattattgcgattagaatcaagcagtaattcgcttggtttcctcgacattgcgcttcagctcgtcgatcagatcctgtgcggaatcgaacttgatttgcggacgcaggaatcctgtaaattccacgcgcacctgatgatcgtacaaatcaagccaatcgtcggtgatggcgtaagcttcgaccacgcgatcgttcattccggtcgcctcgttgaaggtcggcttggtgccgatggaaatcgcagcgggccaacgatacggcgaatgatcggcaaggcgcgcgtccacggaagaggaatcgaactgctgcgaaacaccttcggaagcgtcctgcgcatcatcgtccgccgtcttcgcgcccaagtccacaagccaaccggcgtatacgccgtcgaccggcagatagcctgccacattctcgctcagattcgccgtggggaagccgatggtgcgtccacgttcctcgccatgcaccacggcgccttccacggcatgcggatgtcccagaatcgcgtcggcgtctttgatgcgcccctggcccagcaggtagcgcacattcgtggagctccacacgcgcacggccttcgcctggtttttcttgctccatgcgcgacgttccgccttggacgcgccttccagcggatcggccggctcaccatggtcggtgggcataaccggcttcgcattggctggcacgcgggtttcgcccggtccacgatcgtcgaccacatcaagctggaacacgccggtggcgagcgccagattctcgatggccttcacatcgccggcacggttcgcacccatggccgcatcggatccgagcactagcgcgcgcatgcccagcttgcccaccatttgtccgaggaagaatcggtacgatttcgccgcgaacgccagcgtgtaacgcacgatgagcgtgtaatccacgcccagcttgttgatggcgcgcagacgctcctgcatgctggtgagcgcctgcgcgtcgatcatgcccgccggcggctcctggccaccgttttgcgccgcgtagccgtgcacgagcgctgggcgtggatcgaacagcaccaccacggagaaggactgttccttcttggcgagttccaccacgcggcgaatcaccgcctgatggccctgatgcatgccatcgaacgaaccgatggtcaccacggatttcttatcgttgctcagcgtaggccaatccaccatgccgctggcatcaggcgtgagcgtgattgtcttcatcatgtccttcttgtgtatgaattcgtatctgtagtctgattggatggttcagttgaataccgcgaccggtttagcctcaccgcgtttcgcacgttcgaggatggcgaccaaatcgttggtttcctcaacgtacgccgccgtggtcgtacgtatgtcatgcgcgattctgcgtccgaaacgcaagtcggccgcttcctgatcgctcacggccagcatattcatggaagccgcagcgctggccacgggatcgagcgcatgatcgagcgcatgatctgcatcgtcaagcactgcacgattgcgcgtcacttccatgccttcacgattggtgaatgttttggattcagcgtgggcgctcatgacgttgggcatattcactgaaaatctgccgacacgtgtgcgtcgcagcatcgtcagatggcctcccaacccgagttcctcgcccagatcgcgtgcgagcgcgcgaatgtaggtacctgcggaacaggtcacggtcacgtcgagttccataacgggctgcatatcttcatgcggtgcagtgtcggcaatccatccatctcctgccctctcggccacgactgcgccagcaagttccgtgccggcacgatcgctatgcgtgtagccgtaacgcgcctgccgcacgttgaactcttcgatggtcacaggacgtgccttaagctccacatccttgccttcgcgcgccagatcataggcacgctggccattgaccttaatggcggagtagacgttcggtacctgttcgatgcgcccggtgaaccgttctgtgatcagctgttccacggcttgacgcgaaggaaagttcactgcccgctcccccgccggcaacagctcgccttcggcatcgtccgtagtggtgcgctgtccaaggcgaatggtggcctcgtacgttttgttatggtcgacaatgtagttgagcagtcgcgtggcattgccgaaacccaccaccagcacgccggtggccatcgggtcgagcgtgccagcatggccgacacgcttcatatgcagggcgccgcgcacggccgcgaccacgtcatggctggtgaccccctgcggcttgtcgatgaccagcaggccggaatgttcaggcttcttcgtcatcatcccaatcttcgacttcgacgtcatcatcgtcgaaatcatcgtcgtcatcctcttccggatgcttgtacggatcggcttcgcccgcatactgggcggtttcacgagccttggcgagttcttcgtcacgcttgcgcgcgatggcgagaatgtcttcgatctcatgtgcctcgcccggcacctcgtcgaatacgaattcgagctgcggggtcaaacgcagaccggccttggtgcccacgagggaacgcagacgacccttggcttggttcagtgcctgctgtgcacggcggcgttcgccctgctcatggccttcacggccaagctgggtccaatagactttggcgatctgcagatcgttggtcacacgcacttcggtgatggtcacgtttgtgagacgcttatcgtgcaattgcgcctccatggaggatgcgatcacacgttggatcaacgccgcgatgcgtgcggcgcgaggattggttcctgccattgttgtcctttaatcaggtaagttctgttgtattacggaacgcccgcagccgtatgtcagctgtgggcgttcctttcttgttatcgattgctggttcgaatcaatcgactacttgcgttcgatttcctgcatttcgaaggtctcgatgatatcgccaagctcgatgtcgttgaacgaaccgaggttgatacccgcttcgtagccttccttgacggagttgacatcgtccttgaagcgacgcagcgaggagatttcgagatcattgacggtggcgatgccgttgcgcagaatacggcacttcgtaccgcgcttgacttcgccgtcctgcaccataacacctgcgatattgccgaacttggaagaacggaagatctcgcggatctcggagtgggacgtgacgacctcttcgaattccggcttgagcatgcccttgagggatgcttcgatgtcttcgatggccttgtagatgatcgagtagtacttgatttccacgccttcgcgttcggccatatccgccacctgacggttcggacgaacgttgaagccgatgatgacggccttgtcgacggtagccaagttgacatcgttctgggtgatggcaccgacaccgcggtggatcacctggatgccgacctcgtcagacacctcgatcttcatcaaggaatcttccagcgcctcgacggaaccggaggaatcgcccttgatgacgatgttgagcatgtcgacctcagccttggcgaactgctccttgaggctttcgagcgacacgaccttacgacgcttggccagctgggccgcacgctcggtggcctgacgcttttcggcgatctgacgtgcggtacggtcatcggaggccaccaggaacagatcgcctgctgtcggtacggaggtcaaaccaagcacctgcaccggagtggacggcgtggcttccttcatatgggtgccgttttcgtcgagcatggcgcggacacggccatacgacgttcccgcgacgatggaatcgccgatgtgcagagtaccggactgaacgagcacggttgccacggcaccgcgacccttgtcgagtcgggcttccacggtggcaccgcgagcgtccatatccgggttggcacgcagatcaagttcggcgtccgcggtcagcagcacggcttccagcagcttgtcgacattggtgccctgcttggcggaaatgtcgacgaacatggtgttgccaccgtactcttccggaacgaggccgtactcggtgagctggccacggaccttgtctgggttcgcgcccggcttatcaatcttgttgacggccaccacgatcggcacgttggccgcctgagcgtggttgatggcttccacggtctgcggcatcacgccgtcatcggccgcgaccacaaggatcgcaacgtcggtgagttcggcgccacgggcacgcatggcggtgaaggcttcgtggcctggggtatcgaggaacgtgatcttacgcggttcgccttcgagatcgacggtcacctggtatgcaccgatacgctgggtaatgccgccggcctcacgtgcgatgacgttggtacgacggatggtgtcaagcagtcgggtcttaccatgatcgacatggcccatcacggtgacgaccggcggacgcggcttcagatcttcatcttcctgaagttcttcttcgtccagatcgatgtcgaactgctgcagcagttccttgtcttcctcttcggcggacacgatcttgatgtcccagccgatttcctcaccgaggatctggaaggtggattcgtccaaggactgggttgccgtagccatctcaccaaggtggaacagtacggtgaccagtgccgccggattgacgttgatcttctcggccagatcggcaagggatgcgccctgacgcagacgaacggtctgaccgttgccggtaggaatacgcacgccgccgatgaccggggccttcatctcctggaattcctgacgctttgccagacggttcttacgagccttcgaggacttgccgccctgacgaccgaacgcgcctgcggcaccgccacgaccgcgaccgccgccgcgtgccggaccgttgctcggagcgctgttgccgccctggaagccgccaccattggtattggcgccgccaccgaaacggttgccaccacctgccggacgctgaccgccaccctgacccggacgatgctggccccactgacccggcttcgcaccggtgccttggcccggacgaccacggaagcctccacgctggccgccgccctgacccgggcgtccgccgcgacgaccttcgccgttgttattgttgttggcgttcggacggttcatcggatgcggacgcggaatgtcacccggagtcggggtatgcatgccctgcttgcggctgaacggattgttacccggacgtgggcccggagtgtgcggcttcgcaccattggcggcattgttgccattgccgccctgcggagcattggtattgttattgttgcgctgtgcgcgaggtcccggaaccggagccggcttgccgccctgacggcgttcgccctgcggacgcggagcgttgccgttggcacgattgccatgctggcgggaatcacccggacgaggcatgcgctggccgggcttcggggcttcggacttggacgctgcaggacgtgccggctttggagcggcaggctttgccgcggatgccgcgggagcagccggagtggcacgaggcgcaggagtaggcgaagctgccggggcagccggcttcttggccgggaccgcaggcttcttggattcggatgcgttgccctgcgcgttggaagcgaaagcattcctcagcttacgggcaaccggaggttcaacggtagacgatgcggacttcacaaattcgcccatcgcctcaagtttgttcaaaacagtcttgctgtcaacgccaaattccttggcaagttcatatacgcgtgctttcggcactcaatttctcctatcttgggccgcgcgcatacgagcgcgaccgctactgattcacggcgagcttgttccttctcatcgtgcaaccatgttcgtgatacctcgtcttttccctgggcatgacggcacgtacccccacgctttggattatcgagtccagcatactcaagcccgtggattgaacgcccacgggcttaccgctgctgaaagtgttggttattcggcggtttccccgctggtcgaagcctgcgcttcggccatcttcttggcgtgtgcctcggcggattcgatgccgatcttccatccggtcagcttggcggccaaacgtgcgttctggccttccttgccgatggccagcgacagctgatcatcatgaatgaaggcgattgcggtctggttcttctcgctgattacctgcacaccggtggcgaccgccggagacagtgccgccgcgacgaacttcgccggatcggcagaccagtcgacgatatcgatcttctccggcccaaggttctccatcaccgcacgcacgcgagcaccgccggggccgatcagagcgcccttcggattgacgccctcggtgttggcgcgcaccgcgatcttggtacgggcaccggcctcacgcgcgatggccatgatcgagacggcaccggaaaccagttccggaacctcacgttcgaacagacggcgaaccagctcgggatgggagcgggacaccacgatttccgggcctttgaggccacgtgcgacattcaccacatacacgcggatgcgctcaccatggcggtaacgctctcccggcacctgttcacgacgcggcagcaacgcttcgacgtcgccaacggccacgtgcacattggaggtgtccttcacatcctgctgcacaatgccggtgatcagcttgcccttctgcccggagaacgcgccgaacaccttgtcgtcctcggccttgcggaacagctggctgatgacctgacgcgcggtggcggcggccagacggccgaagtcgcgcggggtgtcatcatattcctcgcccagagtcggcgcagggtgcggattatcctcggtcggctcgacggggatctcatcctgagcccaaacggtaaagcttccggcacgcggatcaagctccacacgagcatgcttcgccgcgtgcggcgttttcagatatgccagtcgcaatgcttccgagagtgcggcatccagcgtctcgggatcgattccctgcccagctgcgagctggtgcattcctgccaggtccagttccatacttccaagacctcctatatgaagttattccgagcgctcggcccaatggtcacagtcgactactagtctaatgtttcatgcagacacgctccccgtttttccccttggccttgtcgactgtcagacgcgcctgcgtcttggtgtgcgcgagcgcccttgtggcatcactggccgcgtgttccgctcctcgaatcgcaggtcgcgccgaagccgaacagcagccaagtccttgcgaaagggcgtatgcagacgcgactgccaacgccgacatcatggcagacaggtcacgccatatcgtcatgcgctatcttgccgcgcaggaggcggtttcagattgggccaacaccgcggcatattgcccggcgcgattcgccgatggcacgttgcgcagcgcgcaggcccgtcacgccgtcagattgatggcctcacggcttgcgattgacatcgcacagcccacgctgtcacgatgcgatggcattgactcgcttgatgtcgatacggattcgcttgcagccatggctgctgcggaagatcaggtggggttcgcgatggaggtgttcgccgcgcgttccttcggtcatgcgacgcttgacatcagcgatcgtcataaaaccacttcgcaacgcctgatttctctttccggagccgaagacaatcgtgcgaaaacctatgatgtcacgcagctgctcgccaatcctaataccatcgtggattccgcaacgggcttgtacgcgccaaccgatgccgtcctggaaatgaattgcgcgcgcagcgaaatcgcagccgttgcggcaagctcgacttcgtcgaacgcctcgacgaagtcccaaacaacctcggacgaccattcggatgactcccgggaacagtcactgggcatgctcgccagcatgatcgccgaccgcgtggatctggcactcgactggggttatccggcattcgacgaagcgctattcgcatagcgcagacttgcgtacgctgtccgcgcaaccgtcttcacacaatgcgacgcagtgttcccgcgaataagacacgccgagcaatcgcagacatcgcaaaaaatccctcaatcggatttgacaatcgccaaagctgtggcaaaatgatgaagttgcttgttttcaagtagcacaatggataagtgtccgagcggtctaaggagcacgcctcgaaagcgtgtgagggcgaacccctccgcgagttcgaatctcgccttatccgcaagtagaaaaaccggagcaacggcgcttcggttttttattgcttacagccctgtggcacgtaggagcacataggagccaaggttattgctttagacgatctgcaacttttatgccttcattcatcgtcgcacacttcttctacccctgaaaatgcatgcctgtcttaaggccgctcaatcctcgatagaagacgtactggcgttcgattaccctaaaatgcaacgaattattacaattgcgtctcgatcacggactcgtgagaacgacgtaacgtcgtcatggcatttcgcatgattcgcgtgttcttttcgaactatatcccgtttttccgtttttgcgattgcgtgatgtggttttgtgatgcgatatttggtgcgattgtatagcgcaatcttctgtgtatccgtacagtatgtgctcttacaaagtacgtttcgcacgaatcgcttcggcacgaatcgccaactggtcgtcttccggatattcgatatgttccagcgtcaatccttgcggagcgatcggaccagtgctgccttcacgcaacggcgtcgtcattttttcggcgaaccaatccacggaacgtttgccgatgcctacctgcacacaaccattaaccagcgatcgcaccatattgcgtgcgaaagcgtccgcaacgatggtgaagcacagcagtccggattcgaccgcaggcgtgcgatatcgctcccccatcgtatttccgtcgtcgatcagcggatgctgcggtatacgacgccaatacgcggttttcacctcgcgtatggtggtgcctccaggattcggggttgcgaacgagccgaaatcatgcaggccgatagtcatttcagcagccttgttcatagcttcgatgttgagatcatcgtcgatatgcagcacgcaattgcggatacgtggatcgatttcgcttgatcggtcggcaatgcgatatacgtaagtgcgttccagtgcggagaaacgtgcgtcgaatccttcgggagcttcctcgatggaacgaatggcgatgtcattcggcagcatgcgttgcagccgtcgcttcaacgccatcaccggttcgacctgcatatgcccgacgcaacgtgcaagcgtctcctcattgatgtcgagatggcaaacttggtgcgacgcatgcacgccggtatcggtacgacccgcgacggtcaggcgcagcggctcgtcatcatcgccttccggtacacgaagaacggtatgcagcactcgttcgatttctccctgcacggtacgcatgtcaggctgtttcgcccatccgtagaaatcggtgccgtcatatgccaagtcgatacgtaatctcacggcaatgagcataacaaaaggcgcataacaacatatgacaacgcataacaaaaaggctgggaacctttcgattcccagccttttcatcagctagtcaagcctgcttgatgccaatcactcggcgttctctgcggtggcttcctgagcctcaaccggtgcctcttcgacaaccggagcttcttcagcggcaaccttggttgcggcttcggcttccttgaccacggcctgcttcgggctcaccggctcggtgacgagctcgatgatggctgccggagcggcatcgccacgacgcggagcaatcttgacgatgcgggtgtagccaccctcacgctgctccatctgctcggcaatctcggtgaacagcttgtgcacgacggacttgttgcggatgacacgcatcacgcgacgacggctgtgcagatcaccacgcttggcgagcgtgatcagacgctcagccagcggacgaaggcgcttggccttcggcagggtggtggtgatgcggccacgctggaacaggctggtagccatgttcgcgagcataagacgctcatgagccgggctggaggccagacgcggacccttctttggtgtaggcattgtttctccttgaaagccccgtcggactcaggtgggcagttgcccgaacatccgaatccgacgaagcggttaggtcaaaagcggcgaatcactcgtcttccggcgagaagaaagtgccgccttcgaggttgttggtatcgaagttgcccagcggggaagccttgagggccagacccaaggactggagcttttccttgacttcgtcaatggacttcataccgaaattgcggatgtcgagcagatcctgctcggtgtgggcgaccagctcgccgatcgtgtggatgccctcgcgcttcaggcagttgtagctgcgctgggtgaggttgagatcctcgatcggaacggccatctccgggttggtttcctctgccaccggggcaggtccaacctcgacgccctcagcctgggtgttgagctcgcggcacaggccgaagagttccaccaaggtggagcctgcggatgcgacagcatcacgcggggagattgccggcttggtctccacgtccaggatgagcttgtcgaagtcagtgcgctgttcaacgcgagtggcttccacgcgatagctcaccttgagcaccggggagtaaatcgagtcgaccgggatacggccgatctcggcgttatcctgcttgttcatctgggctggcacataaccgcggccacgctcgacggtgaactcgatctcgagttcgccatcttcagcgagagttgcgatatgcatatccgggttggcgatagtgacgccggccggcggagtgatatcacccgcggtggcctcgcccttgccgctcttgcgcagatacatgacaaccggctcatcgtattcgctggtgagcacgatgcccttgatgttcaacaggatctcagtaacgtcctcttcaacacccggcagagtggtgaactcatgcgggacgccggagatacgcaccgaagtcacagccgctccagggatggagctcaggagggtacggcgcagcgagttgccaagcgtgtagccgaaaccaggctcgagaggctcgatggtaaagcgggaacgctgagggttgagagattcctcggtaagtgtcggacgctgtgcgataagcactgtggttatcctttcagcttcaggccggtggtgcactcaccggccataagcggcgttggattgatgatttcttctagtgctcagacgcgacggcgcttcggaggacgaacgccgttgtgtgcctgcggggtgacgtcggtgatggaaccgacttcgagtccggcggactgcaaggaacggatagcggtttcacgaccggaacccgggcccttcacgaacacgtcgaccttcttcagaccgtgctccatagccttgcgggctgcggattcagcggccataccagcggcgtacggcgtggacttacgggagcccttgaaaccgacatcgccaccggacgcccaggacacaactgcgccggacgggtcggtgatcgaaataatagtgttgttgaaagtggacttgatgtgcgcctgcccaaccgggaccgacttgcggtcgcggcgacgcggcttgcgcgcggcttgcttttgagctgccattgaccctcgtttcctaataacgaatttgctttgttgttcaggcgatgaaacttacgtctcgtggtctgaactgacagccacctattacttggtggccttcttctttccggcgaccgtgcgcttcgggcccttgcgggtacgagcattggtcttggtgcgctgaccgcgcacaggaagtcccttacggtgacgctggccttggtagcagttgatctgaatcttacgacggatatccgcatcgatttcacgacgcagatcgccctcgatcttgtagttaccctcgaggtagtcacgcagcgtgatcagctgctcatccgtcagatccttgacgcgaatgtccgggttgataccggtcgcggcaagcgtttccttggcacgagtgcgacccacaccaaagatgtaggtgagggcgatctcgatgcgcttctcattggggatgtcgactccggcaagacgtgccattgcgattccttctgttttccgcaggtcttgcaccgagtcgtccggtttcccggcccgggcctgcgtacccggggttcataccgcttgcgcgatctgtgactcagcgcctgtacttattatgccgctggatctgctctcagccctgacgctgcttgtggcgcgggttgacgcaaatcaccatgacgcggccgtgacgacggatcacgcggcagttctcgcagatcctcttcacactagggctgaccttcatggttttcctttgcttgtgtaccttacttgtaacggtacgtaatacggccgcggttcagatcataagggctcatttccagcacaacacgatcctgcggcagaatgcgaatatagttcttcctcatcttgcccgagatggttgcgagcacgatatgcttgttctcgagttcaacgcggaacatcgcgttcggcagtgcttccactacctgtccttcgacttcaatcacaccgtctttagccatgagcctcgttccgttctttggcgattactatgcgtgcccgaagacacaccaacttgcaagaatacacgaaaacgggaactacggcacgttcggcgtgtcgcaattcccgttttcgattgatttgtggtattttattgggctttcttatcgttgcatacgatttgaatttgcccgattttcagctatatcagccaagctcagccacgatggtggcctggatctcttcgacggagccgacgccgttgaaggtcttcagcagcccgcgctcttcataggtggccagcaacggagcggtttccttggcatacacatcaagacgcttggcgatggcttccggagtgtcgtcggaacggccttcgatctcggcacgcttcttcatgcgctccataagcacgtcatggtcagcgtcgagagccaccacagcgtccagaggagtgttcagatcggcgaggatggcgtccagtgcctcaacctgggatgcgttgcgcggatagccgtcgaggatccaaccgttcttggcatcatccatggccagacgatccttgacgatcttgttggtcagctcgtccggaaccagttcgcccttgtcgatgtacttcagtgcctcaacaccgagctcggtcttgttcttgatgttgtagcggaagatatcgccggtggagattgccggaataccgtagtgctcgctcagcagcgcagcctgggtgcccttgccgacgccctgcggtcccataatcagcagtcgcatgttattctccgtttcattgagcctcttgcgaggctttctgattctcgattggttacatgaaaatcgtgataccgcttcacgtcgaaacggtatcacgattttgaggttttacttgccttccttgtggtcagtaccctcgaacaggaatccagcgtactggaactgttcggtctgggccttggcctggcgcagggtgtcaaggccgacgcctgcgatgatcaggatggtggtgccgccgaacggcaacttggtgttgaggtcaagcgccatgatgagcacggtcggaataagcgccacgaatagtaggtacacggcaccgacggtgttgagcctgttcatcacgtagctcagataacggctggtggcgctgcctgcgcggatgccaggaatgaagccgccgtactgcttcatgttgtccgcggtttcgtccgggttgaaggtgatttccgtgtagaagaagcagaagaacacgatcatcaacgcgtacagtgcgatgtaccacacggaagtggtgttggccaagttggagttgatccacttgacccaggactggtcggatttgccgaactgtgcgatcagggtcgggatggccagaatggaggacgcgaaaatcggtggaataacgccgctcatattgatcttcagcggcaggtaggtggaggatccgccgtacatcttacggccaatcatacgacgggtgtactgcaccggaatacgacgctgggaaagctcgacgtagatgacgaggatcatgatgaccagcagcacaccgacgaccgcggcaaacttcgcccaattgccatcggtgcctttggtgccccaaccgatctcccaaagctgcggtaggaagccggagcagatggacatgaagataaggatggacataccctgaccaagacccttatcggtgatcaattcggccatccacatgatgaggccggtgccgccagtcatgatgagcaccatgaccacgaggttccagacggaaccgtcaggcacaacctgggagcaccggtagttgaacagggcgccggagcgggcggtcaccagaatggtggtggactgcagcacagcgaggccgatggtcaggtaacgggtgtactgggtcagtttggcttcgccggactggccttccttgtgcagcgcctcgaagcggggaatcaccacacgcagcagctggatgacgatggatgccgtgatgtacggcataacgcccagtgcgaagatcgatagctgcaacattgcgccgccggagaagaggttcaccagaccaatgaagttttcggaggtgctatccatcgaaccgaggcactgctgaacgaccttatagtcgacgcctggggtcggaatgaacgaaccaatacgataaatgatgatgataccaagagtgaagaggatcttgttcctcaactccttggttttcaaggcctggattaacgtcctcacctgggattccttccatcgacgtgcgcgcctgcgcacccatgcaaaacagactctaccgatcgagtctagcgtacggcgtctacctacacgtggagtgttccatcctttgtcggttttttacaagatttcgaggcattgttttcgttttgttccccgtactggaccaaaacgaagtgaggcctcccccgtctaagcgggagaagcctcacttgcaagcttcagtcagctctacattccttggaatcagtcctcggagatggagccgccggcagcctcgatcttggacttggcggaagcggaagccttaacacccttgatggtgtaggctgccgaaacctcgccgtcgcccaggaccttgaccgggtagccgtcacgcacggcacccttggcgaccagatcggcaacggtgatttcgccaccctgcgggaacagttccgcgagagcagcaacgttgacgacctgatattccttcttgaacgggctcttgaagccacgcagcttcggaaggcgcatgtacagcggcagctggccaccttcgaagcccggacgaacctggtaacgcttcttggtgcccttgtcgccacggcccgaggtcttacccttggagccttcaccacggccgacgcgagtgcgatccttcttggcgcccggagccggcttcaggtcatgcatctgcagaatatctgccataatcagtcagcctcctcaacggtgaccaggtgacggaggaccagcagctggccacggagggccggcgtgtcttcacgggtcacggtcttgccaatcttgttcaggcccagagtccgagccgcagcacgctgcttcggagtggagttcaccagaccgtggtgcagcttgatgttcaggttagtcatcactcaccgtccttctgagcggccttggcctgtgcttcttcacgggccttacgagcctcggcgatgccttcggcgcgagcacgcagcagggagtcaggagccacctcttcgagggacatgccacgacgggctgcgatctcttccggctcttcgagcttcttgagagcgtcgacggttgcgcgcaccacgttaacggcggtggcggagcccatcgacttggtcaggacgtcggtgatgccagcgcattccatgacggcgcggaccgcaccgccggcgataacgccggtacccggagcagccggacgcaggagcacggtgccagcagcatcatggccgatcaccgggtgagtgacggtgcccttgatgcgcggaacggtgaacatgtgcttcttggcatccagctggcccttagcgattgcagccgggacctcacgggacttgccgtagccgacacccacggtgccgttgccgtcgccaaccaccacgagggcagcgaagctgaacgtacgaccacccttgtgggtcttggacacacggttgatggtcaccacgcgatcgagcatctcgttctcgtgagattcctcacgacggttgcgacgctcgccacgacgaccctcaccacgctggccacgacgggacttgcgatcctcgttggtagcttcagcagcagcctgagtgttctgagtttcttcagccacttgggtttccttttcgttgtcgctcacagtgccagacctccctcgcgggcgccttcagcgacagctgcgacgcggccatgatacttgttgccgccacgatcgaacacaaccgcggtgatgcctgcgtcctgagccttcttggcaatcagttcgccgaccttcttggcagcttcggtcttggtgccttcgaaacctgcgaaatcgctcatcagagtggattcgctcaccaaggtaatgcccttggtgtcatcgatgatctgggcaaccatgtgacggttggaacgggtaaccaccagacgcgggagctccggggtaccgctgatgcgcttgcgcagacgagcgtgacggcgctgaagcgcgaccttcttgcccttaccgaaaatctggacgctcattacttaccagcctttccagccttgcgcaggatgcgttcatccgagtacttgatgcccttgcccttgtagggttccggagcgcgaagcttgcggatgttagcggcgcactggccgacagcctgcttgtcgatacccttgacgatcacctggttcggattcggcagttcgaactcgataccttccggcggctcaacggtaatggtgtgggagtaaccgagggagaactcgatacccttgcccttcgcctgagcacggtaaccggtgccgatgatgtccagagtcttggcgtaaccctcgtgcacgcccttgaccatgctcgccacgatggaacgagccaggccgtgctttgcacgggtcggacgcagatcgtcagccggaacgaggatgatctcgttgccttcgacctgagcggtgatgccttccggaatctcgtaggagtcagtgcccttggcgcccttggcggtgaaggactgaccgtcgatcttgacttccacgccagcaggaatggtgacggggagcttaccaatatgcgatgccatgtttcagctctcctttctcaccaaacgaaagcgacgatttcgccgccgatgcctcgatcgaggcattccttctgggtcagcagtcccgagctagtcgagatgattgcgatgccaaggccaccgagcggcatcggcagagcatcggactttgcgtagcgacgcaggcccggcttggagatgcgcttgatgccctggatggaacgctcgccgttcggaccgtacttgagggtgacctcgagagtctggccgaccttggcttccttggcggtgaagtccttgatgtagccttcacgcttcaggatctcggcgatgttcgccttgaacttggagtacggcatatccacggtctcgtgctttgccgcgctcgcattacgcagacgcgtaagcatgtctgcgatcggatctgtcattgtcatttgggcttattgccctttctcgccgtggtttccgccgcccgcacgctccattgagcgattgggccgcggaccttcagcgtcgttatttaccaactggacttcgtaacgccgggcagctcgccgcggtgggccttctcacgaaggcagatgcggcaaaggccgaacttgcggtagacggagtgaggacgaccgcagacctggcaacgcgtataagcgcgcaccttgaacttcggcttagcggccgccttgttcttaagagcggtttttgccatatcagttctccttgaaggggaagccgaggtgcttcaggagcacgcgagcttccttgtcgtccttggtgctggtcaccacggtgatgtccataccgcgctggtgatcgatcgaatccggatcgatctcgtggaacatggactgctcagtgaggccaaagttgtagttgccctgaccgtcgaactggttgccgttgatgccacggaaatcgcggatacgcggcagagccatggtcagaaggcgatccaggaactcccacatacgctcgccacgcagggtgacgtaagcgccgatggcctgtccttcgcgcaggtggaactgtgcgacggacttcttagccttagtgatcttcggcttctggccggtgatcagggtgaggtccttgactgcgccttcgataagcttggagtcgcgagcagcggcgccaacgcccatggagacgacgaccttctggacgcgagcgacctgcatcgggttggagtagtggaattccttctccagctccggcacgatctgctcgttgtacttctgcttcaagcgcggagttgccggcgcttcgacagtggtatcggtcatgccagctcctttccggacttcttggcaacacgcacacgcacggtcttcaccttgccgtcgcgagcctcttccttttcgacgatgcgcacgcgggtcggctgcttggtctccggatcgatgaccatcacgttggagcgatggatcggagcctcgacagccacgatgccggcctgctggccctgctgcgtagcgcgaacgtgcttcttgacgatctgcacgccttcaacgatcagacgatcgtccttgagcacctgcttgacggtgccctccttgccgcgatccttgccgcgaatgaccttgaccaggtcgccgctcttaatcttggctgccatgtcagatcacctccggggcgagggacacgatcttcatgaagcgcttgtcgcgcagttcacgaccgaccggtccgaagatacgagtgcccttcggttcacggccagagccgagaatgacggcggcgttctcgtcgaacttgatgtaggagccgtccacacgacggtgctccttgacagtgcggacgacgacagccttgacgacgtcgcccttcttgaccgacccgccagggatggcgtccttgacggaggcgacgatcacgtcgccgatgccggcatagcgtcgcttcgatccgccgagcactcggatggcgaggagttccttcgcacccgtgttgtcggcgacatgaagccgcgtttcctgctgaatcattgattctccttagccgagctggttctccccaagcaccccgcctgcctgcttgaagcaggcggggtgactcacggagccttgccgaacttatttacttagcgcgctcgatgatggtatcgagacgccaacgcttggtcttgctcaggggccgagtctccataatactcacgaggtcgccaatgtgagcctcgttgtgttcatcatggaccttgaccgtacgagtggaacgcacgaccttgccgtacagcgggtgggtcgaacgctgctcgagctcgacggaaatcgtcttgtccatcttatcggacacgacgtaaccgcgacgaaccttgcggaagttacgctcttcagccattacttctcctcagctttcgtttcggtcgcctcgggggcctggctgatgccgagctcacgctcgcgcaggacggtgtacatcctggcgatgtcgtgcttgaccgccttgaggcgggcggtattttcgagctgaccggtcgcggactggaagcgcaggttgaacagctcttccttggacttcttgaggaagccctcgatctcctcgttggtcttctcgttcagattcttcatggtgtagtctgcagttccgactgccatcagatgtcaccgccttcacgagcaataacacggcacttcatagggagcttgtcgattgcgcggcgcagagcctcgcgagcgacatcctcggacacgccaccgatctcgaacatgacgcgacccgggtggacgttagcgatccagaattccggagtacccttaccggaacccattcgggtgccgagcggcttcttggtcagcggacgatccgggaagatcgtgatccacacgcggccaccacgcttgatgtagcgggtcatggcgatacgagcggcctcgatctgacggttggtcacataagctggagcaagagcctgaataccgaaatcgccgaatgcgatctcgttgccgcccttggacataccacggcggaccggacggtgctgcttacgatacttggttctctttgggataagcatttctcagctcactccttcgtttccgttgcggcaggtgcctcagctgcggccggagcctctgctgctgcgttctgctgctgggcagcgttacgctgaccacggcgcggacggcgatcgccgcgacgtccctggcggttgttgccctgctgtgcctgctgctcttcgaactcacgctcggtcatatcgcccttgtagatccagaccttcacgccgatgcggccgtaagtggtcttggcctcgaagaagccgtaatcgatgagggcacgcagggtctgcagcggaacgcgaccctcgcgatagaactcggaacggctcatttcggcgccaccaaggcggccggagagcttgatacggatacccttggcgcctgcacgcatggcatcctgctgggccttacgcatcgcgcgacggaaggtcacgcggttggtcagctgctcagcgatgccctgtgcgacgagctgggcgtccagtgctgcgttcttcacttcgaagatgttgagctggacctgcttgccggtgagcttctcgagcttggcgcgaacgcgctcagcttcggcgccacggcggccgatgacgatgcccgggcgagcggtgtggatatccacacgcacgcggtcgcgggtacgctcgatgacgatacgggacacgcccgcacgctcaagatccttgctcatggccttgcggatggcgtcatcttcgagaacgaagtcgcggtagcgttcgccaaccttgttggaatcggagaaccacttggaacgatggttctcagtgattcccaggcggtagccaaacggattgatcttctgacccatctttagcggtttccttccttgttagcgacgacgaccgtgatgtggctggtgcgcttgttgatacgagcggcacggccctgtgcacgagcgcggaaacgcttgagcgtcacgccttcgtccacataggtctccttcacgaccaggtcgttctcacggaacggctcgccggccttgtcggccttcacgcgagcgttcgcgatggcgctctccaggaccttacgcaccggaagggatgcgtcctgcggagcgaacttcagaatggtgatggcttcggtcgccttcttgcctcggatgaggtcgaccatacggcgagccttgcgcggcgtcacgcggacgtgacgagcgattgctttagcttccatgtgtccttactctcctttagcggcgtgccttcttgtcgtccttcacatgacccttgaaggtcttggtcggggcgaactcaccgagcttgtggccaaccatggattcggtgacgaacaccggaacatgcttgcgaccatcgtgaacggcgaaggtgtgtccgatgaaatcaggggtgatcatcgaacgacgggaccacgtcttgatgacgttgtgcgtacccttctcgttctgctcgtcgactttcttctgcaggtgggcgtcgacgaaggggcccttcttgatgctacgagtcatctactcgacactcccttacttacggttcttaccattcgggcgacgacgaacaatcatcttgttcgaagccttcttcggacggcgggtacgaacctcgcccttgccccacggagaaaccggcggcttgccaccgcgggtacgaccgccgtgcgggtgatcgacagggttcatggattcaccacgggtgatcggacgcttgcccatccaacgtgcacgacctgccttaccgagctggatgttggcgtgatcggagttgccgacctcaccgatggttgcgcggcagcgagcatccacgttgcggatttctccggacggcatacgcagctgggcgtaagcgccatccttagcgacgagctgcacggctgcaccagcggagcgggcgatcttggcgccacccagcgggcggagctcgattgcgtgcaccacggtaccagtcgggatgttgcgcagcggcaggttgttgcccggcttgatatcagcctgggcgccggtctcgatgacgtcaccctgcttgataccttccggagcgatgatgtagcgcttctcaccgtctgcgtagtgcagcagtgcgatgcgggcggaacggttcgggtcgtactcgatgtgagcgaccgttgccggcacgccgtccttgtcccaacgcttgaagtcgatgagacggtactggcgcttgtgaccgccgccacgatgacgggaggtcatacggccgtaagagttacgaccgccagtcttgctgagtttgcgaaccagcgacttctcaggcgtagaacgcgtaagctcggagaagtccgagacggacgcgttacggcggcctgcagtcgtcggcttataaacgcggatagccataatctagttcttcctttaacttttctcggctagccttcagttaccgaagatgtcgatcgtctggccctcggcgacggtcacgatagcgcgcttctgattgacgcgctggccgaaaccgttgcgggtgcgctgacgcttgccggcgcggttgagggtgttgacgttcgtcaccttgacattgaagatctcttcgattgcctgcttgatctggaccttgttcgcgttcggggccaccacgaaggtgtactgaccgcgatcggacagagcgtagctcttctcagaaacgacaggcttgaggatgatgtcgtgtgcgggcttgtgaatagcgaccatgaaaatcaggcctcctttgcagccggctcagccttcgcagcaaggaaagcgtcgaagccttccttggagaagaccacgtactgagcggtgaccacatcgtacgtgttgagctgatcggcgaagatcgggtgaacggtcgggatgttacgaacggaaagccattcgttcacattctcgcgagagagcaccacggtggtgaacttgttctcggtcaccggggtaagagcggcaacagcggccttggtggacggggcttcggaaacgccgaagtccacgactgccacgcgacctgcgttggcgcgatcggaaagcacgtacttgagagcagcggccttcatcttcttcggggtgcgctgggagtagtcacgcggctgcggaccgaacacggtgccaccgtggtaccactgcggtgcacgaatggagccctgacgagcacgaccggtgcccttctgcttccacggcttgcggccaccgccggaaaccataccgcgagtcttggtggcatgagtgccctgacgagcagcggcgcgctgggccaccacaacctggtggatcagcgggatacgggactggacttcttcggcggagaagccgaagatctcagccggagcctcaacggttccggttgcattgccctggttatcggtaacgttcagagtaacgtttgccatgatttatcaggctcccttcactgccgaacggacgagaacgatgctgcccttcgggcccgggatggcgcccttgatggcgagcacgccgttctcaacatccgacgaaacgatggtgaggttcagcgtggtgttggttacatgacccatgcggccagccatacgcttgcccttgaggatacggctcggggtagcgcatgcgccaacagagccaggacgacgctcgttcttgtgagagccgtgggtacgacgataggacttgaagccccagcgcttgatggtgcctgcgaagcccttgcccttggtggtaccggtcacatcgaccagggtgccctccgggaacagctcagcggtcagctcctgacccggctcgaactcttcggcgttatcggtgcggacctcagcgaggtgacgacgcggggtgacgccagccttggcgaagtggccggcaagcggcttagtcaccttggtcgggtcaacctggccgtagccaagctgaacagccttgtagccgtcggactcttcggacttgacagcagtcaccacgttggtggagacgtcaacgagggtcacaggaacgaagaaaccgttctcgtcccagacctgagacatgccgagcttcttgcccagcagtgcggtgcgattagacataatggttccctcctcccttacagcttgatctcgatgttcacatctgcgggcagatcaatgtgcataagggaatccacggccttcggggtcgggtccacaatgtcgatgagacgcttatgagtacgcatctcgaaatgctcgcgagaatccttgtacttgtgaggagaacggataacgacgaacacgttcttctcggtcgggagcggaaccgggccaaccacagttgcgcccgcgttcgtcaccgtttcgacgatcttcttcgccgattggtcgatgacctcatggtcataggacttaagcctgatgcggattttctgtcccgccattgccttccgccctttctagcgattcgttagttactgtttaccagcctgcttctcaaagggcaccggcgcagaagacccccgaaaccgtggaagttccgtggtcataccacatcagtgcgcagccatgcagttttcactctcgtgatcactgtgccacgctcgcttttttaattccaatttgcgagccctaaaatcaggcaacttctttatttaagcatcaggggtagtcttaagaaatcctcgcgtgtcgcggtctcaagtcctgttttcaagtccctgaaaacgaatgagatgcacattgccgatcgtctgttgcgatcataatgcagcatcatccgaaaatgcttttccacatataaaaaacgaggaatccggttgaacgaatccaaccaaattcctcgttatctatgatgcttgccgatataacgcaagcaccttatatataggtcactgctgatggcctatacatgaagcgactcatgcacgctcggaagcttcttccgtggcggcctcgccctgacgctggacgcgcagcttgtgtccttcggcctggctgacgccgtagtatgcggcgatggcgatgtccttcatatcctcgatctgcgggatacgcggatttgccggagcgcactgatcctcataggcacgcatgccgatctgatcgaggatggaccagaagtagtcctcgtccacaccgcactcctggaagctcttgttcatgccgagcttgttgtcacggtagtcctcgacggccttggccaggttctcaacgccctcttccggagtcttgcccgggttcacgccaaggttcttggcgatctcctggtaacgttccggagcgatgtacttgttgtacttcggccagctggtcggttcctccggaatggagccgttgtagcggatgacgtacggcagcaggatggagttggtacgaccatgggcaacgtggcacagagcaccgatggtgtgggccatgccgtggcacatgccgaggaatgcggagccgaatgccatgccggccatggtggcggcgttgtgcatcttctcctgggccttgatcttgtcttcacccggctcgccgttgacggactcggcgaggttgtcccaaatcaacttggccgcgtgcaacgccatgccatcggtgaaatcgttggcatagacggagacgtaagcctcgaaggagtgggtcagggcgtcgaagccagcatcggatgcgagcttgcgcggctgggtacgcgccagcaccggatcgacgatggcgacggacggggtcagcgcgtaatcggtgatcgggtacttgtagccggtcttgtgatcagtgatcacagcgaacggcgtgacttcggaaccggtgccggaagaggtcgggatgcacacgagcttggccttcttgcccagcggcgggatcttgaaggcgcgcttacggatatcgaagaacttctcacgcacgtcggagaaggagatttccgggtgctcgtacagcagccacatgatcttggaggcgtccatcggggaaccaccgccgacggcgatgatggtgtccggctcgaactcctcacgcatcatggtggcaccgcgctcgacggtttcgacgctcggctccggctcgacgtagtcgatgatgcggaaggtcacacggttggaacgtgcgcggagctggtcgatgatcttgtcgaccacaccgagctgctccatgaccttatcgcacacgatgacggccttctcgatgccgtacatgtcgcgcaggtacttgatggcgttcggctcgaagtaagtcttggccggaatcttgaaccactgcatgttgttgttcctccgagcgatgcgcttgatgttgagaaggttaactgcctgaacgttgccagacacggagttgccgccgtaggagccgcagccgagggtcagcgacggtgcgatggcgttgtagatgtcgcccacgccgccgagggagctcggagagttccagatgatgcggcatgcgtgcatgcgctggccgtattcgcggaccagagcctgatcgttggtgtggatggctgcggtgtggcctgcaccatgcttgagcatggcttcgcacatttcgaaggcctgttccttgttgtcggacttcagcacggcctggaccggagcgagcttctccatggtcagcggctcgttctcaccgacctccttgcactcggcggcaagaatggtggcgtcttccggaatctcaaaacctgcggccttggcgatgtactgcggggacttgcccggcaccacagagttgagcttcggggtctggccggaatatgcggtgcagccgaacatgtactgctcgagcttggccttctcttcgtcgttcacaaagtaggccttgcggcgcttgagttccttgatcagcggagcgtagacttccttgtcggcgatgatggcctgctcggtggcgcagatcatgccgtaatcgaagtgcttggagagcaccagatcgttggcggcgcgcacgatgtcgacgttcttgtcgacatatgccggagcgttgccagcgccgacgccgagggccggcttgccggaggaatatgccgccttgaccatgcccggaccgccggtggcgaggatggtggcgataccatcatgcttcatcagggcgccggtggcttcgatggacgggtgctcgatccactggatacagttctcaggagcgcctgccgcgatggctgcgtcgcgcacgatcttggcggcttcgacggagcacttctgtgcgcccgggtggaagccgaagatgatcgggcagcgggtcttcagcgcgatcagcgacttgaagatggcggtggaggttgggttggtgaccggggtcacgccggcgacgacaccgaccggttcggcgatctcgtcgatgcccatgacatcgtcttcacgaatgatgccgacggtcttctgaccggccagatagttggtgacgtgctcgcaggcgaagatgttcttggtggccttgtcttccaccaaaccacggccggtttcctcaacggccatcttggcgagcaccagatgcttgttcagtgctgcgacggaagccttggcgacgatacggtcaacctgcttctgatcgagcttttcgaaatcgtcaagagccttcaggcccttcttgaccagagcgtcgacctcagcctcggctgcggcgagcttctcttccggagtcggcttggtcggctcttccttctttgcgtctgccacttgaagtcctcctcgattctttgggggtttgcaaagtagtttcccgttattccatccgcctcgaagcggatggacgcgttgctggtcttttgtgacctaggacacactttagtgagtatgcaatatgatgttccactgtgtcgtgtcgcaagagaaatgttatcttctgttcatttaatgtttagattgcgttcttttatggaatcaaaaagcctcaaaaacatcattttgagcgtttttgttgctttttatcataaatcacacacactttctcaagtctcacctccatatcttttataaaagtattttctatatgatatcaatcatatcgagcttttacaaagtcgatttatttatcttgttcgtccaatgtattttttccgccagccagtaggagtttcgcctgtttcttcaaagaagcgacgattgaaattcgaagcgttaccatatccgcaagcgcgacgaatcgaagcgacgctttgattcgtggtcgtcagcaatctgcatgcatgcccgatacgcaatcgtcgaacaaaatccgaaaaccctattcctgcagcccttttgaacagacgagagaaagccgaaacgctcattccggcctggcgggcggccaaatccatgctaatttcaccgctcagatgcgatgaaatgtactcgatggcatcattgaccacaccttccgcaccactgcatacagccggatcgtatccggacgcaaccaccgtataggattcatctgcgggggcatgcgcgaacacatccaacacacgaatcagatcactaacacggcaagcaagactatgttcctccatgttttccagaatcgaaccggcctgacgagcggattcaccgctcagcaccaatgcctgccccgcacgtttcaacaccattgcaaaaccagacgtttccggaaatccagacatcagcagacgcatggtttccggacgcacatggcacaccacatcacgctgacgaagccgctcccccggagcgatgtcggacacccaattatgcggaagatttgaaccaatcagcgcaacctgcccggcctcatacggaacaacggcattgcccgccatcatcaatccggtaccttcccgaatcagatgaatttcaatatgaggatgatgatgccatttcgccaacgagcttgggtagccatgcttcgcccaacgcaccgaagcctgcgcgtccggcacaatgatctccaatacgccggaatcgttcgaacttccacctttcggcacgaatccaccaaaagaggtctgagccaaagccgccttcccatgccgattatcgttgacttgtgcaacagcacccatgacacagacccctttcgtcgttccgtaacgtgcgtaacgtcagtcgtttttcacggtaatctgcagcttaatgtctccaggacgcccctcagccatgcgatcgaacgccgcctgggcatcctccatcgcataggtgtcggtgatgaatggcttcagattcagtttaccgttagccacgaggtcaatggccttctgatacacattggcataacggaagatattttcgatgcgcacctcggtagcctgcagctccgtaatatcgatggccaccggattgaccggaatgccaacgataacggcagcgccaccgggagcaatcagcttccagaatgtctcgtatgacttcggcgagcccgagcactcgaaagccacatcagcaccccagccccccgtttcctcgcggacgcgctccaccagatcctccttggtgagatccaccggaataatacctggaatctgagccgcaatcgccagtttgattgccgacacatcggagatcagcaccttggaagcgccacccgccaacgcgcacgacgcggtcagcatgccgaccgtgcctgatccggtgaccacgcagacatcgcccggcttgatacgagccttggtggcggaccacatgcccacagccaacggttcaagcagcgcaccctcaccgaagctcacattgtcgggcagcttgtaggtgaacgccgcaggatggttcaccgtttcgcacaggcagccatcaatcggcggagtggcaaagaaacgcaccgcaggatcgacgttatacatgcccagtttgctggcacgcgaactcatatccggaatgccgggctccatggccacacgatcgcccaccttgaagccttcgacgccaggaccgacctcaaccaccgtgccggaagcctcatgaccgagaatcatcggctgctccaccacatatttacccacgcgaccatgcgtgtaatagtgcaggtcggaaccgcacacaccaacggtatgtggcgcgatcttcagctcgcctagaccaggtgcggggacgtcaggcacctcacgcacattgatgacgccctgctcttcgagaacgactgccttcatgattattctcctttgtggataatgatgttttttttgagaaaaatgatgattgagcaattgatattcaattgcgattagttacgttcgatcgcggtaatgcgatggccacgatcgtcaaatccgggttgatgaggatgaatgccgagcgtgaccaacgatccgatcgcatagcagatcgcatacgtccagcacacgccgccgaatccgatagtggaaatcagcaccgtcgcaatcagcggaccgaaaaacgtagtcaggccggaagcgagattatgcgcggaaatcgcagcacccttatgttccgacgccaacgcgggaaacacggctcccataggaacgaaagcggaaattcccaatccaagaacaaccgcatcagcacacataagcaccatattcgccccgaaaaactgcggaatgtaatacatgcccagcgtgccgatcacacagaaccagcagccaaaccagcgcatttgccgcatccaaccatgcgaatcgcccatacgaccccagaacacattgccgaaaatggtgaccacaaactggaatccccaaatctgactccattgcgaaaccttaaaccaagcgccgccgccattgttggtagtggccaagtagagtggcatgatgacgggaaagccgtacaacgtcagattgcagatcacacgcaccaccgcagccaaagcgatttggcgattatgcaccagaatggtgactcctcgactaagctcgcgcagcttgtcggcattgctcatggaagaggtgtcagcacccttgcttttcggcaccagcagcaggcaaatcagcagtccagctatagaaaaaggcaacgaaagccacagcgagtagtactcgcccaccagcggaatggtgaaactcggcaaatatgcgccgaacacgccaatgccgaacgagtaggcggcccaaaaccaccccatggccgacgcgagcttggcagtatcgatggtttgcgccatcaacaccacgaacgagtagatgaacagcgggtagccaacaccccgcaacgcatacacgcctaacatcagcggatagacgccgctcggcagcgccacaccaacgaacagcaggtgcaaaacgacccaggcgctcgcgccgatcagcatgatgcgtttggcaccgaacatttcagctagcacaccggacgcccagccagcaagcgcagccatcagcccgtacatggtgaacatcagcgacgattgtgaagaactgaatccctggtccacgatgtatttggacaaaaaagtcaattcaaagccatcgccagtcatgaacaccgctatggcgaccaagccggccaatagcgtgcgcggcagacctatcttcataacatgtctcttttcttggtagaacgtcgttgtcaccgtctcaacttttttgttgataaacatattttcgacgcaaaaaagtggcagaaaatcctttatgcacagctatttttgatacttttttgcaatacctgatatctcagaccaacacgagacataaggaaaggacttttatgaagtagtcttgaaaaagaagttgcgcaggaaggatcaaccagtgaaagcccaatccgccctatcagtcaaagaagccaatctcaaggccatgaccgcgttcatctatacccaaggttcagccaccaagcagatgttcgaacacgaattagggctcagcctgccaaccatcacgcagaatctgcgcgccatggaggccgacgggctcatcgtcaaaggcgagatgcagcaatccaccggtggacgcaaagcgcaaatctacgaattcgcggcacactccagcgtggcgatcggcgtgcgcatccaaaccacacaaatcacggccatcgccattgatctgaacggcaaatccgtagccaccagacagcgcacactcccctatcgcaacaacgacgcctactaccagcgcatgaatggcatcatcaacgatttcgcgcaagaactggcgaaacaaggcagcacggtactcggcgtggccttctgcatgcaaggcatcgtgtcggcggacggccagtcgatcactttcggcaaaatcatgggcaacaccggcctgaaactcagcgaactcagccatggtctcaaccatccgtcgctgatgattcacgattccgacgcttctgccatggcggaactctggttcgaccacaatctgaaggatgccgtctgcatctacctcgaacgacgcccaggaggcgcggtcatcgtggacggatcgctctaccaagggccaaaccaatgcaatggctcaatcgaacatatgacgctgattccaggcggaaacccttgctattgcgggcaattaggctgcatggacacgtattgctcgccggaaacgctgatggaggacggcgaaagcctgcccggcttcttctcggtattggaacaaggcgagcaggagcatcgcaaacgattctcgcaatggctggattatgtggcgctggcggtaacgaacattcgctcggtgctggccggtgacgtgatcatcagcggtgaggcagcacaatatctcgatgatgacgatatggccggactacgcgaacgcgtggtggaacatacgccattcggcaccacggatttcaccctgcgcaagggaatggcgctcgaccatcaagacattatcggcgcggccctgcgttttgtggaaccgtacgtacgcgaactatgcgatatgtgaccgcttttacacatatattaatcgcattaatcgcatcgcttgcataacaaaagaagcgtgttgccgaacccgtatataaggttcaacgcacgcttctttgttcgcttccgtctgcttcacttgttgtattttttcagcgattatttgacggtaatcatctaatgatagttatttgacaatctggcagaattcgatggtttcgccgttcggtccgtatacattgaagtagcgaatgccgtgctcccagaagctgtcgatatgctgaatttcagtgtctttgaaattcagtccgagttccttcgcgttttcgaacgcggcttcaatgtcgggagtatcgaacgcccagtggttgatggcaccggtggtcagcggcgctgggtcgccttcccaggtttcgatggtcagatggccgtaacgcaggaatgcgcaacggttttcaccgttatggaacagtcccgccaactcgaaaccgagtttcttggtatagaattcgatggtttcgtccagatctttcgccggcatgccggaatgctgcagatcggtggtgaattcagacattggtttggtcataataccctccttgtgatggttggtacgatacgtttttcccttttgtgattaggatatgcgctatgcggcgatgtcagcggcgcatttgccgtcatatcgtgacacttttttgctaattccaggctgttcaggacgaataaacagcgtcagcaccgattttgacgacagccttggaagcggcggcgattttgccgtcgaggaagtcctgcacctgctcgagttcaagctcacggccggatcagaccggcacgagcgtcgacagcctcgacatagtaagtcaacagataatttcaaagtgtttagaatgaggttatgaagaacccgtctttgcaccgttatgcaactcgtccaggtctctacttcaccgatgatggtggggcggatgccatcgtccgctcggaaacagcggaccaagtgtggttttgcgtacttgagccgctcgaccaacccagtgccttctatgccgacgcagtacgattgttcaacgagccggggctgaccttcatcgatcaggcgatgaaacagcgcatctgcactcggcgaatcccctcgctcaatcttcgcgaaacactattccgcatggacgggcccaattacggactgtggtacgtgcacgtgccgcaagcatgggacggcatgcaatacggataccgcgtcaacggcccatgggaccccgaccacggcgtgagcttcaacccgtacaaactgttgctcgacccctatgccaaaggcatcgaaggatcaatggagcttgatcccggagcgttctcctatgaatgcgagatcgtgaacggcaaagtcaaaggttcgccattcggcccgatgagcaccatcgactccgtggggcatgttcccgtttccgtggcgatagacgatcgtgccaccaacaagcatgacggtgagccatcacacccgcatgtggcatggagcaaaaccgtgatctacgagctgcatgtcaaaggcttcacagccaacgcgccttggcttcccaaagagcttcgcggcacctatgcaggtttggcacatccggcgacgctctcctacctgcaggatttgggcgtcacttccattgagctgctgccgattcaagccaagcaatccgaactgtttctgcaggaacgcggacgcgtcaactattggggatattcgacgctcggctatttcgcgccggaagcctcatacgccaccaagcgctcccaggaggccggtgcggccgcagtacgccaggaagtcatcgacatggtacgagccttgcatgaggccggattcgaagtgattatggacgtggtctacaaccacacctgcgaatccggtccggaaggaccgaccgtatgctggcgcggactcgacaatctggcatattatcgacgcaccaaagataagatcagccgcctgtacgacaccaccggctgcggcaacacgcttgatttcaccaacacgcacgtcaccacattcgccgtggattcgttgcgctattgggccaaacgcattggcatcgacggattccgattcgatctcgcggcgacgctggcacgtctcgacggtgaattcacccgctaccatccgttcctgtatgcattgcgttccgacatgctgctcggcaatctcaaaatgatcatggaaccttgggattgcggtccaaatggctggcgcaccggcgaattcggcatccccttcgccgaatggaacgacaggttccgcgattgcacacgcaaattctggctgaccgacgtggatcgcacacgcagcggcgaatacggcgaaatgaccatgcaagacatggccacacgcctatgcggatcttccgacctgttcgccaccgaccccggccgcggttcaaccgcctccgtgaactatgtggcctgccacgacggcttcaccaccgccgacctgaccatgtacaagagcaaacacaacgaagccaacggagaaaacaaccacgacggaacaaacgacaaccattccgtcaatttcgggcatgagggccccagcagcgaccaaatcatcgtgcagcagcgccagcgtgccaccatgaacctgctgggcacgctcttactgtcgttgggcacgccaatgctgctcgccggcgacgaattcggcaattcgcaaaacggcaacaacaacgcctacacgcaagacaatgacattacatggcttgattgggattggctgtacagcaccgagcaaacgccggaattgaagcaattcaatctaacgtcacgtttaatcacgttgcgaaaatcccacgatttgtacagtcatgaggatttcttcacgcgcctgagcaaaatcggtttgctgaagaaatccgatcgcgtgcattggtatcttccgaacgggcagatgccggacgattcggattggacgaatcctgccgtacgctcgttcgccatgcaactgctctcccccgacgagcctagcctgctaattctgattaatggttccgacgaagtcacacgtttccatcttccgaaaggcattgaatgggagatggtctggtcttcatcagagatcgtcggcgaatatcccggtttgggaacgtccatcgaacgggtatcagaattcgacgcagagtcggaaaacaagccggcaggtagactgcgcaatcatctgcaccgcatcaatatgatgtactggcagatgcaagacaatgaagcaaatctgcaatctgccgacgatggattgtcggaagacgatccgacattgtggacgctcccggcgttgagcatcagtgcgatgaggcagatgccgaccgcctgattccatcaagctctgcctgaatcgttcgaataccaagaaacccctcggaaaacgaatttccgaggggtttcgtataagccgtaaagctttagcgcttcgagaactgcggagcgcgacgagccttgtgcagaccggccttcttgcgttccacgacgcgagcgtcgcgggtcaggaagccagccttcttcagggctgcgcggttcgcatcacgatcgatggcgttcagagcgcgggcaacgcccagacggattgcgccagcctggccggtggtgccgccaccgtcaacgaggacgatagcgtcgaacttgccttcgagcttgagaagcacgatcggggagttgacctcacgctgcagcagcttggccgggaagtactcttccagggtgcgaccgttgatggtccacttgccggtgcccggaaccaggcgaacacgagcgacggcttccttgcgacgaccggtgccgtagcccggagcgatagcggaagtaccggtgccagcgccagcgttggtttcggtggtgtacgaggtgagctcctcttcggtctcgagaaccgcggagttgttggtgttttcagccatgtttcttatctcccttcggttcacttagcctgctgcgagacctgagcgatctcgaaaacctgcggcttctggccagcgtacggatgctcggtgccacagatgatgtggaggcgatccagctggaccttggccagacgattcttcggcagcatgcccttgatagcggacttgatgatgcgctcagggttggtcttgagcagcttgccgtagctatcgcgacgcaggccacccggacgaccggagtgcatgtacagttccttacccaacttgttgccggtcagagcgatcttatcggcgttgagaatgatcacgtggttgccggaatcggcgtgcggagcgtaggtcggcttgttcttgccacgcagcaggatggctgcctgggaagcgagacggccgagcaccacgtcggtggcgtcgatgacgtaccagtcgtgagtcagatcagctggcttcggagtgaaagttttcacgatgtaccttttctatatattgtgttccggaccttccatcaacatcaatgcgttggttaggcgcggaatgatgccgttttcaggtctcattatccgtgggctccctgaaagtcctcgatggcgagtgggaaaagcgctttgaaggaccccgtagggaaacacaacaatctactagtatatcgccagccttgacatttgcgacacatcgtatagcgaaatcaacgtaaaataactctttttcacagcaacaaaaaccggcgatacgcaaacggacgttccgtttcatatcaccggttttatatatctaatatctgatgccaaacgcgatcagccgcgcataatcgctgcgatctcctgcagtcgagtattgccgaacaattcttccagaggcacgacattgccatcgccgtcagccaaaggaatacgccaattcgggtactcgttgcaggttcccggctggttctgcgtgcgcttttcgccgaccgcgtcgacgatggacgccgccatgagcttgcatggcgatcccttcaaaccgcggtacagcgcgtcgatgatctcgttttcgttggcaagctcgtcttccagcgcggaagcgtcgagatagccttcgtcgacaagcatgctcagcatggcgttatgttcggcttccgcggacttctggaattcttcgaccggaccggacaacaatcccaactgctcgcgcagcttgacatgcccatactccaagtagcctgccgccggaggcaaatcgtgcgtgttgacggaagccagcgcatacggacgccaatccttcggtgcacggaacacaccgtcgaactgttcgaaccattccactgcgcaaccgagaatgccgtgctcggacagcgatttggacacataagccggaaccacgccaagatcctctcccacgaccacgccaccggcgcgagacgcttccagcgcgagaatgccgagcatgatgtcagaatcgtaatgcacgtaggtgccgtccatggccttcctgccttccggaatccaccacaagcggaacaagccaagaatatggtctatacgcaccgcgcccgcattggagaacatgccgtgcaccatgtctcgatacaccttgtaaccggtctgatcaagggcaatcgggttcagcggcggctgactccaatcctgaccctgctggttgaacatgtctggcggggcaccgaccgtggcgcccttggcgaaacgctcaggattccaccacacgtcggaaccggccgggtgcacgcccaccgccatgtcggcgacgatgccaatcttcatgccggcgtcacgcgccgcctgctgggccgcatgcagctgctcggtggcgacccattcgagccaacggtagaattcaagcgtgtcaggatactgcgcgcgaagctgcgcgacctcttcggaatcacgattgtacttacgcacccaatcgttgtcgccgccattggaggcgccccacttgtcgtagcacaggcaccacgtggcataggattcgatctcatcgcccacttcggcgagatactggtcgaactcagcttgacgctgtgcggaaagacctgctttgtagatgatccacagcgcctgcatcttagtgcgccacatcgtttcgcggtccaaaacctgcgcatcgccgttgagaggttcgacctgctcgtgcagtgcatcgaccttcgccttgtcttccggcgaaagcgtggcatattccggcatggattccggacgaatatagctgaagttgatgaaacggcgcgaaatcggcagatacggcgacggctcgatcggtggcaccggctcggcggcatgcagcgggttgatcagcatgaagtcggcaccggtcttcttcttggattcgacgagcagggtcttcagatcctcataatcgccgattccccaagagccgctggaacggatggaatagagctggctcatccaaccccacagggagcctttcttcatctcgtcaagcagttcgatcttctccggagcactaataacggttgcagactccgtcttgccacccacggtgacttcaagggtgtgatacccttcgggaaggtcttccggaagcaccaggtacgacgtgcacacaaatccgccatcgacctcgaccgcggcaccgctgccgccctcatgctcgattttgccggcatacgtctcgccatcttccaacgtgatggaagctgcgggaacgtcaagcgcgccgccgtggacctctactttgctcttcttaccgacaatatgcagcacggtcggaggaacgattcgggtgttgcgttcacgctgaatggtggtgatggactgttcgatcgcatcatcgttggaagcgtcgattccaagtgccttgagcaccgccacaagaacatcgtcttcgatttcgtggtagtcacggctcataccgacataactggtggcgacacccgccaactttgccagacgaatgagcggacgggctagacgcgttgcattttcggtctgttctgtcataagcaacagtctatgccccaatcacatgcaccacgcgcaaaaatctcataaaaatgacaacgtatgcaactatttttccgaaagacgcttttcagcggccctttttacttctcccgacgcatcctgcgcaagtttttccagcatctgatcggatgtgttcgggttcactgcaacggccctgcgcaccatggaagcgagcaccgccggagcgttcggctcgatctcggttcccaaggatcccaaaaaatcaagggtttgcgaatccatatccggatcctgcgcgccttcgagcctcatcttccaagatgtccgcttattacgcaatgcgacatcgcgcacttcgggggacgcatccttggtgagacgccccaccagccaattcttatcattggaattgccggcaacggctttgcgcacctcaacggattcgtcggtggacagtttgacgagaatattcggaaacggcatggtttccgcgaggaaaacacgatcttccaacggcgtatgcgcattgcctgcgacagcctccagcagtgccgtggctcgcgagaacgcagcctgttcggaacggtcaggcaatggccggcgcgcgaattcactcagttcagcggcatccgcggaatgccgcaaacgctcgtaagtcgcggtcagaggctcgaaatccgaaggaatctcctgaccttgcgattgtgcggattcgttctcggcattgccgtcttgtttgatttcagcatcggtcatagttttccaccttacgtcattgtcttccgggattcacattttcaccggacgattggaagttcccgttttctgcggagtcacggttgcattgaacgtttcgaccacacgcgattcgaattgctgcgattgctcctgtggcacgacaaccgccaatacgatgcgatcggtgtactgcgcgtccgcctgctcaccctgcaccgaggcgagaagattctgaaaactgcccaattgtgagtagtcgagcgttacctgatattcgctacacggtacgattttcgctttggtcgccactttgacggcgatggacgcacccgaggaatatgcacgaatcagaccgccggaacccaataggatcccaccgaaataccgggtgacggcaaccacgcaatccgtcatctcgttggcgcgtagcacgtcgagaatcggcttgccagccgtgcccgacggctcgccatcatcgctcatacgctcggccaaacggccgtcggagccaccgcacaccgcagcataggcaacatgacgggctttcggatgctgatcacgaatcatctgcacaaacgcgagcgcctcatccaaggaatcgatatggcaggcgtcgccgatgaattccgatttcttctcgacgaacgcatcatgcgcgggctgatcggcggaatcgagtatggtctgcatgtctttcaacctacccaatcacgccgaccgtccgtacgtttttcttataccgtttcatgcgatcgctcacacgacgacgttgaaatcctcgcccttaaagtaagccgcgaccgattgaacaacctgcttggtgatgcccacatatgcgccgtcggtgcgccaggcggtgtgtggggtgaggatgatgcctggaatcgagcacagcggatcgtcggcagcgagcggctcatggtcgaacacgtcaagcgccgcaggaatgtcgccgcgctggagtctggagagcaacgcgcctgactcgatgatttccgcgcgggccgtgttgatgaacatggttcccggtttcagagcctcaagattttgcgcggtgacaatgccttttgtggagtccagcaacggcaagtggatggacaccacgtcggatccggcaatcagttcgttcatatcgtcaaccggagtgacgttcaggtcggtgagcacctgctcgggaacgtgggagttccatgcggacacgttcatgccgagagttccggcgatacgcgccacggtttggccaatgccgccaaggccgatgatgccaagcttcttaccgtacagttcatagccgtcgacaccatcccaattgccttctttgacttgcctgtcgagtttgccgacctgcctggcgagttccatgagcaatgcgatggtgtgttcggctacggcatggtcgccgtagtgcaccacgttgcatacgcggatgccacgttccttggctttgtttagatcgatgtagctggccacgccggtgccgccgaaagcgtagcatttcgcgttcagacggtcgaggatcgagtcggcacagtggaatccgatcactatgatggcgtcggcttcgacgcaacgcgcgacgatggtgtcttcatcgagcgtgaaatccttgtacatgcgtacgcgggcaatgtctttgaacagctcgaagttcttttcgaacgattcaatcatcgattcgatgatgacgggtataaccaccagcggcagatcggtacgttccggctgggtttcgtagatttcatccatgtctttcacctcacactgtgtgttcaagcggttcttccgcgttttcaaccaacggtacgaggcatattgtgccatggaaaactactcgccagatgaactcgcccgctctgcggttatattccattccttgaccacgttttggtcggcgcccatggaatagagcacgtcccagatgcgttggcgcacattcgcgtcttgcgtttcatcccagcaagggccgtccggatggtcgcttgccagcgaacaccattggtatttgccttgcgtcacattggcgctgggcacccagtcgatacggttgacgcgccacgagcctgccacgccttttttgcctgcgaattgaatgcgcgcggtcacaccttggttgtttacgatggtgtctgcagtattggccgattcggttacggcattacccaaaccgtagatgatccaagtgccgttatagttctcgatcggctgcgcgcaatggcaaccggcaccatagatcacatcaaatgcgcccgtatcagctagctcgtgcgcttcatcctgctgccaggaatcggcgtagtccaagtattcctgcacggaatgcatggccatggccaccacgtcggcaccttgttctcgagcggccttcgccttggccacggccttgtctatatcggcctgatggttcggatctccggattcgcgaaggcgatccacacgccagtcgtagtcaggcgtttgcgcattcaacgatacggttcccgcaacgagtccgattttgccgtcttctggcgaacatgctggaatacgccaaatactatgccgctatcaagggcgttgccgccgctggcagcggcgatatgaacgtggaccgccgtctcgaatcaattcaaaaactgggcagcacggttacggacccgttggttatgtacatgttcgcggcatggaagcgtgatcgcgtaagttgtgatggactgctgcgcatgcttgcggatcttgaatcgtacctgttccgcagaatgatctgctcggtatccagcaacggattgaacaagctcgttccgtcgctgatcgtcagacttgattcggctgaagatgatttggccgaaaccttcgccgcactactcatcaccgagactgccaaagccacacgcatgcctacggacagtaaattcagacaggcgttgctcggtgagaacctgtaccggccggcctggcgatgcaagtatctgcttgccggcttggagaactataaccaccccaaggatccgcggtccttcagcgaatacaccatcgaacacatcatgccgcagaacgccatggcgcacgccgaatggtgcaatatgctcgcaaacctcgaccgattcccgctattggtgaacagtctgggtaatctgacgctgaccgcatacaattcggagctttccgacggaacgttcgaacagaagaagaaccgtgcggtcggcggatacgatagcgaatacctatccatttccgcggaactgcacgatgcttcgcaatggaacgaacaggcgatcgcgcagcgaggcacccgacttgccgatctcgcattgcaggtgtgggcacgccccacagcggggaatgaggttatgcagactctgcgcaatcggaacgtgaaccagggggaacgcgaacagaatgccgttgatttcgctgatttgtgcaaacgcggagtcctcgcggccggagatgtgctggaaagccgatacgctggcgtaaccgccacggctaccgtaaccaaagaccatcgcatccgcttggccaacggcgagatattcgacagtccatccggcgcatttcgccgtgccagaatgctcgaaaccggcgaggataagcaggtcaacgggtggacagtgtggaaagtcgcggacggcagaactttgaacgaattgcggtaagtcggcagtaatatctcgctgcggcgtagtttctggaatggattgtacgaatatgccgcaacacgggctgattttgtcgacgtgtatggcgatccatccggccgtaagacaaacatcgacacatggacgagtttcggcgtgggttcggaaatctgccacccagaggggacactgaatatccgtggcggctatattacggtcgacctgtacttcaccgacacgttccagtacgcgaagctctacaccatgagggattccgttgaacggatactggcaaatctgggcgaggtgatgtgggacgagccggaagccgacaagaaaaactggcatctttgggtgcgtcgtgatgtggatttctccggtgacatgacggaagcctaccggtggatgacggacgggctgctcgccatgcgcaatgtgtatgagctgctcggctgatgttttggccgtttcgactgctgtgcgttcaatgcttcatacaatgaacgtagtcatccgaaaagaggccgccatgaaatatgggatgagaaaacctaactggaacatctacgacgccgaaacgaacgacatggccacgaaaatccacaacaaccaatacacggtgaactgacggaaacgattgtagccggcgccgcctagcatgcaatacgggaaacgacgccggccacaacgaccggccaagacggacggaacacacgaaaaggcgaatcaaacacagcatgggcaagaacggcacgcaaccaacaacgaaaaacgtcacaccagcagtcacaccatggggtaagaaccgtgtgaagaacaccgaaaccggcaagcacgtgctcatcatgccaggcattggatacaccgtagaccgaccgctgctgtactgggcagcgcaggcgcttgcggccaacggatggttcgtggaccggctcgacctgaaactgacggaaagcgtcgagtttccggaaatgatcgcctgcatggaacgcgtggtcgacgaatggcacaaagcggcgctcgaacatgctgccgaatcgggtgaggagccgcatttgctggtcgtcaccaaatcgctctccacactctcatatccgcattccgcaaagctaggattgcgcgtggtgttgctcaccccggtgctcaatccgccgccattcgacaggcacaagtcggtcattcccgcgccgctgccgggaactgccggcagcccgatgccgctaatctgcgcgggtgacgccgacccatactacgatgacgccaaagcgcatctgctcaccgaccatgtgcgcacgtacgctggtgccaaccattccatcgaagtgccggacgattggcagacgtcgctcgactacctgaaacaggtcacgcaagccatcgtcgactacgccggctgaaaagaccgggacggactatgcgcatcgtattgcagaaggtcggcgaaggatccgtcgacgtggtcgacgagacaagcggagaagtcgacaccacattcgaaccacagcatataggcatcggctatgtgctgctcgtcggagtggaagacacggacggagcggagcaaatcgactggcttgcccgcaaaatcgccaatctacgcgtcttcgaagacgagaacggcaaaatgaaccgttccatccacgacgtgaacggcagtgtgctgtccatctcccaattcacgctatacgcgaacgtgcgcaaaggcaaccgcccaagcttcgtgaaagccggagcgcccgcgcacgccgaacagacatggcacggattcaacgacgccctgcgcgtgcaaggactcgaagtaaaagaaggacgattcggctcccacatgcgcgtgcggctcgccaacgacggtccggtcaccatcatccttgacaccgacgaactcggcgtctgacccagaaccccaacgtgaaaccctatatccgacgattgtcatagggtaaaacgcatgggaatatggaacgaccgcaaattgatcgtcaactgcctgccgttgaccgaatccgaacgtgcgcaattcatacgtgctgcgaaagacataccacaggaattcgtcggcgattcgacccaacggggaagcatgagctggaccgccgcagtaccggaggaactcaaagccaaagccaccgcggtcatcggcaacatcgcgcccgaggaatgcgcgcaatgccccaaactcgaatggcttcaaacttggagcgccggcgtcgacaaataccagcgacccggcatcctgcagcccggatccatgctcaccaatgccaccggagcctacggacaaagcgtctccgaacacatgttcgccatgatgtgggccatcatgaagaacctgcacatctacgcggcaagcaacccgaatgccatgtggcaggacgcaggacgagccatcagccccaacggaaaaacggcgctcgtcatcggaaccggcgacatcggatcacacttcgcacgactctgcaaaaacgtcggaatgacaaccatcggcattcgccgtaatcccgccgtcgaagcgccgggcgtcgatcatatagtcggtttcgattctctcgacgacgtgctgcaatacgccgatgtgatcgccatgagcgtgccatctacttcgacaacgcgccatctgctcaatgcggaacgcatcgcatctctcaaacctgacgccatcatcatcaacgcgggccgcggcaacgccattgaaagtcaggcgcttgccgacgcgctcgcggaaggacgaatccgtggtgccgcgctcgatgtgaccgaaccggaaccgctgccggccaactcgccgctgtggtgcgagccgaaatgcctcatcaccccacatgtggcgggaggcaaccatcttgagatcaccgaacgcagtatcatctccattgcattaggcaacgtccgctgctacgccaacggtcagtcgctcgacaatcgcatgcccatcaaaagctgacggtcgcgcgtgcggggagacccgtatgatggcagtcgggaagaaaggaaagggtatgacattgaacaaatggcgtcgtgcgacggaatggttcatgacggcattggcgttggtgttcctgttcgcgtattcgtgggaagttctggcgaggacgcatatcctgttgtgtgaaatggtgatcaacatcatctggatggtgttcatcgccgactgcgtcgtttcgatcctgctggcagaagataagaaaacttggttcaaagacaatctgctgatgctggtgtccatcgcattgcccgtcttcaggccgttgagactgctgcgtctggtggcagtgctcaacgtgctcaatcgtaccggtggcatggcggtgcgtgggcgcatcacactgtacacatgctgcagcgtgacactactgatgtatatcggcgcccttgccgaattggatgtggaacgtggggttccgggcgcttccatcaccgatttcggtgaagcgatatggtggtcgttcgtgaccgtcaccacagtcggctatggcgatttgtctccggtgacatggcagggaagatgcatcgccatcggactgatgataaccggcgttgccctgatcggcatcgtcaccgcgacgctggcttcatggattgtcgaccgtgttcgtgacgagaccgacaagcgtgcggatgaggcggaatcggaaacggaacagttacgccacaatgtgcgggaactgacggacaccgtcaaccagctgcgcgatgatatcgcgcagctgcacaggttatagcggttctcatgcctgcaccggtattatcggtcggttccacggtcaacgcgacggtatctgtgggcgtgctcgaagccgccaccgattacaagggtcagcgctcgctgccgcgcgacttctccatagaactgaagcagggctccatcaccaaccagcgtagatcgggccgctgctggaatccgaaccggtggaactcgatccatggcagccgctcaccaagcgttgccgctgatataacctgtatggagcgaagccgtggctgggattgcagccacggctttcctgttccgctgtgctgatactctttcataagaacaaatgtgcgaacgattggggttcagttggcggatactttgtcatggctttctgacgaactacgcagcgaatgcagtcagcctgtattgcagcgtgcccgtggaatcgccaaccagtggcgtgcgaaaatgtcggatctgcattgcctgaacgactccgattccgatcgcatcaccctgcatgccaatatgcggggcaccacctcaccgtccagccgatacgaagtgcaggccacgcttgatttgcatgatgagcttttcttggccaggtattgctcgtgccccgcgttcaacggttcgcagcacggttatggcacgtattcgtcggcatattcgcccagctaccgcaacaatccaaaatatcgcagtttcgatgatgatgacgatgaatacgattatgtcgatgattatgatgatttcggttcaggatcgacgttcggccatgtgcaggacgatgacgagttcgattcggagccggctggggggcaccgctataccggcatgtgcaagcatgtcgccgcaatgctgctgctgtttcttgaccagcccgaacggttccgcggattcaagcgaagtgacgtgacctcgcctatcctctccgactacatgcgtgcgctggatgcgaagaatgacaataccggtcaaagcgcgcagcttgacgtgctcaagcgcatcgtcgacgcgaaaagccgtctcgccgacgagcaacgaggcgtcattacgcaaggggccacgaaaacaaaacgcaagagcggttccatcatagtgaaaccgggaagcgtgcgtctggagcccacgctgatcatgaaccgtgagctgtggagcctgacgttgaaaatcggctgcggcgacgcaagttatatcatcaaaagcatttccaaattcgtagccgacatgcgcagcggcgcatacgtgtcgtatgggcagaaactttcgttcacccatactccggatatgctcgaaccgttctctctgcagctgttccgattcctggaaggcgttgttggttcacgtgccgcagcgcaactgcagaacaactactattacgcgccagacgtgcgcatcgaacgtgaaatcatgctcaccgatggagaattgtgcgatctgctgaatctgttcaaggcggaatcgcaacaggactacatcgaagacgtgctgatagcacgtgggctggtggaaacgcccaaatatgaggaacgtgagagggcacggcagctgactccggatgatttcactcgtacggatgacactgccccgaactatgtcgatgtaaccacgcctggtgaatccggatcgcgtaccatcgccatgttcgacggcaatccgcaattccgatttgctgccgaatatgtgaaggaaggcgcgtcgtcgggcgtgcgtatcacgccgaaccgcgttatcacggatcggattgtcgggcagcgaggcgcgtaccttatgagcgccgagcataacgtcaatccatcgaacccccatatggtgcctgtcagtggattcttccgctgtgctgacagcattcttcccgcagtggacgcgttgatgacattgtgtgcgtcagacagcactgacggcgtatttattgcgaaaaacgactggcccatattcgcccgaaccatactgccgaagcttactgaagctgacatcggtttcgacattccacaggaagtcgccgaacagatgggagccgactgccaaatcgaattctacttggaccgtgatctgcagggcatcacctgcgaggctgtggcacgatacggcgatttcgtattccagctggtgccgaccgccaaagcgttacgaggcgtgatcaaccctgactcgcggtcgaaggcggcgctcgtcaaacgagatacggcgcgtgaatcattcgcggtgcaggtgatacgtcaattgttccccacttggagttccattgatgtggcgcgcgtgcgtgaggaagacgagcagacgattctgctgttgctcaccgaaggcgtggatatcttgcgctcggtcgggcaagtgttctccacggccgcgttcgacggcatgttgatgcctggcagtcctacggtgaaggttggactgtccatcgactcgaacttggttgaaatctcgccgatcgccaacgaagtgccgatgaacgaggtcggcgcgctactgaattcctaccgaaggaaccgtcgctaccaccggttgaaggatggtacgttcgttgatctgaagaacgccgatctgcgcgagatcgatcagatcgcaacggatcttgaccttaatgagaagcagcttgattccggaagaatcaccattcccggatatcaggcgttcctcttggacgcgcaggttgacgacgatggcaaaagtgaatcgttcgtcgactacgtcaacgatgtgaaaatcatcgattcgaagcgatatgaagtacccagcaatctcaaaaacgtgttgcgtccgtaccaagtggagggcttccaatggctttccaccttgtgggacaaaggcttcggcggcattctcgccgacgaaatgggtttgggcaaatccgtgcaattgctgtcgctggtggaagctcgcaagggcagtggtcccgcgttgatcgtctgcccggcgtccttggtatacaactgggccgccgaatgcgaaaaattcacgcaagatctgaccatcgaagtcgtggccggcacgaaagcgcaacggcgcaagctcatcgcagccgtggcacagcaatggaagaacccctcggaatccaacgatatgcagcgtaccgatgtggtgatcacctcatacgatttattgcgccgcgacgtggatgattacgccgcctgccggttcgcattgatggcgctcgacgaggcgcaatacatcaaaaaccatgccacgaagttggcgaaagccgtcaaacagatcaccgccgaacaccggttcgcattgacgggaacccccatcgaaaaccggttgagcgaactgtggagcatcttcgacttcctcatgcccggattgctgggaacctacacgaagttccgagaaaaatacgaacagccgatcatggcacccggttctgaacattccgtcatggctgacaaactgcaggctttggtcggactgttcattaagcgacgtctgaaaaaagacgtgctgaccgatttacctgacaagttcgaaaacgtgctcaccgtcaaactggaaggcgaacagcgcaaactctatgcggcgcacgagcaacggttgcgcgccacccttaccaaaaccaaggacgccgacttcaatacgaagaagattcgaatccttgcggaattcacactgttgcgcgaaatctgttgcgatccgagactcgtctatgcggatgcgaaaaacgcttccgccaaacttgacgccatctgcgaactcgtatccacgtgcatggacgaaagcaagaaagtgcttgtattctcgcagttcacttcattccttgacctgattggtacacgtttggctgaacagggcgtggacttctacaccatcaccggcgagacaccgaagaaacgccgtgtggaactggtggacgaattcaatggcaacgatgttcccgtgttcctcatctcgctcaaagcgggcaatacggggctgaaccttgtgggtgcgtccgtagtggtgcacgccgacccgtggtggaacgcggccgcgcagaaccaggccaccgatcgtgcgcaccgcatcggacagacgcaggatgtgaacgtgtaccaaatcgtagccaaagacaccatcgaggaacgcatcctcaaactgcaggagaagaaaagcgagcttgcccaacagttcaccgacggcaccgcatctggaggcgtcggcacactcagcaaagacgacttgctcgacctgctggcataacaatcaacgtacctgccgcttgcttgaacgcacacgatacgaaagcaacaggcaaagcgcacactgcggcaacacaccatgaggcgacgttcatgccataggcaaaaggcatatgaggccaagatcatggtttccggattaaagattgatgcctgctgataatagacgccagtgagacgcggtttgcatatttccgacgataggcgtatatataatcgtgcaagtttcagggaaggtgaaaatccttactggcggtaacggtacgactgacgttcataacggtcccatgccgaagcccgcgacccgcgaaagcggctgatccggtgagaatccggagccaacggtcaaagtccggatggaagaaacggggctcaacatgagtgtatcctcaccaaacaatacccaaaacaacgacgccgaaatcaccagcgaaagcatgacgcgccccgacaacgcgcattccacaggcgtggccgactctggacgctggtccaccaaacgcatcgccatgtatgcgctgttcgtggcgctgtcgatggccgtcagctttgtggaatttcccattgtgccaggcgtggaatggctgaaatatgatccatccggcattgtcagcctggtggcaggtttcgcctacgggccagcggcggcggtaatcgtcagcgtgcttggtttcctgccgcacctgttcaccaacccatggggcacgcttatggccgtgctcgtggctttggcattatccgtgccggcagcactgatctaccgcaggaacaagacccgcaaaggcgcggtcatcggcatcatcgtcggtgcgatcgcagccttggcgatggcgattgtgggcaatataatcgtcacaccgttctacgcgcatatgaccaccgcacaggtcgtggcattgatcgtgccggcgcttctgccgttcaacgcgttgaaattcaccatccatggcgtggtcaccttcctgatctacaagccgatctccaacctgttgaaccgctgagcctcgttcaccatatcgattccgcatattgatgaataggaaggaacctttcgacgtatggaaggttcctttcgtttatgaaagactttttccatgaatcctgacagcgccacgaacaccatcgcggtcgaactgcacgatattcgtttcacctacgactccggcgcgacctgggcgctcgacggcgtgaacctgaccgttcgccaaggcgaacgtgtatgcttggcaggaccaaacggatcgggcaaatccacactttcacgcatcatcgcaggacttgccgcacccgatgccggacatgtcacgttgttgggaaacaacgtattcgatgactccggcgcgcacgctgatgcttaccgcagcgcccggcatggtatcggggcggttttccaacatccggaagatcagatcgttaccaccgtcaccgaggatgatgttgccttcggtccggaaaacctcgccattgcgcatgatgatatcgatatgcgcatcgccatgtcacttgacgcagtcgacatgagcggacaacgagaagccgatcccacgcgaatgagcggaggccaacagcagcgcgtcgccatcgccggcatgcttgccatgaatcccgaaatcctcgtgctcgacgagcctaccgccatgctcgatccgcaaggccgtgccgacatcatgcatgttcttgacgaattgcagcagcacggcacaaccatcattctcgtcacccaccatcgtgacgaattcgtcaatgccgaccgcatcattcgcctggataacgggcgtatcgtgcaaagcgctcgcggtaatactgcaagtattccggaaatggacgaatcaggcacagcgcaagaagacaacccaattgccaaatccaatattgcaaatggcgcatcgaagccaacatcagctgtaccaatcattgaaatccataatctgatatatcaatatccaaacagtagcaagcctgtgctcgataagctttccataaccatcaatgagggtgaaaccgtggccatcacagggcataacggtgcaggcaaaaccaccctcgcgcgtcttctctgcgcgctggaacagccgcaatctggcagcattaccgtcaacaccattcccgtcgcacgccaacgcgccaacggcaatatgcagtcgctcaagcgtgcggaccgcgagaaactgcgcgccaccatcggctacgtcatgcagcaccccgaacgtcagcttttcgccgaaaccgtagccgaggacgtcgcctacggtccgcgcaaccaacggcttgatgaagcgcaagtggatgaacatgtcagccaagccatggcattgctgcatattgaacatcttgccgaccgttcgccattcgacctttccggcgggcagcaacgactcgttgccatagcgggcgtcatcgcatgccaaccgcggattctcattatggacgagccgaccgcgggacttgatgaagcggccacaacccgcgtgcacaatctcatccaaaccctccacgcacaaggcatcaccatactcatcatttcccattcgcaagcggaaatcgacgtacttgccgaccggacgatcgcgcttgacgctgaccggaacgttggtggaaaagttcgtgatgccgagcctggttctgctgtcgaatcggcaggttcgaagaatctgcacacgcttggctccggacatgcaaagggagacgtccgtgaaaaccgcagttttatggaacggcttgacccgcgcgtgaagatggtgggcgcgttggcggtcatgttctccgcattcgccatccgctctttctggcagctgctcgtggccgcactgttgaccggcatgatcgttgcgacatcaggcatcggcgtgaaacaactgttcaaatcgattcacatgttccttgcattgttcgtgttctgcggactgctcaatgtgttcttcgtacaatccggcaatgttcttacgaacatcggaccgattccaatcaccgacgacggtgtgcgtatcgctatactgtacgcctgcagattcgttgcggtcattatcgtcggagtggtgttcctcgccaccaccacgcctacggccatcaccgacgcgttcgaagccttgctcaaacccttcgcaaaaataggcgtgcacgcgcaggagatcgcactggtgatgagcctcgcactgcggttcctgcccactctgggaagcgaggcgaaagccattgcggacgcacaggcggctcgaggtggcagcatcgaaacgggaacgttcgtgcagcgtatcaaggcgatggtttccatcatcattccggtgttcgcaggggcgatacgccatgccgacaatctcagtctcgcactcgacgcgcgatgctatgaagagggtatcgcacgcacacattggcgcgtgatgagcatcgccaaacgagacattgccgcgggcggtgtggttgtggcatatgtggctgcgttggttctgatcgctggactaaactgaaggcagtcggcggattttaccgtcctcacgctactcttgagcaagcatcatagataggaatggaacaagttatggcattaaccaagaagcaggtcaagcagctgcgaggcctggccaccaagctcaatccgctcatccaggtcggcaagaacgatctgagcgaaaacgccatcaagcaggcggacgaaaccatcgaaaagcgtgagctcatcaagtgctccgtgctcgacggatccggtctgaccgccaaggaagcaggcgagggattggctgaagaactgaacgcggaactcgtgcaggtcatcggcaaccgtttcgtgctctaccgccgctcccatcgcgacgacgtggaacatatccgcctcgtacgcgaataaagcgggaaactgacgcgaccaaacataacagggcgggtgctttctgaaaaccaatcagaagacacccgccttgctgcaatgaaaataaacaatcggaagtcaggaaaccccatgaaggagtgctatcagcgcgcctgattccattcgggcttccatgtgtactgcatgtcgtacgcgctggcccagaacatgtattcgttctccacgccggtcacgaaaatgtcgatcagctcgcgcttgcgctcctcgctcgcgtcggccaccagtttctcgatatgatcgagcagccacacggaatcctgccagaactcgtcggtcttatacatgtcgacccagctcttgtacggattgttgtcgagcgtgtccgcgaactcggcggcaagacgataaccataatccgcatacacccaggcgcacggcagcacggccacaagaatgtcgagaatatccttgccataggcgatggaaaggatattcgacgtgtaggcacgcgcgaaggccgactggcgcacattgttcatctgctcttcggtgatgccatagctggccaagtaggagcggtgtacttcggtctcgacctgcagggcgccgttctgcaccttgagcatgaacgccatgatttcagggtcggtggccttggctaatcccaaagcgtgcactctggcgtaatcgttcacataacgaaaatcctgcagcagatagaaggcgaaacgctcgcgttgcagtgtgccttcgccaagctcgcggatgaacggctgctggtagccttcctcccaaaccaggtcggcggccttgcgcatgcgctgcgcgaacggcggaagattgtcgcgttggatgcctttggcggcgtcgaactcataatcgaaatcggttgttgatgtcacagcagtcactagacatgcctccctacgctggtgttaaccatcaggttcaaagggttcaggcctcacttggcccatctcaacccgacgaacacgggttcccctgcattacgccgtacattatggcaaagccgcacgaaatgtgcaagagcccgtccgtcgaatggaatcgtgccgcatgatgcgaacacaggcgatgttcggttgagggcgagtgcaagaatggaacgtatgactgaaaagcaagttgcgaagaacaccatcgaaaagctggctatcgtcgtggtgacgtacaggcgtcagcagctgctcgccaccctgttcgaatccatcgaaaaactcactgtggcgccatggcgtatcatcgtcgtggacaacgagcacagcgaggcgacccaaggcatggtcgacgatttccgtgaagcggtcaccgcgcagtggggcaataccatcgccgaccagtcgggcaacgaaagccgtgtggtgtacgcgccgcaatccgacaacctcggcggcgcaggcggcttctccgcaggtgtgaagaaggcatacgagctgggtgcggagtggttctgggtgatggacgacgacgtggccgtgatgcccgaggccattgaaaggctcgccaagtggaccggcagccatgatgtgatccagggaagccgatacgactacgacggaggcccgttctactggcagtacgatttcatcgtgcctcttggcattcccaatccgatcgctccggccgcgttcgggcgtcccggctatcgtgtgatggacaccttatgctttgaaggcggcctgttccgccgcaatatcgtggaacagatcggtttgccggatccccgcttcttcatctactgggacgatacgatgtacggctatcgcgccagcaaggtcaccaatccgatcgtggtgcccgacgtgatcctgcgacgtacgcgcgagatcggcaattgggatatcgccggcgtgcgtcagctcaactccacttccgacatgaaccgctaccacatcatgcgcaaccgtggctacatggcacgctatttcatgtcgttcggcgattaccgtccgctgatgttcggctttggcacgttgctgaccgccgccaaggaggtcattcgcttggtgatggtggaccgtgagcatgccaagaccggcttggtgcagattgccaagggttggtgggattcacgcaagctgctgcatgatccggattggaagccgatgccgccgctcaagtaatgtggctacaccgtcttcagacggttattttcttatgattcgccccatgccgatgcgttgcgttggcatggggcgaatcgtttgcagaaaacaatcgcaaatatttgcgtttcattgcgacagattatgcaatcgtattcaccaattgtgtattgtcggcgcgttttggggcatggggcgagttactatggcgtttaccggttcgatatacccactatgtaccttgataggagaggtcgaagatgattgaaactgcacaggcatttggcgttgacattggcggctccggcattaaggcagccccggttaacctcgagaagggcgaatttgctgaaccgcgtctgaagatcctcaccccggaggtttccactccgaaggccgttggcgaaatcgttcgccagcagctcgagcattttgaggttcctgagtccgctccggtcggcatcgcattccccgctccgattcatgttggcgagaagctcggctatatggccaatctggaccagtcttgggttggcgtggacgtcaccgaagtgttctccgaagcttgcggccgtccggtcaccgtggtgaacgacgctgatgcggccggtcttgccgaacagcagttcggcgcagccaagggccaggacggcttggtcgtcgccaccacgctgggcaccggcatcggcaccgcgctgatcttcaacggcgagctcattccgaacactgagctcggccatttggaactgctcaagggcaagggtgacgccgagaagtacgcggcatcctccattcgtgaaaagctcgatatgggctacaagaagtgggccaagcgtctgaccaagtattattccctgatggagttctacttggatccgcagctgttcgtcgtcggcggtggcgtgtcccgcgtgtccgagaagttcctgccgtacatcgacatcaagaccccgatcgtcgcagccaagctgcacaatgaggctggcatcatcggcgctgcgtactacgcaagcatcaagcagaagtgatgtcgtgaaccataaaggttcctaaccttcatataagcgagagccgtccgattcatccgtcggacggctcttgttattcctctgatgatcgcatggcgaatgcatccttcttgctcgatgcaacacttgcgcaacccagagagtatggtggagaccatgcgtttttcctccagagtcgatatcagcgagcccaatcccatcgccaaagccgaagcggaagccaaagcgaacggcatcacactcggcaaactcaacgactccaatccaaccaaacatgcgctcgcgtcggaactattgccggacatctacggagcggagccacgcgggcaacgatacgcacgcgaagcgctggccgcattcctgcatgaacaaggcaataccgctaccgccgacgacctatacatattgagctcgacgtccgaagcgtactcatggctgatcaaactgctctgcaatgcaggtgacgctgtgctcgcaccgaagccgggatatccgctcatcgaatcgatcgcacgactcgaatgcgtcgacatgatcgagtaccagcaacgtttcgacggatcctggtacatcgacgtggccgaactacgcgaagcgcttgaaggtgaagatggcggccgcatccgcgcgctggtgctcatcaatcccaacaatccgaccggatcgtacgtcaaagcgtcggaacgtgaggccattgtgcggctttgtcatgaccatgaggtggccatcatcgccgatgaggtattctacgactatgatcttgaaccattcgatggcaacgcgcgtctcgcgggggagaccggcacgctcacattcgcattggatgggttctcgaagacgttggccgcgccacatgccaaagtgggttggatccaagtgtccggcccggcggctgaaatggatgaggccaagcgcagactcgacgtggtcgccgacgactatctgccaatgagtgagatcatcgccaaacagatccccgccatgctgggcgccgcagccgcgcagaccgcgcgcgtgcgagagcgcgtgcaaaccaacctcgcagccttgcataccatgctggatgatgacgagcagggcatggtcagcgtgttgcgtgccgaaggcggatggaatgtgcttttgcgcgtgcccagcgtgcttgacgagaacgaactggtgttgtccatgatcgaaaagcacggaatttcaggacagcccggctatttcttcgatatgacgtcgaacggctatctcgcgatctcgttattgccggaacccgacgaattcaggcataacgttcagacggtgcttgacaccgtcaacacaatgatcggctgaaacatgttgtggttccatcgtcgacaccgatgaaggagccgcaacatgtggggaacgggaataatccgtgggtatggtcaggctttggaagcctcatatttagcgcggatgaggtccgtgtaaaaggccacggcctcatgcgggccaccgtcgaacaccacctgatgatcgtcgaccaccagcgtgcggtcgatcgcatattccgcgcgtgtgatcagctccgtgtcatgcgtggcgaacactacctgtttgtcgtaactgaacagagctttcgccacatgcgcggacgccacctcgtccaaacccttggtcggctcgtcggcaacgatcaccgcgggggagaagctcaatgcggaagcgatcgccagcagatgacgtttctcgctatccaatgcggaggcgggctcacgtgcgaccgccgccagatcgaaatgcgcgaacagattgccgatgatcgcctggcgttcgctttccggcaccttatgcttcttcaacggttcatcaatcgcctcgcgaatggaatccgctttgtaataactgttcggaatttcctcgcgacgaacgcggccgatcatcgattcgatacgtttcagatcacgtttcaccgacggatcatacgcagcaccattcgcgtcgatacgcaccgaaccggacgtcgcagacaatgcgccatccaacagctgcagcaacgtggtcttaccggaaccattcaacccgatcacagccacacgtttgctttccggagtgatcgtcaacgatgtcggctccagaccgacattgccatcctcatacgtgtggcctgcctgatctagcgtgaacgtgacgtcatgcgtcgcttcgggacgtttggatgaaaacagcgaatcgaaaaaacccatggcaaccattgtacgggcgtgccgaacccattgcatacgaaacggggccggaaatccaaactcccacaaggagtttagattcccggccccgtcaagcctgcggacaggatgtcaggcgaaatagaatcccgagaaatcgtacttgtacacgcggtagatgtacgcactgttcaacgtcatcttgaactgcgccagcagatcaccatccttgttgtactggccgaacagacccttcatgcccgagtcgatgaggatctggccattatccaattcctgcgcggaactgacatacggcgaatatggcacgtcgaacgatgacacttccgtatacgtgccggcattctcgttgaccagatacttgcgataccgcgaatttgccgtgtcggaagacagttcgatcgagattccgtcgatcaccgaccagtcaaaatcaggacgcgtcaacgaagtgccgaaattattgtcgaacatgtacaggtaatactggccgtcaggcaacgaatcatcggcgacgtatgtgatggaatgctgtccgccggtatcggaaaaatctccgtctttcgctaggaaactgctgacctcatcggtgcctgcccacacggacggctcgccgatcatgtagtcgaccgtcggatctgattccagatcatccactttgatgatggtggacgtttcgcgtgcggagaataacgcggaaccatcatccaacagttggatggtgttgcaatgcagccaatcccaacgattctgggcgctcgaatccgactcgtcggttcctgcatgcgtggtggaggccttatagtcggcgaacagttcgccgaaatccaccaagcgggtcacactgccggtggaagtgttgagcttgatgacctgatcttgcacggcattgtcgtcgcggcccatttcggtggccaacagcacgatgtctccattggcgtccatcgcgtaatcgtggtgcagaatatagtcggatccaagatcatagatcttctccaacttgccgagacggttcatcgctgccatgtggtgtgtggaagcggagaaccacatgagcccgtcatcgtcgaacagcagacgatgcgaacgatagtagagcacgggaatctcaccgcgcagcacgccgttcgtatcataatagaacatgaagtcctgctcgtcggaatcgttgccgagtatggcatacaggccatcgcccaagtcttctccggaatcagctacgacggtctgctccagttgcacttcctcattgccaagcagggaagcacccctgtgttcgaaggtatgcgtacgggatttgccatcggcgttggtcaacgtgatggtgatggtgttcttttccccgggaataaggccgagtatctggaattcatgggttttgctgtattgcgattgctggtaggcgtcacgggtgaaatccgcgtagccgtccgcatgcacggtataggatacggataccgagtcgtcggtggtgaaatacacatacagcgacgtggtgttggtgccgtacggatcctcggtgacgaacatgtcatcttccgtggcggcagacttgcttttttcctgctcgagcttgtcgtcggccatattctgatagtcggctgtgtacacattctcgatacgtgcgttcagccgttcgatcctgttttgtctgatggccgcatcgacgttgtcatagctggcgagacagacgcccaatgcgatggccgatgctaccacggccgcggtccagcgtttaacacgaggatggttagacagaagtggaagcgatttcataactgatgtctccaacaagggttcatctcatatcgaacagttacgacaccactattattcgcaaaactcggaacaaaccggagattttattggacaaaccgtaataaaaccctgaaataaccctgaaaacgccgtgcctcatatcagggtgaaccacgactgcacgtcatggaacaaaccggaattattgcgtatcagctcgtcgtcgcgaccatataggaacaacgacaacaccgtcaccgccaacatgaacagcagcagcgccaacaccagtacgcgcaacagccagcacagccgcggacggtcgcaatccaacgcaatgagcagcagaggcaacgaagccaaggcgaacagccaaccgaaatcggcgatgtagcgccacccaagaccacccaagcgcgcgtcaagcgccacaatcagcaaacttaacagcaggaacgtcgtcagtgtacgccacataccgacatgaccacgagcgcgcatatgccggcgtaggaatgggcatgccagcgaagccaatgcgagaggcgccctgacgaacaggcctccaggcatcgcctccgtgaacccccaatctttcaatggggtggggtcgacggcaaggaacgggaacatattcgtccagcgcaacggcaaaaacagatagtatgcgaccgtccaaatgaaattcgaccacgactgatggtagctcgtcatatccgtgaccgttatctgatatgacgaaccgaaatcgaatggcgaggagaaacgcaccatgttataggcgaacaacggcaccaccacaaccaatgcgggcaccagcacggccaaaggcgcacgcaacgcatgcaacatggcgcagacgcgcccatgcgcgccagaagcgaacacgccatcacgcaactgtttggcaatcgcacgaatctgcggccagaacaacggaaacgcggcgaacgccaccaccacaaacgacggacggcaacccacattcgcggcaatacacaccgaaccggcagccaaacgaggcagcgacaacgattcgaccgtattcgcaccaccatcgccaccggcatcggccgcgttcgggtgcgccgcacccatccatagccataagcccaacgtgctcaacaacaaggacgccgcaatcggcaccgaataaaaattcgtccgataccacaagtacggggcgttcgacgccaaaaccacaaacacgcacaacatactgaccgcagccagcgaaacatgcggacgcacacgctcgatcacgcgaatcgtcaacaggcacgcgaacaccaaaaaaacaaacatcagcagcggcaccgcagcgccagacggcatcatcagaccaccatcaacccacaacgacgttatcgcacgatacggcacaaacaacagcaacgccggcaccacgccaaaatacgaataccaacgaccatcaaaaaacgcataatcccaatacaccggactcacaccatcggcaagcaattgctgacgagtcgtcacatcatacggattatccgcatcgcgcaacgcgtcgggcacatccaaatcaagccacgcatgaccattaagcaacgcccgagccacatgatcatactgatcgtaatcatacgtatacatgccatccgtatgaaaactcaacggcaccgcagacaccaactgccacgccaccgccgcaacagtcaccaacccaggaaccgtcaacaacacgcccaacgtcacacgctgacgcacactcgacgtattcaacggcaccttccacaggcgcgagcccggacgccacaacgccaccaacaccatcaccaacaccaacaacgccacacgcaacggactcaccgaaaacggcacacgcacattcgcgcgaaccgcatcaaacggaatcaatgaccccttcggctccaccacctgcacgcgcaccgtacgaccggccgcagccctcacatacaacgaacgagacgaatccaacgacaccgaacacaacgaaccagccacacgatccgcatccgcacgaacacgcaccgtacgcaacacgcgcgaaccggcaggcacaccacccataacctcatcggacaccggcacgatccgcacatactcagacgaaccatccgcagccacctgcaaatacgcctgcgtcggatcagtaacctccaacaacccgtcatcacgacgctcaagccccggccccaacgtgttatacgcagccgccgaatcacccgacgccgccaacgagcggaaaaacggcacattacacaacacgcactcaaccaacaccaccacaacaaaagcggctacaatagctgcgcacacacgatgacgcgcctgaaaacgctgtttcgaaaaagtcacgaactttattctaaaggctgcatgtcgcattgaattgaaagaatggcccacatgtcacacctcacaccagcatcgccatcagcacaccatccacaccaaggacggaccatgctcaaccacgccatgcaaggggtacgacaactcatcaaccacaacaaacacccccacaacaccgccgacgccaaccccttcggcaaagccctcgacacgccagacgacatcgtcgatgaactcacccgcaacgccatcaaactcaacccactcatcaaacgacacatcatcaaaggcttcgaaggcataccaagcacactccaactcggctgggcgcaactgccacaaacccaaggcaaagccttctccatcggactattcaccgacaacaaccacttcgcgcaaatcgcgctcgccgacagcaaagcacgcgtcttcgcgggcaccaatcccgaaatggacgtgcaggatctggaaccacgattcatattcgtcaaagaagaaaccctcaccctgccagacggtccacgattcggacacgcgacaaacggcgcgccgaagatggtgcgcgcgtcgcaaggcggtgtcgtgggacgcatgcccgatggccgcatgatgtggctcgcatcctggctgaaagtcggcaaccgctacacgctcgaacagatgcgtgccaacctgccggaaaccatgcgattcgatctggaatacagggatgccatcaccatcgcattcttcgcagcctacatgctgccgcaaatgaacgggctactcgtgggattcggcacgggcaacatcttccgcaggctcaaccgagaggcgccgatgggcgcgatccgccgatccatcagagacacgatgagcgcacgctcccatggcatgcgcgcatccggacttgaggattatttcgccgacctcatgcgcgaggcaggcgcccttgacaaagaccaagggctcgaagcagtacacggcgcggaaccattgcacctatacacgtccagctactcgggctgctatttcttcgcttgggattccacactgccgttctcggcatcgctgcgcgcgctgaacatcgaaggcaacctcaaccgtttcgccgcagtcagttcatggctggaacgcaacgcccgtatcggcaagctgcccacagaagacaccgtaacccgcgcggaagccgcgcaaatcgacatggcgctactggaaaatccggcgctgatcgcattgaaaccggacgacgaattcggcgcgatcctcgactcacagcaggatgacggcgtccaagccgtcatgcgcctggtggacatcgccgcggaaaccagacgttccatcgccgaaaacacgaaggacggcgaggatggtaccgccttcggagccgaaggcggttcggaatgggtataccgccagacaatgtcgagactattgcgcagcatgcgcctgccataccgcttcgacgtggacttccgatgcagtctccgagacggcaatatggccatcggtttcacctctgccggcgtttccatgatgccatccaccaaatatgacgtgtcccgccacgcatgggtggatatgacggacgccgaacgcgcccgcatgagcgcggactacaatctgcgtgttggactgatgatggccgcgttgagttttggcgccgatccgggcatacagcgtgtgtcgatgcatatcgattcgattggtttggaagaggccgtggccgagcaggattccgccatcagcgagctgatgagcgaggctttggcggctttcgaacgcattcgtactggagatatgggtgtttctgggtccaaggccgatccgaaggacggcgatttccacggagacccgtcccgtccggtggcgccgagatccgccgacatgggcgttgatggcgtcaactccgaggatacggatgatgcgttgaacagccaattcgaggatctgatgcgggatatcgacttcgacgaagtgacgttcgcggttcccgacgagattgcggacgattcctctagcatggacgacggttccgcacagggcgtgcatgatggcgctcttgacgcgggactgatcggcttcggcgatttcgatgggaatggtgatgatccattaagccagcttcgcaagaatccgaccgtacgcaatctggtgacggtcaccttcaccagaagcgaattcatggagcgtctgggcgagtgcggattgtctgatccaacaggcacataccgtatgttcgatgcggaaatggatgtggacggcctcggcgcattgaagccagtggacgccacgttcgatttgcgcgatagtcgtttctccccatccggaagtcaggaggagcctgagctttccgacgccatattcgaccatgacacggcacagctgttcggctgccgtgacatgtcggggttgtccattcagcgcgtcgacctgctgcagcgcgcggttggcgaattccacagaatcgcgcaggactcccatctggaatcggtggccaaggcaaagcaggccatggacgtcatcaacaccattgccgacccggaattgacgtcgttggctccgcaggtgacgagtgcgctcatcgatggcaaagacactccggacttctccttccgcttggccgacgagcttgacgcggaacgcatcaaggcgagagacctgctgttctcaggacaggtcgaccaaagcgtggaactggccgaagcggcgttggagcgaatggaccgactgttcgcttcgaatccgggcgtgccgcggtatttcaactcgtatgcggaacgcgtcatctacaatcgcatgttcgccacggaaggcgaacggaccgtgctgattccggacaatctgttctacgcgcatatggaactcgccgacgtgcttgcacaggtcaaaggcgtgaaggccgcgttgccgcatctcaatgcgatggtgcgatatgcgccggcctacccgctttcccatctcaagctggcggttcaactggcgcgcgccgaggattgggatccggccagagcggcttgcctcaacgcgttgcacgtcgcacttgaccgtgaggatgcgtcgttcgcctattacagactcgcctatgcggaatggatgtgcgaccacttcgacatcgcggccgccgcgtacatcatgagcgaggagattgcccccgggcgaatcgccatgctggagagcgagctgcaggaattgatcggacgcgcgcaatcgcaatgcattccggtgcccaccgacgttccggaagccatgcacgtgcttacccaagcgggactgccggtatggcccaatacccaggtcgcatccttggtacgcaaggccgcgcgggtctgtgtggatgaaggcatgttcgtgccggcacgtacgctttcggttgccgcttcaaggatggatgacgaggagcgcgacggtgccgacgtggtgcagatgcagttcctgaggtcgttgaacaactgaacggcgtgctttccgcagtgcgccaaacagacgttggcgatgcagcaaatcgaacatttgtgcgataatgtgtgcatggcggctctgaccggcaaaacattgaagacagtgacaaggcaatgacaatgacaaggcatgacgattccgaacaactcgcatgggattttgacgcttctgaaatgggcggcgatacgggctccgcgtcaaccgctgtggttcccgacgggggagtcagctcatatgcgccgggcagtgaacgctggatcgccgcattgcagccaaccgatgccgacgccatgcggttgacccgacttgatgtctcgtccatcagtgctgaagccgcggctcgattgtgggcgcgtgtggcggcgtgggtggaatccgaccagatcgcatactacatcgatgacgcgccggtctcgtccgacgccgcctatgatgcgagaatacgttgtctacaggcgttggaagcccagttcccatccctcgattccgcgcaatcgccgacgcatcgtgtcggaggcaccttctccaatgatttcgcatcggtacgccacccgtctcgcatgatgagtcttgacgatgtcttttcgcttgaggaactgcatgaatggtacgacggtgttattcggggacttgattggcctgagacgaagcctttgccgatgacatgcgaagtgaaaatcgacggtcttgcgcttaacctcatctaccgtaacggcgtgctcgagcaaggtctgaccagaggtgacggcgtgatcggcgaggatatcacgctcaatgtgcgcaccatctccaccattccgcagaatcttgcgggaccggaagaagacattcccgaattcgtggagatccgcggtgaggtcttcatgcgatgggacgatttcaacacgctcaacaaagaaaacgaggatgctgggcgcgcgcctttcgccaatccacgtaacgcggctgccggaagcctgcggcagaaggatccgcgcatcaccgccaccagaaggctgagcttctatgcgcatggcattggaacgctccagtggggcgccaaacgtggtgccgaccatgatgcggtcaacaaccaatccgaagcgtatgggttgtataagaagtggggcatacccgtttcgccacataaccgtgaggtcaccacattcagccagattctcgacatgatcgattactacggcgagcatcgtggagacatcgaacacgcgctcgacggcattgtcgtaaaagtggatgatttgggattgcaacgatcgttgggcgcgacctcgcgtgctccgcgttggtccatcgcctacaagtacccgccggaggaagtcaatacggaactgcttgacatcaccgtgcaggtggggcgcaccggccgtgtgaccccagtggccatattgaagcccgtatatgttgcgggttcgacggtgtcgagaaccaccttgcacaatccattcgaagtggaacgcaagggtgtgctcatcggagacaccgttgtggtgcgtaaggcgggcgatgtgattcccgaactcgtaggtcctgtgctggaacgcagggaaggacacgaaggccagctgcgccgtttcgtgatgccttcgcactgcccgagctgcggggcggaactcgctccggccaaagagggggacaaggacatccgctgcccgaacgtggaatcctgcccggcacagttgaccgaacgcatcatcaatctggcatccaggaaagcgttcgatatcgagcatttaggcgaccaatccgccatcgctttgacgaatccggaagaggaccgtcccgattcgacggccacctacgcgccgaacatcacggaaatcgtggtggagccgggcgcggagcccgaaccgtacgagcctgtggaaggtctggagctgccggcccgccaaacaccggtgctgtccagcgaagccggtctgttttcgttgacgtccgccgatctgcaggatgttcgcgtatggcgtgaagcgccgatcatcgaaatccacgaaaccatcggcaagaacggcaaaccgaaaaagatacgcaaacgcattggcggatcgggactgtggcatcaggttccggcgttctggacagctcctacagttgcaagaaaacgtaaggactccgtcgacgaatccgcggaatatcccgaatatgacgtgcctgaagatgccgtggtcgttcgcgaggaaaccaaggtgtcgcgttccggaacatccagtgtgcagccgatatatatacgccccgcggaaaacacgaggaaaatgcttgacgaaatggacaaggcgcgccatgccgacctatggcgtgtgcttgtggccctgtccattcggcggctcggtcctcccacggcgcgtaccatcgccaacacattcggttcgctcgacgccatcgaacaagccagcgtggatgaactgtcacagatagacggcatcggtccggaaattgccgaatccgtggtcacctggtttgcttcggccaagaatccaggcgattggcgtggcatggtgctggaagcatggaaggcagccggagtgggagtcggacaggcacagaccagtgctctgccgcagacactggaaggcaagacagtggtcgtcactggttcgttggttgatttctcgcgggattccgccaaagaggcgattatctcccgcggtggaaaggccgcaggatcggtcagcaagaaaaccgattgggtggtcgtcggcgaaaacgctggtgccaaagccgccaaagccgaggaattgggaatcgccatgctggacgaggaccagttcaaactgctgctggaaaacggaacggtgtgacgcgtgccatatcaagccggcaacgtaatcacaagaaggctctggcatgccgcgcttccagacgctagtctggtacgcggctaaaggaggaaccatgaccgacgagcgcaccatcgaagcgcgcatctatgagcgactcagcaaagtaatcgacccggaactgggccgatccgtgaccgatttgggcatgatcgcagccatagacgcgataccggtggaaggtaagacgaacacctacgaggttcgtgtggaggtcgaactgacggtggaaggctgtccactgtcgcagaccatcaccaaccagatcaacggagcggtgtcgtcatatccggaagcgacattgctgccgcgcatcgaagtcgggtccatgagtcaagacaagctcacccaacttgtggcaggcctcaaggccgaacgcaaacagaatccgttcaacaagccgggcatcaaaacccgtattttcgccatagcatccggcaaaggaggcgtcggcaagtcttccgtcactgcgaatcttgctgccacatttgccgcattggggtacgacacggccgccatcgacgccgacatttatggtttctcactgccgcgactgttcggcgtgcatgcgcaacccaccaatctgaacggcatgctcatgccagttaccgcatggggtgtgaaattgatttccatcggcatgtttgccggcgccgatcgtgcgatcctttggcgaggcccgcgattgcagcgttctcttgaacaattcctttcagacgtatggtggggcgagcctgacgtgctgctgctcgacttggcaccaggtaccggcgacatggcgatttccgtggcgcaggctctgccgaacgcggaactggtggtggtcaccacgccgcagccatccgcctcggacattgcggtccgctccggcctggtggcattgcaggtaccgatgaaggtacgcggcgttgtggagaacatgagctattacgagcatcagggcgaacgcctgcggattttcggcgaaggtgggggtgcgcgtgtgtcggagcagttgaccgaaagccttggctatgatgttcctttgctcgcacagctaccgttggagccggaattgcgtgagaccggtgaggccggccgccccgccgtgttgaacgaggatggcgcgttgcgcgccgatggcattggcgagacgttcaggaatctggccgaatcgttgatgcacagacctatgtgatgtgcggggcacgtatccaggccgtcatgacccgcggtatggacggtggcctaatgcggctgcggattcacagctcatccggggaacgtctgggtggaaaacgaagcgaaatgaaaatgacccttgtgaaaatcttgtgccttgtgtagtatcaagcgcagacacgggggccgtatggctgagaggaagcaagcgcttcaaccgtatgaacgtataccgggtaatgccggcgcacggacgtctctcttttcccgtgccttgacatagagaaaggcacattcatgaccgtaaatgaatcttccgtggtgaagaagcataacaataaatggcgagttgttgacatcgtcgtggccgctatcatcgcggttgcggctggcgtgattttctggggctgggatgtcatctgcgccgctccgattacgcttttcgaagcggtgacgccgggcttcgaaggcttgttgaacggcatctggctgtttgcgggtccgctggccgccatcatcgtgcgaaagcctggcgctgcgttgttcgctgaaacctttgccgccgctctggagcttgccatgggcaatccgtggggcatcggcggttctttgattatcggtatctgccaaggcctcactgccgaaatcggttttgcgatttttgcatacaaacgttgggatttgctgtcgaccaccatcgctggaaccctcgccggcttgggatgcttcctgtataactggaccgtgaatcctgcttgggcaggtttgcgtattgtcgtcagctgcgtcacttccgttatttccggcgctctggtggctggagtcctgatgtatctgctgcagcaggccatcgctaaaacaggcgtgcttgaccgtttcgaatccggccgtgcgaaggccttggtatgacgattcgttaatgaagtcccgtatcgcattcacagtggtggatacgggacttctttgatgcgtgttcgttctgcaaacgcggaatgcaagaggaatgaaagaacgattcatgggtactgatgcagaaaaatcgttttccgcagccggggtggtcgcacgcgattggggatggcgacacgcctcacgtaaggatttcgcgttaaggcatgtggatttcaccatacagccaggggagcgcgtgttgttgttgggcgcttccggcgctggaaaatcgacgttgatgtccggtcttgccggcgtgctcggcggcgatgacgaaggcgagcttgaaggagagctgctgattgacggagtggacgcccgtcaggcacgcggacgttccggattggtgttgcaggatcctgacgcgcagacgattctggaacgtgtgggcgatgacaccgctttcggttgtgaaaatctgaatctgccgaaagatgagatttggagcagggtccgttcctcgctcgacattgttggactcggctacatgaaacttgaccgctccacacgcagactgtccggcggccagcgccagcgtctggccttggccggcgtgctcgccatgcatcccggactgctgctgctcgacgaaccgacggccaacctcgatccggagggcgtcaaggaagtgcatgatgcggtacgccatgtgctggaacagacccgtgaaaccttggtggtggtggaacaccatattgacgtatggcttgatctggtggatcgggttatcgtactcggcaagccggaggccgactcgcatgtcagcggcgtcatcgcagacggcactccggaagaagtgttcggcagcatggcatcggtgctcgcaaagggcggcgcatgggttccaggacgcaccatcgaaagtcatacccccgaatccagccaatcgtcgggagatgttgttctgcgaacggaggatctcagcttcgggcgtgacttcgcgcttggcgagcatgtgaacctcgtgttccatgctggcgagatcaccgcactgaccggcaaaaacggcgtgggaaaatccacgctcgcgttgactttggccggcttgctcaagccgatttccggccgtgtgagcatggatgagaccatggttcccgcacgtagggagaacgacgtcttcacttggaaaagtcgggatctgctcggacggatcggcatggtgttccaggagccggaacaccagttcgtcgcatccagcgtgcgtgacgaagcggcggtcggccccaaatccatgggcaagagcgaagaagagtcttacgctatagccgacaacatgcttgagcgtatgaatcttgctagattcgctcaagctaatccgttcacattatcgggcggcgaaaaaagaaggctttccgttgcctccatgctggccgccgcgccgaaagtcttggtgatggacgagccgacgttcggccaagacttcaccacatggacggaaatggtgaaactgatcgccggtgcgcgtgacgccggctgttccgtcatcatggtcacccatgacgaaccattgatcgaaacgttgggagcgcgtcgcgttctcgtaagcgagggggagtgagatggaacagttggaaaccatcagcgtggtaccgcacaaggaacgtcatgacgatgccaagccggcatcgccgtcatggttcgtggcaaaaatcaatccggtcagccgtttcatcggcgcgctgatactatgtattcccatgttcgtgacgctggacgtggtctccgcgtccgtggcactcgcattggaggtgttgttgctctggattggcggcgtcgctccgtggacggtgcttcgtaaaacctggccggtgtggattgccgcttcgggaagtttcatttccgtgtcgttgtatggcaagacctccggggccgtgctggtcaatctcggtgatgtcgttgtgatttcgcagggatcgttgtacttggcgttggccacgttcctgcgtgtggcggccattgccgttcccggcgtgattcttgcgcttggtcttgatccgactgatttggccgatggtctggtgcagattctgcatttgccgtcgcgtttcgtgtatggcggtttggctggcatgcgcatgtttactttgctgcaggatgattggcgtgcgcttgggcagtcccgtcgttctcgtggattgggcgacggcagcgccgtcaaacgtgtgttctcgcaggcgttcagtctgctggtcgtgtcgattcgacgcggcacgaaactcgccaccgccatggaagctcgtggtttcggcgcggacgctccgcgaagccaggctaggaaatcgagcttacatgccgtcgattggctgttttacgtgatttgcgtggccgtgccggtgattgcgttgtcttgcgcttatttcaccggttactggcattgggcttttaccggcactggcaattaatcggagcagggctgcgcagtacgaggtttgttgaatgcgcggcggatttgcgaagggcgtttcattcgttgtatggaatggaacgcccttcgcatttgcccgttgtttttctcaaaagatatgtgatatccgctacttggcaagcttgtcaagcagcagcgcttcggtgatcacattgtttttcaggctgggaagactgatggattcgttcgggctgtgcgcgttggccttcggatcctcgggaccggtgaccagtacctgcgcgtccgggaaaatacgctgcaattccggaatgaacggaatcgagccaccttcgcccttattgaccggagccacgccaaacgcctcttccatggcgtccatggcgtctttggtagcctcggcatttggatccatggcccaacccatgccattatcaagcttgtcgacccacacttcggcgccaaacggagcatgctcgaccatgaacctggcaagtgcttcctgagcctcttccggacgctggtttggagcggtgcgcaggctgagacggaacgtcgtttcaggggagatcacgttgaacgatccctccactggatgagcatcgaagccgatgacggtcacgctcggcttggtccacagacgtgcggccaaagaaccggtgccggccagacggtaggaatcgacgatgccggcgtccgtacgcacggttgcctcatccatatctcgctgcagtccgccgattggatcttctgaggcgacgcccggtaccaccaaatcgccatgctcgtcatacatggaagcgatcagcatggaggcaagcgtgttcgcatcgaggatcggtccgccgtactgaccggagtgcaccggatgatgcagcgccttgacgtgcacgtcaatatcggtattgcctcgcagcgacgtggtgagcgaggggatttcagcggaccaattgcccgagtcggcgacgatgatcacatcggaatcgaattcgtccttatgctcctcgatgaagggaatgaagcttggcgatcccatttcctcttcgccttcgatgaagactttgatattgaccttcaaatcgtcgccgagcgcctgcaatgcgccggaatgaatggcgattccgccgccatcgtcggccgagccgcgcccgtacaggcgggtgtcgattacagtgccgacgaacgggtcggtgttccatgcgctggcgtcgggtaccggctgtacatcgtgatgcgcgtacagaagcacggtcggcgcatcctcatcgacaatcttcgaaccaatgacttcccaagcgcccggggtgccattaggattgtgggactgcaccacttgggcgtttacgccgaccttgctgagctcttcggccacaaattcggcggatcgtttcatatgatccgcggtgatgccttttgccgaaatggactgtaatgcgattttcttgttaagcacgttgacgatgcggtcaaaatccgcttcgactcgtgatcgaacttcttcgacaggtaaagctgccatattgctccttacaaagacgcgctgccatacaacaacgcagcgtgatcatatgcgtgtaacgaatgaccattgtatcggtctcaatcggcacgtccaattgttgacagggcagggccaaggcgtcgatacgtcactttacgctctataggcatgagtttgtttaacaagaaggaagagacggcgcaggagcctgtcgagaccaaggttgcggaaaccacttccggcaagggtcgtccgacgccgaagcgcaaggatgctcaggcgcagaatcttcgcccgttggttcccaaggatcgcgaggcgagccgtaaggccgccaaggcgcgtatgcgcgagcgtgagaacgccgagtacgatgccatgcagaagggcgacatcaaccacatgccaaaggcagagcgtctgccatggcgcatttacatccgtgactacgtcgacgctcgttttaacctcggtgagttcttcattccggttgcgttcgtcattctgatcggttcgattttcgtaacatatcagtggcctgcgctggcattgccgttgatggtgctcatgtatgtgtacctgttcgcggtgatcattgacgtggtgatcatgtggcgtaagctcaagaagaaactcattgagaagttcggcgagcaatccgtgtccaagggcatgcgttctggttcctatgcgtggagccgtgcgatccagatgcgccgttggcgtctgccgaagccgcgttacgataagcgtggacactggccggagtgatcggctcctgccgggaatcgcggccatcgttttttcaagccgtcggcgaaaaccggcggcttttccattaccatgtaaccagttgtaacgcacgaatcaacgaggacaggcatgactgaacagcatttcgacatcgtcatcatcggagcgggaccaggcggatattccacggcactacgcgctgcccaacttggcaaaacggtggcattggtagaacgcgacgacacgttgggaggcacttgcctcaatcgcgggtgcattccatcgaaggcgttgctgacggccgcgcatagtgtagagaacgtacgtcaggcggagcgtatgggcgtcaatgtcgcattgcagagcattgacttcggcaggttacgtgacttccgtatgtccacggtggagacgatgacgaagggattggcgggattgctgtcgcaccgtggcgtcaccgtgttccgtggcgaggcacagctgaaaaatggtcatgaggtgcatgttgcgccggccttgggagagacgcaggttctgcgttccatcaaggcgggagtaggggaacttgtaggatcggaacttacgatctcaggcggcgatattgttctcgcgaccggttcgcgcccgctgccgttgcctgacgatccgttttccggagcgttgattgattcgacgcaggctctggaattggacacgttcccatccagcgcagtgattatcggcgctggcgcggtggcgttggaattcgcatcattgtggaatgcgtcgggatgcaaggtgaccttgctcattcgcaaggatcgcgtgctgtcgtcttgggagaggcgggcttcgatgacgttgacacgtgagctcaaacgccatggcgtgaatgtggtggcgcgcacgtcggtaagtcatgtggacaccggagcaaacttgggtgctaccgtgcactacaggcagggtgatgacgttgaggagcgtaccgcgtatggcgaagtggtgcttgctgccattggccgcatgccgaacaccgatgccgactggttcgcttccaacggcatcgcattggatgaacgtggctatgttctgaccgatgcgtacgggcgcacgaacgtggaaggcgtatgggctttgggagatatcacgccggggcatgccttggcgcaccgtgcgttcgagcagggcatcaccatcgccgaaaccatcgcgggacttgatcccaaacctgtcgtcgacgaaaccgtgccgcaagtcgtgttttccttccccgaggcggcaagcgtcgggcttacgctcagcgaggcgaaatcacgtgacactattgtcgatccgcaggaaaccgcatatccgatgctgtccaactcgcgtatgctcatgagtggggagggtggatccatgaccatcgtcagcggtgcgatggctgacgctcccgacgttcctcttgtgcttggcgtgcacatcgtcagtccgatagccagcgatctgatcgcggaagccgaacagctggttggtaaccatgtaccgcttgccgatgcggcaaagctcattcacccgcatcctacgttcagcgaatcgttcggagaggcgctgctcaaagcggatggcaggcctttgcacacccgataatcctcgtcaataaaggggaaacagcggaaatcatgcgatatggcatggttcctgataaactaccgttccagtgtgagtaaccgcataaccaagtgaggaagtcgatggcagacaaagaagagccaaagaagaagcagagcaccatcaaacagatcattcagatcttcaagtacacccatgccgaagacaaggctcttccgtggctgtgcggaggcgtgttcgtggcgcctatcatcgtgttcgtggtacttggcatcgtattcaagtggtcggtgattggatggatcacatccatgatcctggccgtcatgcttggcctgctgttcgccaccatgatgctcaccaaccgtgccgacaaagtcggatacgccaagcttgaagggcgtcagggtgctgccatcagcgtgctcggcaacattaacaaggctggcttcaactttccgcaggagccggtgtgggttgatccgaaggccaaagacgccatttggcgcggcaccggttacaacggcatttatctgctcggcgagggcgattacaatcgcgtcaagcgtgccatggaccgtcaggagcagaatatcaagggtgtgaccgccggttccgatattcccgtctaccgtatctacgtcggccagggcaagaatcagacgagcctgaagaatctgcgcaagaccgtgctcaaatgcaagagctacctgccgacccaccacaagaacaagttggtggccgccatccatccgaagagccgcttcatgcttaccaagaccgagctgaacatcctcaacgagcgtctgcgcactctgcagatgaagaacggcatgggcattccgaagggcgtcgacccgatgcacccgcagcgcatcagccgtcgtgctatgcgtggccgctgattttcctggaatcgtaaagccggcttacatatgggaacctcgatgaacacgttatcgaggttccttttttcatatctccgttaccttccgctggcctgcgcgcatgcggtaaggtttttgagaaaagaaatggacgtcgcaagcgacatgacgacacgaatgtccacaaattgaacggttttgcagaggcaaatacgagcgttcgtaacaattgaaccccagtttttcgcgaaatcatccttcgaatatgtcattacgaaacattctcgtaacccaattggcgagtgagcgaaacgcgcgttcctagactaagagcctgtaagttacttattcgaaaggagcggtcccgtgactgcacttgaaaccaaggctgatgctgaggcccttatcaacaaggaaggcatcgagtatgtctccgttcgcttcactgatctgatcggtgttcagcagcacttcaccgtgccggcaagcgaattcctgaaggacgccttcaccgacggcatgccgttcgatggctcctccgtggaaggcttccaggccatcaatgaatccgatatgaagctggtgccggacgtttccaccgcattcgtcgatccgttccgcaagcacaagaccctcgacgtggccttctccatcgtcgacccgctgaccgacgagccgtactcccgcgatccgcgtcaggttgcaggcaaggccgaggcctacctgaagtccaccggcatcgccgacaccgcttccttcgctccggaagccgagttcttcatcttcgacaaggtgcgcttcgagaacagcatgcagcgctccttctacgaggtcgactccatcgaagctccgtggaactccggcgtcgacaccgaagacgacggcaccccgaacatcgcattcaagaaccgcgtcaagcgcggctacttcccggttccgccgatcgaccacacccaggatctgcgtgacgacatggtcgccaacctgcagaaggtcggtctgatcctcgagcgttcccatcacgaggtcgccggcgctggccagcaggagatcaactaccgcttcaactctctgcagcacgcaggcgatgacctgatgaagtacaagtacgtcgttcacgagaccgccgctctggcaggcaaggccgcaaccttcatgccgaagccgatcgcaggcgacaacggcaccggcatgcattgccaccagtccctgtggaaggacggcaagccgctgttctacgatgagaagaactacggtggtctgtccgaccttgcccgctggtacatcggcggcctgatcaagcactcctcctccgtgctggccttcaccaacccgtccctgaactcctaccaccgtctggtcccgggcttcgaagctccggtcaacttggtgtactccgcacgcaaccgctccgccgccatccgtatcccgctggccggcacctccccggctgcaaagcgcatcgagttccgtgctccggatccgtcctgcaacccgttcctcgccttctccgcacagctgatggcaggtctggacggcatcctgaaccacatcgagcctccggagccggtcgacaaggatctgtacgagctgccgccggaagagcacgcaggtatcaagcaggttccgagctccctggcagaggccatggatgcccttgaggaagatcatgacttcctcaccgcaggcgacgtcttcaccgacgacctgatcgaaacctggatcggcatcaagcgtggtgaaatcgaccaggcccgcctggctccgaccccgctggagtacgagctgtacttccacatctgaggcctatacccagtttcccttgaaatcaagctgttttggactccaagggtaatcagaaggtagccagattggttataaggagagcctctccaaattggggaggctctccttattcctacagaatttcttccatccgggacggcaaagaccttacggaccggtcttctgactcctcgcctccacgaacacatcagacgcatccaataaataaccgttgatatgagccggacgtgcttccacaggttcaccgttaatgtcgtcgtattcatacaacgcaggagcgtttgtgcctctgtcgaatccgacaatgacgacatgcacgttcgcattgtccgtagtctgagcgtcccagcagaacgtacggtgagcgaaccggatacgccaccctcgttcgaccacatgcttgaatagcggggcgacttgtgctggccttgtgtgatgctattcgtggatacgaacgcgaattgcgcggagggattcccgtcaaggaaatcaatagctttaaaataccatccagccacataatccagcgagcctccggccttgccgcacaccagttccatatcatccttgatctgctgcgtgtgctgctgatggccgatgaacggcgggttgcccatcacatacgagcattcatcaccgggcagcagaagactgacgaggtcataaccatagtcactcgcgaacgctctcgttggcgtcgcggcatcttcgaggatgccttcaagcgcctcacgagtccccaacgtccttctctgcatgaatgaacctccttgtatggctggaagttatcgtcacagatgatttcgtaaccacttacctctgttcaagcgccgcgttgacccgtgccttgagtgcaggcaaggtctcggcctcgaaccaaggattcctgctcatccatagctggttgcgcggcgacggatgcaccaaagggaagaatccccggccgatataggcatcataatcgcgcaccacggttgtaaggctgtccgaattcttgagatgcaggtacctgcggacggcatatgcgcccacaagcacagtgagccgaacattgggcatgagcgccaagagtgcaggatgccactgctcggcgaatcccttgcgcggcggtagatcgcccgacctgccatgtcccggaaaataaaagtccatggggagaagcgccacccgctcaggatcataaaacgtctcgcgagaaacacccagccaatcgcgcagacgctctcctgacttgtcgttccaggggatgcgcgtctcttccgccaccgcgcctggtgcctgcccgatgaccacgatgcgagcgccagccccgacggagtagagcggatcgatgccgcgcttggtgtagtctgcattcgccccatcagcctttatggcattaaaaatcgcaaggaaatccttgtccatgtcgaaaccatctccttggtgacatgcgccgttcatgcatattgattactcgtttcccacaaatataccttgcctttgctctgcagggtatatcgtaggaaatcatcctcatgtagtaattcccgcatagccgcatatcgtctttcaagatttttattgccaatgtgcatcacaaagcactacgcctaactggattaaataaatactcaggtttcaaccgtcttgcaagcgtagcgttaccgcgaaccactctctataagcacccatggcgcccatcgtagataacaagccgaaagaaggagaacgcggtccggacgacctatttcaagcctctaaaggagcaatcctttcggggcttttctattgtccgaaaggaggcggcacgcatgccgagaaaaccaagacgcccctgccgccaccccggctgcccgaacctttgcgaggacggcgagcaatactgtgagaagcatcgcaaggaagcggagcggcagtacaagcatttcacgcgcggctactccgcgggcaagcgctatggcaggcagtggaagaagatccgcgaccgatagaagaacattggcatagtccttaaagtgaaatccccttatgaggtcagacacatctggcagcgggacaccataggacgccgccacatacgttagatattcccggaatgtgaaatactgaaatgactgatcttccgctgcccctagatccagtgcaaatcagaaagtaaggggtgatctgcggtgtaccagacgcttaaatggttcaaggaaagaagtgccttgctgtccattctgcattacctccgattgtttttgtctttctcccagagcgaataggcggagaacaggagcacgccgccgaggaaaatgtacagcaggacaaacgggatgttcatggtaacgaaactgtaaatcatgcagacaataaaacgcaaatccattcttcgcgtggccgacggatacgggttccatccgatcagtaagttcggcaaacgaagcatcccggagttgaccggatgcgctgcggggcatgtggatgcatgttggttgtgatgggccggttggaggatattccggccgattatgagggtcgtttgggcgtccccgttttcttgaaaaacctgtcgaataaaaacgaccttactgagccgcctatgccttgtgcatggcgataatatgctctatctcggcaagatccgaagcgaaatagataccatgctggcgttcccctgtggagaagccatcgtcgatcatgcgctgcagcaacgccttcatgtcatcgtagaaaccgttgagattgtagaaaatgcaaggctgcgtcaactggtcaaggcaaaccttcgacacaacctcactgatctcctccaacgttcccgtgccgccggggaaggcgatgaacacgtcgccaagctcgatcatgcgagtacgccgttcggtgatattcggcacgatggtgagctgggtcagattcttgtgcgcgacacccttgtccacgaacatctgcgcctcgatgccggtcacctcgccaccctgctcaagcacagtgtcggcgatgactgccatcagcccctcgttggaaccgccatacaccaaacggtgcccgttctcggcaatccatatggccagctccgccacggcctgcttgtatacggggttgttgccttcgtgagctcctaaatacaccgtgacgttcatgcttgtacctccaacattcatgggatgatgtcgcgcgcccaaccgtaatcagacaataagtcagataatcagtgtaacgaaccgatgttcgcaaaccaatcgaaagcggtgagacacactcgcaagctgtgcatatctttcatggatgtgcaaaagccccgtacccgacctgccaaattcatgacatgtcgaatacggggcaaggcgaagggtgacgatcctgctgtgacaaatcgctgccgttgcacaacacttttccctctgtgggattcgcaagcccggaaatcagtaacagcatagtggttttgccagcgctggggcatcgctctgtgcgttgccggactgctgcgaatccggagaattgttatcggtattggaatcctgcgagccggcagagtcgctggaatcatttgtcggaccctgcatatcgcgaccggactgcgccctctggctggtctgctgcgactgctgatggaatgaatctggaaagttttctgaattaaaaacgcgacatggacggggcattcattgcggcaatggtgttaggctaacgcgtatgcctataaaatccgaagtcattgcgaaccccaagtcggagcgcgtccgccgcgtgtccgagctcgccgatcgaaaagggcggaaacggtctggccgtttcatggtggaaggcccgcaatcggtgcgcgagctgctgacatggcatccaggacttgtcgaggatctctacgttgaggtcgagtcggcacagcccgatgcctcgtttgcgacacctgtcgtcgcgcagatggcgggcaaggccatgcaatccggcgtgtatgtgcacaaggtcactcatgcggtgatgcaccgtatgagcgccgacgcgcaaggcgtgcttgccgtcgcggacatgcaggctttcctcgattcgtccgccgctccggacgatttcgacgagcatgcgatggtcgccgcgttttggcaggtccgcgatcccggtaacgccggaaccgtgattcgttccgccgacgcggccggctgctccgccgtggtattggtcgacgactgcgtggacgtgttcaatccgaaagtgatccgctccaccgtgggatcactgttccaccttccgattctgaccatgggaacggacgacttcttcgcatggtgcgatactcacgagttgtcagtgtatgcggccgatgtatatggcacggattcccggcagccggaatccctgacggatgtaatcgctgcgccggaaacgcttgccggcgccaaagcggtgttgttcggcaatgaggcacgcggattgaccaaggaagttttggaacgaaccgataggatcgtgtccataccgctctatggcaaagcggaatccttgaacctcggcaccagttcggcggtaatgctgctgagcttggctatgtcgagtcatgttgaaagaatgtaaagtcggaaaacgttgaaattgcgcgtttttcgcgtaaaacaaacgggaaatgagaaaggtatctcgtggcagaaggtgcggtattcgacgcccaagcggtaaccgatgcggttgccgagggcatcgcgaaaatcgaaaacgcctccagcatggaggaattgaaagccatcaagacgcagtacgccggagcggaatccgcgatgacgcaggccagcaaggccatcggcgcgctgccgaaggaccagaagaaagacgccggcaagatcatgggcaagctgcgcgctgactttggtcgtgcgtatggcaccaaggaacagcaggtcaaggccgaggaagaggcccgtgcgcttgccgccgaaaccgtggacatgactcttccggtcaatcgcaagccgcttggcgcgcgccatccgttgccgaaactgatggaggatgtcgaagacttcttcatttccatgggctggcagatttccgacggtcctgaagtggaaaccgaatggtacgactttgacgcgctgaacttcggccccgatcatccggcacgccagatgcaggataccttctacgtcaagggcaatcaggccaaggacgccgcaggattcgtcggatccaacatggtgctgcgcacccagacctcctccgatcaggtgcgtggtctgctcacccgtggcgtgccgctgtacatcgcatgcccgggccgcgtgttccgcaccgatgagctcgacgccacccatacgccggtgttccaccaggtggaggctcttgcggtcgacaagcatctgaccatggccgacctgaagggcgtgctcgataagcttgccgtggccatgttcggcccggaagccaagacccgtctgcgtccgagctacttcccgttcaccgagccgagcgccgaactcgacctgtggttccctgacaagaagggtggcgcaggctggctcgaatggggcggctgcggtatggtcaacccgaatgtgctgaagtccgctggcctcgatcctgaggtctacaccggcttcgccttcggcgtgggcgtggaacgtaccctgctgctgcgccacgacatcaacgacatgcacgacctggtcgaaggcgacgtgcgattcagcgaacagtttgtgatgggggagtgattgacccatgccaatggttgacattgattggctcaaggaccatgtcgaggttccggaaggccttacgtacgaacagcttgccaaagatctggtgaaggtcggtctcgaagaggaagagatccacacctcccagctggtcggtccgatcgtcgtcggctacgtggtcgacgccactccggaaccgcagaagaacggcaagatcatcaactggtgccacgttgacgtcggcgacgaatacaatgagaccgatgagaacggcaacaaggtgccgcgcggcatcatctgcggcgcgccgaacatggctgccggcgaaaaggtcgtcgtaacgcttcctggcgctgtgctgccgggcgatttcaagatcgaaccgcgcaagacctacggccatatctccaacggcatgtgcgcttccgaacgcgagcttggattgggtgatagccatgacggcatcatcctgcttcgcaagtacggcttcaccccggaagagtatgagaagctccagccgggtgacgacgccatgcacctgctgcacttggacgagccgctgctggagatcaacatcactccggatcgcggctacgcgttctcataccgtggcgtgtctcgcgaataccatcattccaccggtgcggcctacaccgatccggctgtcgccctgaacgagaaggcgccgatcactaagggcctgccggaaggcaccaagaccgacatcgaagtgatcgtcgacgacaataatccgattcacggtgtggttggatgcgatcgctattacgctcgcgcggtcaagggcttcgatccggccagccatacgccgaattggatgcgtcgccgcctgacccgcgcaggcatgcgttccatctccttggcagtggatgtcaccaactacgtgatgctcgacttgggacagccgatgcatgcctacgatctggataagatcgaaggaccgatcgtggtgcgtcgcgccaacgaaggtgagaagctcaccacgttggatggcaaggatcacgatttgagcgtcgaggatctgctgatcaccgattccccgaatggcgaacgcggctcccgtgtgcttggcatcgcaggcgtgatgggcggcatgtatggcgaggtcactgccgaaaccaagaacatcctgctggaatccgcgcacttcgatcaggtgtcgatcgcgcgttccgcacgccgtcacaagattccgtccgaagcctcccgtcgtttcgaacgcggtgtggacgaccagctgcagccggcagccgcccaaatggccgccgaactgatggttaagtacggcaatggcgagccgagcgagcacccgaccgacttcaataccgtctctaaccgccgtccgatcctgttcaaggcttcggaagtggctcgtgtggccggacttgacacggacgtgaacaccatcagcgacattcttaccgacatcggttgctccgtcgcaggaggcggcaacggcgagttttccgtggcgcctccaagttggcgccccgacttgaacgagccgtgcgatctggttgaggaagtggcgcgtcttgtcggatatgacgagattcccgtcaccgtgccgccggcaccggtcgaaggtcaggtcggtctgactgctgagcagctgcgcaagcgccaggttgccgatgaacttgccgaatacggcatggtggaaacgttgagctacccgttcgtcggcgatgaggattacaagaacttcgcgctggacgtcgctgagacgaagaacgtcagcgtggagatcgccaacccgctcgccggtgatcgtccgttcctgcgtcgtgacattattccaacgttggcacagaccgttcagcgcaatctacgtcgcggcgtggagaatgtgtcgctgtatgagatcggccacgtgtatctgtgggatccgaacgctccggcgattccggcactgccgggtgcagtcaagccgacggacgagcagcttgccgcgcttgatgccggtcttccggaccagccgatgcatgttgctggcattctgaccggcaacgccgttgactccggttggctgggcgagcgccgcgcagtggattggtctgacgccgttgaggcggtgcagcgcatctccgaccgtattggtgcagctctcacgctggatcagccgaaggctgaagatgtgccggcacaatggcatccgggtcgtgcggctcgtgtgatggctggtgacgtattcgtcggtatggtcggcgagcttcacccgcatgtcaacgaggtgttgggcttcccggcccattccgcggccttcgagttggatttgaccgcgctgttcgccacgttgagcggcaagccggtgcaggccaagccgatttccaccttcccgccggtcaagcaggatctggcctttacggtgtctaccgatgtcacggtcgccgagctcaagcaggttattgtcgatgccgctggaagcagcctcgaaagcatcgagctgttcgacgtgtacaccggcgaccagctgggcgaggacgaaaagtctttggcctacgcggtcacattccgcgctccggataagactctcgcttccgaagacagcgaagccatccgcaagcgtattgtggatgaagcgtccaagctgggtgcgcagctgcgcgcctgatcccgaccttcccaagaacagaggatgattatgaacgaaccggagcagtatcagccgaccaacaccgacgaacgtcaggagacggctgatgctgctccggtttcgtcatcttccgatgccgctgcgtcttcacagccggagtatggtcagatcaatcaacccgaatatggtgcgatgagtagccagctgccggccggttacgatccatacgtgtatggtgcgcctgaacctgaaccgcaacctgcggatgctgtacagcagcagaatatgcaataccaaacggggcaatacccttcaaatgggcagcaaccgatgcctccgtacaatgcgaacggacaacggaatccatacggcgccaacccgtatgggccgaatccgtatgatccgaaccaatatccgcagcagggcaatatgccctatctgccgaatctggatctcaacgatcctcggcagaatcccgcatacggccattgggatgcctatgcgatcatgtctctcgtgcttgccgtgctgatgccggtgccggtccttcccgcgttggtcggcgcgatttcgatgtggcgtaccaagaagctccatatgaaagggtatggcttggctctcgccgcggtgatcatcaatgtgttgtacaccttggccgtgatttggttggcgatgcatggtctttccgttgccgacctgtataacgagacgttgcagaatatgcttggcggcgcgggatcggggcagggagacgagtcgatcgctgcctgattcggcgtgttttctagtcctttaataattgtcatagtcgcgcaatgaccactatgcgacacgaaatgaatgcataattatgcaatgtagtgcataaagtgtatgctgaatgtgttttcagtgagtcaatggaaagagacgtgacatggccaaatacacagtagccgtggccggcgcgacagggtatgcgggaggcgaggccctccgtatcctcgcggcccatccaaatttcgaagtgacgtgcgtggccgggcattcatccgttggggacaagcttggcaagcatatgccacatattccgcagcttgccgaccttgtggtggaagacaccactccggaggtactgaacgggcatgacgtgatcatccttgcgctgcctcatggggcatccggtgcattggcttcccagcttgatccgaatgccgtggtggtggatttgggagccgaccataggcttgaggaaaaaaccgcatgggatgagttctacggcggcgacttctatgagcactggacttacggcatgcctgagctcattaccggcatatccgaagatggttcttaccagcaccagcgtgaggtgattccaggaaccaagcgtattgccggtccaggatgcaatgtgaccgcaaccacattggcgctgcagccgggcattgcccaagggcttgttgaaccggcggatattgttgccgatctggtggtcggctactccggcgcagggaagaatctgaagcgcgtcaatttgcttgcagctgaggcattcggttccgcattaccgtattctgtcggcggtactcatcgtcatattcctgagattttgcagaacttcgcccatgctgcaggaaagaacgcatccgcggcaaacgagttcacgctgggattcaccccgattcttgtgccaatggcccgtggcattctcgcttcggtttccgccaaactaaccgatacagcattgaatatgtcagatgctgaaatcaggcaggtttggactgacgcatatgcggatcaggatttcatgattgttttaccggaaggcgtcatgccggccaccgccaatatcatcggatcgaacgcggcccatattcaggtggccatcgaccgtaaggcggggcgtttgctggccttcgcggcaattgacaatctcaaccgcggcacggccggacagacggtgcagtcgttgaacgtagcactgggacttcctgaagatgcaggcctgacaaagattggagtggcgccatgagcgtaacgtttgcgcaaggtttttccgcggctggcgtggaagccggtatttccgcagtcgaaggtaagaaggatctggctcttgtggtcaataacggtccgctggatatggctgccggagtgttcacttcgaaccgtttctgcgcagctcccgtgcagtggacgcgcaagatcgtggccgacggtcatgtgaaagccgtcatccttaattccggaggcgccaacgcatgcaccggccagccgggttatgagcaagccgaagccacggcacaaaaagttgccgaactcttgggcgcttcagccgaggacgttgcggtatgctccactggtttgattggtgaactactgccgctcgaccatgtgcttgccggtgcggacaaggcgtttgcggccctcgcaaatactgcggaagcaggagcggaagcgtcgcaagccatcatgaccaccgacaccaagccgaaaaccgtcgaacttgaagggtccaatgggttccgtgtcggcggcatggtcaaagggtcaggcatgatcgcgcctcagctggccaccatgctgtgcgtgatcaccacggatgccgtggtaagcgcgggacagcttcaggcagctctgaacactggagtggaaatgtcgttcaaccgcattgacgttgacggttgcatgtccactaacgacaccgtgcttttgcttgcgtctggagcatccggtatcgaaccggatcccgacgagttcaacgagcttgtggcgcaggcgactgcctccttggcacgtcagattgtcggagacggtgaaggcgcgagccatgacatccgtgtcaaggtgaccggcgccaccacggaagatgcggcgcttgcttgcggtcgtgcggtagcggcatccaatttgctgaaatgcgccatcttcggcaatgatccgaactggggtcgtatcgtcagctcgctgggtaccgtgccgccggaagtcgctccctacgattccaataaagtcacggtcgacgtcaatggcgtgcgtatctgtgagaacggcggagccggacgcgaccgatccgaagtcgacatgactccgcgcgaggtgcacatcgacatcgatctgcatgcgggaaaagcggaagcaaccgtctggaccgacgatttgacccacgaatacgtacacattaatgcagattacgaaagctgattgaacggtaatgaccaaggaactcaaaggacctggattccattttgacgtgcataccgatttgcgcgccgaccaaaaggcggaagtgctgatcgaggcactgccatggcttgaggaattcgccggacagcgcatcgtcatcaaatatggcggcaatgcgatgatcgacgatcatctcaaagcctgtttcgctgaagatatggtgttcctgcgacaggtcggcttgcatccggttgtggtgcatggcggaggcccgcagatctcgcacatgcttaaggctttgggcattaagtcggaattcaagggaggtctgagggtcaccacgccggaggccatggatgtggtgcgtatggttttgacgggcaaggtttcccgtgaacttgtcggattgatcaacgctcatggcccgttcgcagtcggtctttccggcgaggatggtgcgctcttttccgccatgcagcgcaagccgatcatcaatggctctccaaccgatattggtttggtcggtgacgtggtgagcgtcgacgcatccgcggttgaggatctgatcaatgccggacgcattcctgttgtttcctcggtggctccaaatgaggatgatgctaccgaagtgttgaatgtgaacgccgattccgcggctgcggcgcttgcggccgctcttggagccagcaagctggtcgtgttgactgatgtggatggcttgtacgccgattggccagacaaggactctttgatcggacgcatcggcgtggagaacctacgtgatatgctgccggatttggagagcggcatgcgtcccaagatggaggcctgcgtcagggccatcgatggaggcgtgccacgcgcccatatcatcgacggacgcaagccgcattccatcctgaatgagattttcaccacagacggcattggaaccatggtcgttcccgaagacggtattgaaatgaggagttcgtatggcaactgaacagttggaaaacctcggcagtgaggacgccaagtggctggggaagtactcccgggtgcacatgaacgtgttcggtactccgctgcgtgttatggaccatggagaaggtgcgcatatctgggacgtcgatggcaatgaatacctcgatttccttgcgggcatcgcggtgaacgcactcggctacgcccacccgaaatgggtgaaggccgtcagcgagcaggccgccaaagccgcccatgtgagcaactacttcgccacggagccgcagatcaaactggcgtcgaagctcattgagcttgcgggcgctcccgagggatctcatgtgtatttcggcaactccggagcggaaggcaacgaggcggcattgaagcttgccaaactgtatggacgcaccttgccgggcgcatcgcctgccattggaggcaaaccggcgcgtatcatcgccatgacccatggcttccatgggcgtaccatgggcgcgctgtccgcaacgtggaagccctccatccgagaagcgttcgagccgctggttcccaatatcgaattcgtcgaagctggtgacgaggccgcattgcatgacgcgtttgccgaaaccggtcccggcaaatatggcaaaggtcctgtcgccgccgtcatcatggagctgatccaaggtgaggctggcgtgcgtccgcttggggccggctatgtgaagaaggcccgtcagatgtgcgacgacaacaacgcgttgctcatcatcgatgaggtccagacaggcatcggacgcaccggatcctggttcgcattccagcgtgaggatcttgcgggcggagtggttccggatattgtgaccttcgccaagggcgttgcaggcggtttcccgatgggtggcatgatctccttcggcgccaagctttccgcactgttcaccccaggctcccacggctccacctttgcgggcaatccgctcggagcggccgccgcgatggccacgttggaaaccattgaggaagacggtctcgtggccaacgccgaggcacgtggccagcaattgcgtgacggcatcatggcttgcggcaatccgcttttcgtctccgtgcgtggacgtggcttgctcgacgcggtcgaactcgcccatccatgcgcgcatgcggcgatgaattgggcgttggaacacggtttgatcgtcaacgcggtggcgccagatgcacttcgtcttgttcctccgctggtggtgaccgaacaggacatcgatcaggccatctccatcctcgcgaagattccaacggatcttcccaacgactgaacatagccggcaatcaaagcagactggatatttttgaaaggagccaacaatggcaactcctgaactgcgccacatgttgcgcgatgacgatctcaaccatgaagagcagaagcaagtgctcgaactcgccatcaaattccacaacgaccgtttctaccatcagccattcgccggcccgcagggcatcgcggtgatctttgacaagccgagtacccgaacccgttccagcttctccattggcgttgccgaactgggcggctatccgctggtcatcgacaagtccggctcccagcttggccgtggcgaaccggttgccgacaccgcacgcgtgcttgaccgcatggcctacggcgtggtgtggcgcaccttcggccaggatcgtgtggaggaaatggccaagtattccacccatccggtggtgaacgccttgaccgatgaattccacccttgccagattcttgccgacttccagaccattgccgagcatcgtggcggcgtcgacaatctgaaaaaccagaccatcgcctacctcggcgacgcggccaacaacatgtcgaactcctatctgcttggtggcgccgtggccggcatgaacgtgcgtgtcgcagggccgaacggctatctgccggatccgcagatcgttgccgatgccgaagccatcgcatccgaaaccggcggttccgtgttggtgaccaccgatccgaaggaagcggtcgccggcgccgactgcgtgttcaccgacacatgggtttccatgggcgaagaatcggaatacgccatccgttccaagccgttctgggattatcaggtgaacgccgaactcatgtcttatgccaaggaagacgccatcttccagcattgcctgccggcataccgtggcaaggaagtcacctccgaagtcatcgacgggccacagtccgtggtttgggatgaggccggtaaccgcctgcatgcgcagaaggcactgctgacttggcttgccggcaaggcccgcggcgatgaaagcctgctggcctgatgacggaccaaacacctgcgctgcaacgtcctgccacacgggccgctcgattgagcgccatcgagcaggcgttgctgacgcgcatcgtcacctcgcagtcgcagctgtcccagattcttgcggatcagggcatcgaagtgacccaggccaccctgagccgcgatcttgacgagatccatgccaccaaaacccgtttggctgacggaaccgtggcctatgcgctgggcagacagccggaggaaagcgcgtcggccaatcctgatgcaaaaacggaacagcagatgaatcgtgtgctttcgggactggtcacttcggtcgctgcggccaggaatctggtggtggtccacacgccgtctggcgcggcccagtatgtggcaagtgtgatcgacaagcagtccatcgatggagtgctcggcaccattgccggggacgataccgtcatggtgatctgcgccgatgacgattatgcgaaacagcgtgcgcaatggctattggacgtcgtgtccaaaggctgaatagccgtatagtggacacgacgcaccgtatatgcataaatatacagagcattgcatatactgatgaataacgtttgatgttagaaagggaaaccatgagcgatcagaatcgtctcgtcttggcatattccggtggtctggatacctccgtcgccatctcatacctaaaggaacgcaccggcaaggatgtcgtggccgtgtccctcgacgtcggccagggtggcgaaagcctcgaaaccatcaagcagcgcgcgcttgcctgcggtgccgttgaagcgtatgtggtagacgcccgcgacgaattcgccaatgaatactgcatgaaggcgctgaaggccaacgccctgtatgagggtgtgtatccgctggtttccgccatttcccgcccgctcatctccaagcatctcgtgcgcgccgcccaccagttcggtgccgacaccatctcccatggctgcaccggcaagggcaacgaccaagtccgtttcgaggtgtccatctcctccattgatccgacactgaaggccatcagcccgatccgcgacctgtcgctgacccgcgacgtcgagatcgcattcgccaaggagcacaagcttccgatcgtgcagaccgagaagagcccgttctccatcgaccagaacgtgtggggccgcgccattgaaaccggcttccttgaggatccgtggaatggcccgaccaaggactgctactcctataccgacgatccggcattcccgccagtcgaagatgaggtcgtcatcgaattcaagcagggcattcctgtcaagatcgacggtcacgacgtcaccccgctgcaggccatcgaagagatgaaccgtcgcgcaggcgcacagggcatcggccgtatcgatctgatcgaggaccgtctggtcggcatcaagtcccgtgagctgtacgaggctcctggtgctatcgcactgatcaccgcccaccaggaactcgagaactgctgcctcgaacgcgagcagcaccgcatcaagcgcgatatcgacaagcgctgggccgaactcgtctacgatgcgcagtggttctccccggcaacgcagtccctgaacgccttcatcgaagacacccagaagtacgtttccggcgaaatccgcatgatcctgcatggcggccgcgccgtcgtgaccggtcgtcgttccgacacctcgctgtatgactacaatctggccacctacgattccggcgacagcttcgatcagaagtcgtccaacggcttcatcgacatctacggtctgccgagccgtgtggccgcagcccgcgacgtcaagttcggcaatggcatcgaggttccggaaaacagcgtcgagtaagcgagttttttacgccgaatcgtcttgataatgggggagagcgtaccgttaggaccatcctgactggtatcctctccctcagtcatatctgcaaggagaatgaagtaacaatgaccgagagcacaaccaatggtgaacacctcgccctgtggggcggccgtttcaagtccggcccgtctccggaactcgcgcgactgagcaagtccacccagttcgattggcgtcttgccgacgacgacatcgcaggctcacgcgcccacgcccgtgcgctcggacgtgcgggactattgaccgccgacgagctgcagcgaatggaagacgctctcgacgagctgcagcgccgtgtcgattccggtgcgttcgctccgatcgaagacgatgaggacgaagccaccgcattggaacgtggactgctgcagatcgccggagacgagcttggaggcaagctccgcgccggccgctcccgcaacgaccagatcgccgcgctgatccgcatgtggctccgtcgccacagccgcgtcatcgccaaaatgctgctcggccttgccgcaacactgaccgaacaggccgaaaaggccggacgcaccgtcatgccggggcgtacccacatgcagcacgcccagccggtgctgctcgcacaccagctcatggcccacgtgtggccgctgctgcgcgatgtggaacgtcttgccgattgggacaagcgcatcgatgcaagcccgtatggttccggcgccctcgccggcaacaccctcggcttggagccggtggccgtggcccgcgaactcggcttctccaaggtaaccgcgaactccatcgacggcaccgccagtcgtgatctggtcgccgaattcgctttcatcgcagccatggcaggcgtcgacatcagccgactgtctgaagaaatcatcatctggaacacccaggagttcgcgttcgtgcgccttgacgacgcctattccaccggctcgtccatcatgccgcagaagaagaacccggatattgcggaacttgcacgaggcaagtccggccgtctcatcggcgatctggctggtcttctcaccacgctgaagggcctgcccaccgcttatgcacgtgatcttcaggaagacaaggaagccgtgttcgaccaggtcgacacgctggaagtgctccttcccgcgttcaccggcatggtcggcaccatggtcttcaacaaggaacgcctcgaagcggaagcgccgaccggtttcgccctcgccaccgacatcgccgaatggctggtaaagaacggtgtgccgttccgccacgcgcacgagctttccggtgcatgcgtgaagatcgccgaagaccgcggccaggaactgtgggacctggccgacgatgacttcatcgaggtcttcaaggaattccttccggccgacaaggctcccgaagtgcgcgaagtgctatccaccgaaggttctgtttccgcccgcaatggcaagggaggcacgtctccgctgcgcgtgcgcgagcagatcgtttccgcgaaaaccgccatcgaacagctgcgtgccttcgccaactccgtcagcgacggcccggcatacaagacgccggaatcattgctcaaataattacagcaacagtacatagcaaaggcaaagcggtgccactgacacgaacgcagatacagcagcttgttcgacttcacggccaggagatactgtgccatgagcatatgcagatcgaaagagtctgttaccagcatggcgtggtcaccacgtttgctcattccatccgtgtggcttgtctggccgtatggatcgctgacaggctgcacttatggcatagggtggatttgcattcgttgattcgcgccgctctgctgcacgattattttctttacgactggcatgcgcatgatggcggccgtcatcgtatgcatggtttcacccatggtggcaccgccatgcgcaatgccgtgcgcgatttccatctcaatagagtggaacgtgacagcatcgagaatcatatgtttcctttgacgccgataccgcctcggtatcttgaagggtatttggtgactgtcgcggataagatcagcgccacacgggaaacggtcagtcttgagcgcttctacaagccgaaagtcaatatgcatacaagtggaaagtgacggcgcgaaagcatgctcatgctggaatacctgttcttatggttcctgttctattcatttgccggatgggtatatgaatcgattctcgtgtccgtttcggaacgtcgcttggtgaatcgtggcttcctgaatggtcccatctgcccgatctacggttgcggagccgttcttgcgattgtgctgctgcatgatctgcataatcctttcgcggtttttctcatttcttcaatcggtgcatgcatgcttgaatatgtcacgtcatggggcatggaaaagctattccacgcacgatggtgggattacagtcatcgccgattcaacattcaagggcgcatttgcttgcttggagcgattgtggtcggtctgctgggtgtgctcatcaccgatgtgatacagcctgaagtgaatcgcattacacagatgattcctttgccagtagtgcactggatgtgcgtgattttcatggcgtttatcgtcgcggataccattattacagtgcttggcatcatcgatttggccgacaatcttgcgaagttcagcgaaaccgtgcaggcatatgcggagaaagccggtgattccctgcaatggggcaaagacattttccgagacaaattccgcgacaaggtgcaagacaaggtccaggattggtcggactcctcgcaggagattcttgccaatatgcaggccactgccgcatctatcctgaacaagcagcagcgtcgtatgattaacgcattcccgcgtctgcgtttcacggattccatcaaatacagcaagatcatcgaaactctgcacgaaatgctgcgtcgcaaataatcgcgcgataagcaacagcatgaaatcgcctgccgctcgaaagaacgacaggcgatttcattattgtttgcgatatgcgatttgcatgacaatcacgctatgacagtccatcggatcatttacggatttcgtatggagtgggcgcttccagcgacgtgtccgatcccttgtagtcggtgatgcccgcaccgacattcggatgttgcgcggaatacacttggtcggcgcaatacagcacgagcagcacggcggccacgatgccaagctttcgcgcatcgattctgctgagcaggttgtcgagggccggagccagcagatatacgatggccaatccgccaaggccgaacgtcaataatccttcggcgcagatacggccgttgatatttagaaagtatccggtgtaatcccaccagcgttgaccatcatgcgtcatctccagataccacgatgagaagtattccaagcagccgcacagcaccatagccgcgacgaattcaagcgctggcttttcgcgcagctttttgagcagaaccagaatgatcactccgccggtgccatagatgggcagccaagggccatgcagcgtgccacggttcacgaacatgtcttcggaaataaatgcgagacttacctcccacacccagccgacgaagcaaaagatgaagaacatcatgatcagattgaccagtgagtagctgtggtcggcgctgatggtacgtgattcacggaatttgaacggcatcggagcaggcgcaagacgccccggataaatggagccattcagaatattctcgccgatctgcatctggtgaagatcctcacgatactcttcatagcggttcactgcgctggcatgcagaatgcggatgccaagccactcagaaagaaatcctgtgaatccatgcggcttgggcgctggaacaagattctgttccagctgtgctacggattgggcgacatcggcgtacgtggtatggagcgtctgcgggtcggccttgaagtacaggtattcgtcgttgagcatctcactgcctgcaatgccggtagtcttggccatcgaacgcacgtacacatagtattccgcgaagaacgcggcattgtagccattggaatagaagatgccgctcaagccgaaggtgataaggttgagcaggtaccagccgaggaacgagcagtccgccacgaagcattcccatttatgccctttcatcatgcgtcgggacaagcgaatggcgtccaaagcctcgatattcggattctccgcaacgatgtacggcaccatacggtaggaatattgcttgatgaagaagccgacgatggtgagactccaaaggaacaggaacacgttttccacaaacatggtccatgccatgcgcggccatttgcgcgtgtgaatggggtagaagaagcgacttgccggaagcttgttataggaacgtccttccaacagcatacgtgccatgacgatgcggtatgtttcttgaatgaacagccagacgaaaatgtagacggccagcgagagtattaccggcacggcgatggagacgccgccgttatgggtgacggaattaatggcgtcggccacggcgatcaccatcgagccggatgcaaacgagttgagcagggacgcgattactccgcggcgacggccgaacgtggcatcggtatcgttgttgacgatctgctcttggttttgcttgaccttttcacgggcatcgttttcattgcctacggcaagatcctgcaatacgtcatacatgtcgttggattgcgtggaatcctccgtttgcggggtgctgatcgaaatgttggtgctgaccgagagcgtcgatgaagtgtacgcaacaccgaacaccgaagcgaacaggcaaatggcgactatcatccaataatgttttctctgggctttcttagccgcaaccttcatgcctttgcggtccatgcaggtatctcccttcttgatatggggatgctccttctaactttacccgtatgcacgatggttggtggatgatggggaaacaccgcgtgcgcctgtcttcatcttctgcgaaactgtagggtgcgtaaaacgcagtatcatccgcaattcaatagggagaaagcacagctatggctcacgtcatcgatttcaaggaggccggtttcgagtccgtcctcgatgaactggaatggcgcgggttgatttcccagtccactgacagggatcgactcgccgaagcgttgaacggagatcccatttcctattattgcggtttcgatccgaccgctgcctctctgcatatcggcaatctggtgcagctcatcaacatgcgtcaccttcaggcagcaggccatcatccgattgccctggtcggcggcgccaccggcttgatcggcgatcctcgccaatcgggcgaacgtacgctcaatccgaaagacgtcgtggctggttgggccgagcgtctgaaagcgcagatcggcggcattctcgaagtggaaggcagcaatccggtccgtttcgtgtccaattacgattggatcgcctccatgaacgtcatcgacttcctgcgtgacgtcggcaagaacttccgtttgggtaccatgctcgccaaagacaccgttgcccgtcggctgaattctgaagatggcatttccttcaccgagttcagctaccaggtgctgcagggcaacgacttcctgcacctgttcgacgaataccattgcgtgcttgagcttggcggatccgaccagtggggcaacctcacgtccggtcttgacctgatccacaaggtacgtggcgtggatgtgaacgtgttcaccagcccgattatcaccgacgctcagggtaagaagttcggcaagtccgaaggcaacgccgtctggcttgacggcactatgctgagcccatacaagttctaccagttctggttcaaccgccctgacagcgagatggagaacctgctgaaggtgttcacgttcttgccgaaggcggagatcgaacgtcttgtggaggaaagcaagaccaatccgggcgcgcgtgaggcgcaacgcaccttggcttgggaggtcaccagcctggttcatggtgaggaagccacccgacaggccatcgaggccgccggtgcgctgttcggccgtggcggcgatcttgcgggcgttgacgagtccacgctcgaagctgctcttgacggcgtgaagatcgacggcgagttcgccaaggccgcggtgggcgaccgtgtggcggaagccggcatgaaggccggactgttcaagtcgatttccgaggcgcgcaagacgattaaggctggcggcgtgtacctgaacaacgcccgtgtcgaagacgaagagcaggttttgaacgaaaatgacttcctgcatggacgtttcgcattgattcgtcgcggcaagaaggccctcggcgtcgtcgaaaacgtgtgaggcaatcacgagcggcgcaaacaaacgtaaacaaagaacaaacgaagaccattttcaaggaatacaaggaatataaggaacagcatggcagaagaacagcgcggatcgcgcggcaagtcctacggcaaccacaagtcctacggctcgggcaagccgggcgatcgcggcggcaaaggattcaagccgcgtggcaatggcggcaagtcctacggccacaagtccggcagcttccacaacgacgatcataagggcggataccgcaagggcaatggcggcaatttccaccgcgaccgcgatttccgtcgtgacggtgagggggaaggccaggagcgccgcttccataacggtccgcgcaagttcaaccgtgacggcgagcgtcgtgacgatcatcgcgattatcgtggcggtcgtggagacaatcctcgctaccagcgcgatggcgagcgttccggtttccatcgtgacgatcgacgtgacggaaaccgtaaagacttccaccgtgatggcgatcgccgtaacttccaccgcgacaacgatcgcagggatttccatcgtgacggtgaacgccgcaattaccgtgatggcgagcgtcgtgacttccgtcgtgatggcgatcgtcgtaacttccaccgcgatgaccaccgtggcaatgatcgtcgtgatggcggccgccgtaatttccgtgatggcgatcgtaaggatttccgtcgtgacgatcagcgccgtgacttccacaaggatcgcgaccagcagcagggcgaggagcgtcgtgagttcacccgcgaagagaagatggcctaccgtgaggagaagcgtggcgagtacatggccaagccgcgccgcaattccgatggcacggtgagcttcccctcgcagaacccgtacacgcatcgtcgtcctgatgagccgaagatgccgaagggcatcgaatggcgtatgctcaccaccgacgatcgcgaacgcctgcgtggcctgtcgaaggaacatgcggaaaacattggtctgcacattcttgccgcgtacacgcttgaggagagcaacccggagctggccctcgaacatgccaagtgggtggcccgccaggcttcccgcatcgatttcgcccgcgagacactcgccttcgtggcataccgtcagggtgattacaagcttgccttgcgtgagttccgcaccgcgttccgtatgaacggtttcctggattatttgccgttcatcgccgactgcgagcgtggcatgggcgagccgaagaaggccatcgaagtggctgtgagcgacgatgccaagtatctgcgcggtgaagccaaggctgaaatgttcttggtgtacgctggcgctctgggcgatctgaagatgtgggacaaggccatcgagatcgtgcacacgctgggccgttccaagggattggccggcgaataccgcatgcgtgcggtgcaggccgaacagtatttccttgaagaggccggccgtaccgatgaggccatcgcattggatcgtctgctcgacaagctcgaactgcagtacgccgatgttgaggatgatgagacttccgacgatctggttgtcgaatacgacatgcaggagctgaacgacgaactcatggacgtgcttggcatttccgaagatgacgcgcagtacgctccggaagaccctgagaatgaggaagacgaatccgaagccatcgacgagaacggcgaaaccaacgacgaaacccagcttgaggccgaagagacggaagcaggcgcggaatccgatgacgagccggcagaagctgacgatgctgcggaagatgacgccgatgatgacggtgaggctgaagaggccgaagagtcttcggatgcttctcccgaatcctccgaagataacaagtgaggtgacgtggcccgcatgctgaagtccacgaatcagccgctcagcgaagcatactcgctggcactgcttgatcttgacggcgtggtctaccgtggtaagaacccggtggaacatgctgccaagaatatccgcaaggccgaatccttgggcatgacggtggaatacaccaccaacaattcgtcccgacttcaggccgtggtggcagaccagctgaaggggttcgatttggatgtcgaaccctggcaggtcatcacctcgtcggttgtcgccgcgcgcatggtggcacgtgccgtgcctgaaggttcgaaggttttcgtgcttggcgcccagcatctgcgtgaggaagtggccaagcaaggtcttgaagtcgtcgattccgcagaagcgcagccggtcgccgccatccaaggatggtatcccgacatgtcttggaacgaaatggcccaaatcgcctatgccgttgagcatggcgcgacctatttcgtgaccaatcgtgatctgaccattcctcgtgaacttggcatcgcgccgggatgcggttccatgatcatggcggtgatcaatgccaccggtgtggaaccggtttcgtccgcaggcaagccggaatccgccatgtatgacgaggcgcgcattctcgcagcccatgatgatggcgagccggtggacaaggaacagtgcctcgccatcggcgaccgtctcgacaccgatatcgaggcgggcaatcggggcgggtacgattcccttgcggtgttgaccggcgtcaccgatccgcgcgaactcatgttcgctccggcgtatcttcgcccgacctacatcgccaaagatctgcggggcttgaacgagcccgctcctgaagtggtgcatgatgagggcgcatggctgtgccgcgatgcgaaggcccgcgttgacggcgaccgcctgtatgtcaccgacatcaccagcgtcgacgggttgcgtgccgcatgctgcgccatgtgggccgcggccgacagcgggcgagatgtgagtagcgtgatcgttccggaattccgtatttcctaacgaacaattcgtaccgattattggaaaaccattgcgaaacagtgattccactcaggttgttcgtcttgacgttgcgttgttggaacgtggtctgaccgacagtcgttccaaggcgcaacgtctgatcgcggatggcaaagtcagtgtgaacggtgtcaccgtcaccaaagcatcggcgaaagtcggtggtgatgacgtcatcgccgccgataggggagacggctacgtttcccgtggcgcatacaagcttgtcggcgcgttcgaacggttcgccgacgtcggattgcgttccgcgcaaggattacgttgcttggatatcggcgcgtccaccggcggtttctgcgacgtgctattgcgcaatgatgccgcgcaggtcatcgctttggatgtcggccatgggcaattggatccgaaaatcgcgcatgacgaccgtattatcgaaatgagcggcgtcaatattcgcgacgtgtatgcggaggatttgccgtatcgtccggaaatgattgtttccgacgtatcgtttatttcgctgacatatgtgattccggtgatcgcaagaatcgccgcaccgcaggcgcagatcgtgctgctggtcaaaccgcagttcgaggtcggcaaaggcaaccttgggaaaaacgggattgtcgaaagccaggaattacgcgaacaggcgctgtcctccgtcgtggcatgcgcggaacgcaacgggcttgacgtgcgcgccacaacagtatctcccattgaaggcacgcatggcaatatcgaatatctgctgtacgcggtcatgcagtgaaacagcgaccggttgagagaaccgtgtctgcagtgtaatcaaggcaaataagataagtaaaagaaaaaccggaaatcatgattatgaaattccggatttttccatatggaaagagcgtgtcagctgcgtaggaaccggtcgatttgattctgcttgcccatgatgatgagttcgtcgttgcggtgcatgatgagctctttcgaaccgtattcgaattccttgcccggcgatttgatgccgaccacggtaatgccgaagcgttcatgcacgcgagcgtcttcgattgtgtagccgaccacatgcgcgggggtatggattttgacgacgttgtatgcgccttcaagctcgatgtagtcaagatagttgccggacacaagatgtccgacgcgtttgccggcgtcggtttccgcgttgatgatgtggcgtgcgccgatgcgttgcagaatgcgggcgtgttccttcgacacggacttggcccaaatgtcggagatgccggcgtcgagcagattgccggcggtaatgacggaagcttcgacgctgtcgccgatagccacgacggccgtgtcgaaatcggatgcgttgatctgctccaacgccatcacatcggtcatgtcggcctgcacggtgggaatctgcgaagaccaacggttcaccagttcgccgtctttgtcgacggcgagcacatcctggcccatcatgtcgagcgtggtggccacagagctgccaaaacgccccaaaccaactacgagaacgcttctggtgttgttggccatgatgttatgcacctttcgaaattccatcttcaaaaatctatattcatgtgtgattgcaggcaactgtaagtatatgaagccgtatcgtcagccgaccacgatctgctcggtggggtagcggacggcctcgagattgtgtggacgcgaaatcgcgtaggcgatggtgagcggtccgagacgcccgatgaacatggttgcggcgagaatgtatagcaccgtggggctgctttcactggctacgcccaccgagtagccacccagtccgaacgcggagcaggtatcgaacagtgcgtcgcacagcgagcagccggtgatgatcatcagtgccatcgacaccacggtgaccagcatgagacatgccgtgcttacggccacggcggtcataaccgcctgcgtgtggatgcggcggtggaatgcgttgatgtcgtggcgtccggtgaatgcggcacgacaggtcagcagggtcaccgcgaacgtggtgacgcggatgccgcctgcggtcgaggtgctgccaccgccgatgaacatgacgatggacaggaacactttggttgcgtcgctgacgcctggcatccacgacaggtcaaatccggagcttcgtggcatgacggccgcgaccatggcgtgccagaggcgcggctcgatgccgtttccggcgaacagcagcttgttgttccattccatcagcaggaaccacgtgaacgaggcgatcacaatgcagaacgtggtggtcagtgtgagcttggtgtgcaggctccaacgcttcggaggacgacgcatacgccaggaacgcatcaggttcagcaataccgggaagccaagggttccgcagaaagcactggctaggatcggcaggccgaccgcccagttgttgacatgcagaccggcgccgtcgggggtgaagccggcgttgttgtacgccatgaccgcgaagaacagcgattcccacaatgtgtggcgcacattaccgtggttgaccttgtagaggccggggaacaatgcgacgaatgtgatgccttcgatgacgaatgcggtggtgatgactacggtgagcacgcctttgatttcaccgagcttcgtagtgccgagttcgttggcggtcagcatgcgctgcgtggccttgagatggtggttcacggccaatgcgatcaaggaggcgaacgtcatgacgccaaggccacccatctgcacggcgaagatgagcacgccttggccgaaggtggtccaatgcgtggtggagttgacgatggagattccgcatgtggaaatggcggatactgcggtgaagaacgcggtggtgaacgtggtggtttcgtctttcggcgtggcaatgggcgtcatcagcaacgtagtggacaacgccgcgagcgtcagaaagtagaagatggtcagacggcctggatggttgacgagtcggcgcgtgaggccgcgcttgcgtggcttgcggtcttccgccatggccttctcgaaagtatctcccgagaaccaccatgcgtagccatgtgaggcctcacgattggaggaggactcgtcaaagacgaggtttgacatgccgttcctctctccttttcttacgatattcggtcttcgttcctgtgagctattgtaagcatatgtgcgactaacaggctatttgacggctgacattcctgattcgtggcttgcatcggagacggatttgaggcgtgttcgcgggttttggcatgttttcgacgcgcattgccggttttcgttcatttgttcgattacactggaggtcggtgacgtcttcatgggcgttttccatagggcgtttccttttgctggaaagggattaacgatgttcggtacccgtcatgcggtggtggtgacgcatagtcgtctgagggagagtggcacggtggttgaggaggctgtcgggcagctgacccaggccggtttcgaagtgtcgatcattgacaatatcgaggcgccggatttcggcaagcagccgccggtggtttccgaacgcactgagatcgtggtggtgctcggcggggatggcaccattcttcgagcggctgaactggtgcactgcaccagtgtgccgattcttggtgtgaacttgggacatgtcggctttttggcggagtttgaaagcttccagatgagtgaggcgatccgcagggttgccgagcatgattattccattgacgaacgcatgattgcgcatgtcgacgtgtggctgccgggagcaagcgagccgattgaggattgggcgttgaatgacatcacgttggagcgtgcagaccgtggcaaaatggtcgaactgtcgattcgtgtggatgatgtggaaatgagctccttcggctgcgatggcgtgatcgtgtcgactccgaccggctcaaccgcatacgcgttctccgccggaggaccgatcatgtggccgaacgtgaaggcgttgcagttggtgccgttggccgctcatgccctgttcgcgcgccccttgattattggctccggttccacattcgccattgatatccttgaggattccacgtcggatggttggatctgctgcgatggccgtcgccaatgcgcgttgccgcggggcactagggttgaggtgcgcgaatcgaagagcacattgcgcctggcccgtctttccggcgtgccgttcacgaatcgtctggtcacgaaattcgatcttcctgttgtcggttggcgcgagcaggcgcgtaaaaccgggggagtgcatcatgggcatgtgtttccggaagataaagaaacgaacgagtaaaaacactgatgcttgaagaacttgagattcataatcttgggccgatccgttccgcgctgatcgcgcctgccggcggtatgacggcgatcaccggtgagacgggtgccggaaagtcgatgctgctcagtgcgattcggctgatttccggcggtccttccgacggtgggcgcgtgtcggtcggagcgaacgaggcgtgggcgcagggcgtgttcgaggtcgcctcgtcaccggccgcggtcgcagccgcgcacgaagcgggtttcgaacctgaagacggagaactgttcctgtcgcgcaagatgcctgcctccgggcgctcccgcagcatgctgtctggtcgtagcgtgcctcgttccgtactggggtcgatcgcagcggagctggtgacgattcatggtcaggcggaccagttgcgtatcgcatcttcgacgcggcaacgtgagtttttggaccgctatgccggcgatgatgtagcgttggtcgcatacggcaaagcttggaatgcgcttcgtgccatggatgatcggttgaaacgattgtcgagccaggagtcgtccatgcgccagcaggcggattacctgcgcgagtccatcgaacgaatcaaccgcatcgatccgcagccgggggagatggccgagttgcgtgctcgccgtgatcgcattgagaacgcggccgagatcgccgaaggggtgaaccgtgcgttgagcgcgttggatgcttcgcaggttgttgacgatgttgaatcatccagcgccaccgatctgattgatcgcgcgtcgcaggcgcttcgcgccattcatgtggacggcgtgttttcggaattggctgatcggcttgattccatcagcactgatttgtctgatgtggtgttcaccttgtcgggcgaagtcgacaatgatctcggcatggaagacttggacgccatcaacgggcggatccatgagcttgacgaattggttcgtcgttggggtccggaattgtcggacgtgattgcgtggcgagatcaagcggtgttcgacttggaggatctggacgcgtctccggaaaaagttagtcaattgcaggcggaacgtgaaaaactgttcggtgaagcgttgaaggcggcgcgtgcggtaagcaaaaggcgtgtcgctgccgcgaaggaacttgccgccaaagtcactgcggaactcgaatctcttgccatgagcggatcgaaactagagatccatgtatcggaacgtgaacatttggacgcttccggcgctgacggcatcgattttctgttcacgccgttcccgggttcgccgcaaatgccgatgggcaaaagcgcgtccggcggcgagctgagccggctcatgctcgcgcttgaactcgttgcggcggaaaaacatgtggtggcgggcggttccgtacctcccatgacgttcattttcgacgaagtcgacgcaggcgtcggcggcaaaaccgcggtggagcttggcgcgcgattggcgaaactcgctcaatccgcgcaggtcatagtcgtcacccatctgccacaggtcgcatcctgggcggacgaacagtacgtggtcgccaaaggtgaaatggatgacggatcaatcgccaccaccatcaatcaagtgcgtggggaggcgcgtgtgcacgaaatcgcccgtatgctctccggcagtgaaagcgaagcgtcgctggaacatgccgaagaactgctcaaatcatcggttctcgattaacgtaagatgcacaataataaaggaggatatcgatggcaggcaatcaaggcaagggcgccattttcgatcttgacggcacgctgcttgattccatgggcgtttgggatcaggttgacatcgattttctttcaaaacgaggcattgacgtgccggacgattacatgacgaaagtcgcggccatgcaattccgccagatcgccgaatatacgattgcgcgtttcagccttaccgacactcccgaagagctgatggatgagtgggatcatatggcccgcgtcatgtatgccacagtggtcgaagccaaaccgtatgcacgtgaatatctcgctcaattgaaagagagtggagcgaaacttgccgttgccacatcgctgccgccgatgctgagagagccggcgatgaagcatgttggcattttcgactacttcgatgaagtggtcagtgtcgatgatgccggcgacgtcggcaaagaccagccggacgtgtatctgttggctgcatctcgcctcggagtcgagccggaggagtgcaccgtgttcgaggatttgctgatcggcatgcgttccgccaagtcggttggcatgaaggtatgggccatgcacgacgattcgtccgatgccgattggccggctatttgcggtctggcggatggtgtcatgttcgacttccatgacgcgcctgccgtattgtaggaaccggcgtcgtacggagatatatgcatttggggctttccgttgattcggaagaccccaaatacgttccataagagtctaccggctggctcggttcagatgtccttgctgccgtaaatatgcagcgatatcttgctggagaacaccaaggcgagtacgtcgatgatcaagaatgtcgctaatgcaatggcttggtgccggctgatcgcctcggccagctgttcgacggtcttttcgagttccggcaatgccttgcacagtccgatgaccgtgcccacgatcacgccgatgctcagaaaaatggcggccatggcacgataaggggagaaccggtacaggaacggctgcacgatggcgttgagcagcacgagggtcagcacggtcatcgcggcgaagccgatcgcatccgtcactttaactggctcgtgcatgatggtgccggcgcaggcgatgctgacggccacttccaatcccgccaccagatcgcaggcgataaggaatgcgaatcgtccgaggatctggtggttgcggttgatgggcacgatgccgttcatccaatgatggttgttcatttgttcataggagaacagggtgatattaagcatcaggaagccggaggccgccccgccgatggcggctcccgcaacgctgtcgagagtggaccctgtagccgccatcaggcatgtgaaacctggaacgtacgcgaagaagatggctatgtacgaccgcccgtagctgatggtacggttccagtccaaggaaatctgcctaaggatggcggtcatggcgtccgcgttcgctgtcgtgttcatcgtacgtctccttcgttggtattgccgattgccgtatgtgccgcggcgttggtcagtctgatcacatcctcaatcgaagcatgctgtgtcaggagaccgtcggtgccgccgatgtgtgggatatcctgcgtgcggaccaacgcgtcgaagccggttgcgtatgtgcggatgccgaccattgcccgccgcagaccatcagtaagctcatccggaccgcccttgaccaggcggaacgcgtcttcgaactcgtctttcggcccgctgtaatacagcatgccgttcgttatatacgcgaggaaatccgcgcaacgctccaaatcggcggtgatatgcgtggagaagattacgctgtgtccgccatccgcaacataatcggacaggatgtccatgagctcgtcgcgggacagtacgtccaggccgctggtcggctcgtcgagaatcagcagtttcgcatcgtggctcaacgccacggcgagcatgagcttcatctgcatgccgcgcgacagatccttgatcttcttgttccgtccgagtccgaaccgtctgagatatgcgtcgaacagattgtggtcccacagcgggtacattgggctgcttgtccgttccaccgcgtcgaccgtcatgtattcgatgaaatagctgctgtcgagcactacgcccagctgctctttggcccgctcctcatcggccatcgcgtcaaggccgagcacttcgattcgtcccgcgtctcgcgtggtcatattgaggatcagtttgatcaacgtggatttgccggctccgttcggaccgaccagacccatgatgtagccggacggcaggtcgaaggtcacgtcatccaatgtgaagccggaatcataatgcttcgtcaatccggttacgctcaaggccaaggttggccgcgttccttgggggagtgaggaatcgttcatgattgttccctgtacgctttctcgaacatgccaagcagatcaagtaggctgatgtcggcggctttggcctcgatggaaacttcacggagcttgtccatgatgcgttcacgcgcacgttccttcatgagttcgttgcctcgttccatcacgaatgtgcctttgccctgcacattctccacgagcccctcgtcggccagttcgttatacgctctggtcacggtgagcacgctgacgcgcagttccttggcgagcttgcgcagtgagggaagcgcctcgcctgctgtaagctcacccgacatgatcgcggacctgatctggttcttgatctgctcgtaaatcggttctccggacacggatgagatgatcagcttcaatctgtgcctctttttctgtatgtttcgtaggtgatatatctcccggccgaacagttagatgcaaactgtttagctgttatatataacagtaacacagaaaacccgtactgttattacgtgtcgcataacagtacgggttttgttggaatataaggaaatccgccgctccatgaacgcctcttgcggtcgacgattgacggaagcgacatttacttgcgttcgaggattcccgtatggacggttatgcgcgagtcggatggatgatacggcggaaacacaggtagatcagctacgccaacggcatggtcatcaacataggcagtgtagggaaccggcgatgagtcccacgccaatcatgattgcgattttcttcgcgccgaaggagagagcgtccgtttcggcgcgatccgtcgcctgggtggtgttgctatcttgctgcatgattgtttgttggggaaaccatctgttattccattcccttatagagttctttggctagaccaatcagtgacttgtctgagcctgctgggccaataaggcatgcgccgcatggcagtccatctgctgtttccaatatcgcgtatcgtccgttcatagtcgggtagttgttgaaacatcgacagatcaatcagaccgtgaacgcctttggtgtgatatcaacgacttgcgtcacgttgaagtcgatgtcagccgacagcagcaggtacacttgttgacgtggcatctcgaacatggcggcaatcatattgatggcgtgttcgacgctttgcgataatgcgtcatccagcgtactgctgaaacccattggaatcagcgtgccatgactgatcgcaaatggcagaggggctgcggacgttttcttggagatgatcacgcagccattccctggctctgacggtattgtaccggactcatccaaccgagcgaccgtttgatgcgctcgtggtcgtaccagcggatgcagtcgtcgaccgggacgagcacctcgtcgcgggtacgttcctcccaatgcccgggatggacggactccatcttcatgcgtccgaaggacccctccgcgccgtcgttcctcgggaccgaacatacgataatcctttcattcagtctccaagaaaacgtccgcatcctgtaacgtccggattcttgcatactttgggttttcggtcctgacgtgaaaggcggggacgtttccacgtgtcaagtcgacaatcggccagccataatgatgtgcgttgattgggggtgtccgcagcgaaatcggtggaacttgtccagcaggttctgtgatacgtcgagcatcgtgaatccatggggtgggggagttgcggctgtgcaacttacttgagttctaagcgacggttcgcggattatttgtcgatcgttcacgtttaaggcgttgcgtgttcgccttccgagcctattttgtcgcccgggctggcttgtctgacagcttcaatgtggcaaagcagaagaggtagaagaatgaggataatggcgaaaaaccatacggcaacaaaggaacagcggcaggcaggagcctggcgcaaacgcggtaccaaatcggtgggcggtggcatgctcgcgttgacaagcgctgtagtggcagcggccatgctcgcaacgccagcggctttggctggggaaggaaccgcccggtattacagcagcaagcagccgtatgttgcaccggcgagcacatcatattcagcaattccgagcagataccatcttgcatacaccgagtctgtggcaaggcatggctcgcgtggcctgtcgagctacaagtatgacgctttgctggcactgatggctcagtctgctgcggaaaacaattatgctggattcgttagcccagaggttggcaaggaattcatcaacaatgtcaatgccattactgcggtcaacgtgggcaacgggtatggcatgctctctggtcagggcgccatacagcatcagggcattggtgagagaatataccagcgtgatgctgatctgttcgccaatgccgcaaagcagggactgcgcgtctcataccagagctcgggtgagcctcgtgcaaccgaatccggagagaatttcaaactaggattcgatcaggcttccaacggtttgctggcgaatgcggttgtagcaccgaataatcctgcggataacaattccggcaagaatttcgacaagaacaccaccacgttgtatttccataagactgataatccggatggtacgcagaaaacgggcgaggccaaggagcgcgcggaacgttaccagcagttcgtcgcgaatgatgggggcatcgccgaagctgaggaaaacgtgacgaacgatccgtccatgaccaccgcttcgcataatctgctctctcaaatcttcactgacgatttcctcgcgtccatcggcaaggaggaaggccagcgcatctggtacaacacggctgacggcacgaaaaagggtgcggccaattgcgctgctggcgccgaccctgccaaggatgcgaacgcgtgcggtgacgccaagaagaagatcgcgtcggaacaggatgcggcaatggatttgtacaatctgtacatcatcgcggccgatatggaacaggagaacaccggatcccacacgttcaatttcgaccagtacttccaaggtcagcacgcccaggaggcgaagacgtttgcttggtcgcttgatgccgaggacttctatgagaagggaccggggcgcgcaggtcaggatgagacctaccgcattgcccagccgttgctcgacgatttcttcaatgcgatcgacacgagggagcgggccggcaccgccgcgacgttccgattcgcacatgccgaaaccattattccgtttgcggcattgctgaagctgcctggatcgcagcagcaggcgagtgaactgtacacgtatgagaataatccgtggcgtggcgaaagtgtgacgccgatggctgcgaatgtgcagtgggatgtggttgtgcgtgatggtacggacgtctcggggcagccgtatcagccgttggtcagaatgctgtacaacgagaaggaaatcggattcaacgattcctgcacgccaattgcggatggttcgacctggtataaggaaagcgagctgaaaagctgcctgaatggtaagggaaccacggttgatgcccgactgacggatgaggaaggtcagcctgaaacgccgggccatgaatcgacaccagatgattcgcagaaggctccgggtgcgaatgatgcgaacggccagcggaagcatccggtgaaatcgtccgcgaacggcggcgatgcggtcaagctcgccaaaaccggttcaaacgtgacgcccgccatcgtggcgaccgtcgtgatggtgtcctccgcgatttttggaggaagctacgcgcggcgttcccgccggaaggcttgatttgaaaccttatctcgaccaggttacggcctgacttgcaacttggccgcagccggacttcggtctagcgttttacatctgatgcgctgttcccaattcccatcctcgggcttggaagcagcgcatcattgcgtcaaggtgcggtatgaggtcagtgcgtatgcggctggggcttttcgcgtactttggcggtgagatagtccgcttccaccttccatacggtgacggcgcgtacctgctggtcggtgaattccgcatgttccatgccggcctgctgcttcatcagcagtgcgagcccctggcgtgcctcgtcaagatcgtcgatgatggatgcggtgccattgccgacgatcgacttgaacgcctcgccccaattgcacaacgtacgtccttcgaccacctcgcagtcggtcgccatctcgaacgccatgggaagcgcgttgtttgcggccttgaccgcgtccatcttacgtccggtcgcagaaccatggaaatacaaggtgagatgattggattccgcatcgaacacgtatccgaaattcaacggcacgatggtgatgccttccgcatcggtgtatgcaagactcacgatcttgcacgttgcgataatcgcatcgatctgctgtggttcggttacctcacggtcggcacgcctcatcatgcgatgccttcccgcaaccgtccgctcatcattacgacgcgtcaccatggcacgttcctctctgctggatttacacacccagcctaccggctccctcagccgatgctgtatacgccggaaccatcatcccaccaagcatgatccactggctccggctgcacaagacgtttcggtcccttcagcatttcaatcgccttcaactccaaacgttcacgctcctcagccaacgcatcgccaacacgatcaagcaaaccgcacacgcaagccgtgggctgacatgtcggaagacgatgatttattgtcggaagtctgagtctcatcgcgctttttctcttctcttacgaggccgtgccccgtgccgttacgagaccttcgaaaggctcgccgaagagcccatgttcgaagacatcggcacactgcacgaccactatcaggaattcggcatctacccgctactgacactgcttgcgtcattcgcatgaaaaagctgatttataaacaaagcggcatcgcattccagattagaaaacggaaccatcaagcttatcaagcgcacgcagcagagaatcaacatgacctttcgcgcgcacgttgtatcgggcaacacgaatcactccatcaccgtcaatcacaaaagtcgaacgaatcacaccctcgtaaaccttgccatacaatttcttctcaccgtacgcaccatacaaacgatgcacggtcaaatcagcatccgacaacagagggaacgtcaaatggtcgcgctcgcggaatcggatgagcttgtccagcggatccttcgatataccgagtacggtgaatccgcgggagcttaggcgtgcgaggttgtcgcggaagtcgcaggcctcggtggtgcagccgggagtcatcgcggcagggtagaagtataggatgatattttggccgcgcaatgcggagagcgtgacactaccgccgttgtcgctgggaagtgtaaagtccggggccgttagtcctgcttcgagtcgtgcggatgtacgggagtcctgcgctgctggggttgctggcgaattgatgtcggacatgattatctccttactgttctttggatttcaagtgccgataccaagcgagaataaacgtcatcatacccgcctttgcgtgtgcacagttcgttgactcgttgcgcgccgccgcgaactccaaacagtaggcgtcagacctgtcaagggaacaaatcggaaaaagatcctgcgcgaagtatggtttgaaacgtgtcatcgtgcgcattttctggatctgtcggccttgtgctgagcaaagcaggctgtatctcgcctatgtatggcagatttcgggatgtgacatgaggcatctcgcttatatatggcagtcggtttcgcgaaaatgaggtttttcatgcccccctacctactgctttgacggactgacctgccatatataagcaagatatctccggacaagttcgcaaatctgccatacataagcgagatatgagcaaaacggtgttcaacaacaaaggaaacgtcaaatgatcgcgctcgcagaatcgggcatgagtactcttagctactcttcggaattcagaagccaagtggaaaacgaacggtcatacaattccgtttatctcctatgatgttttccagaacggggaaatttcggggaagcatggcgcgttgaagagagggacatccacgtcgcaccgtacgacaacggagaacaaagacgcggcagcgaacgtcaccgcgaaatccatatggttcaaacgacagctcaacatggcggttgcggcggtaggcagcgtcgcattgtgcgccaccatggccttcgtcgcggcactcaccggctacgtttcctcaagcgacctagactccgcagcatacaagatggcggcctcccaagctgaaatcaccgagagtctcatcaccgacagcgacggcgtgcggaaggtctacaattctgccgccatagcgttccctgacgggcacaccgactcctaccagaagatgcatcgcgccggatccgaggaaaccgcatggccgttgcctggcagcacgccggtcatgttcgagatgcccgagtggaccggctcggacggcaagccactcaaggccggtatcgacatttgttgagacggtcacttctatccggaactcggtcgttattatgccgcgtccggagccgaactgttcctgcatccgacggccacgaccggcaacgcatggcatcgcgaatcccgcatgggcagctataccgaccgtgacggtctcgcagtgatcaccgacaacgtgtggggtcccgacgggtatccgctcgacgtcgacggcaacccgatctacttcgtcgatgagaacggcgacaccgtttcctccggcaaggacattgcggtctacaactacgcaggagttggatctgacccgttccgcacgtcgagcctcatcatcaacgcatggagcggcaaggatggcaccccgttcgactactccacgggcagcgcgctcgacaccagcggaacaggcaagggcgcgtccgacagcgaatcggccgacatgacgttcgccgaaggcgcctgcgatccagacaatctggaaatccgacagatgaacttgtcccgcgcagggttcagtgtcatgaacttcaacgctcgcctctgctccaagatgtacgatcagctcgccaaactgaccatcccaggatatcaggccatgtatgatgatccgaccgaactcgacaagagcgcgctcgaagctccgatcgcggcggcacaggccaagcttgccgaattcggcaaatacacggacgatacggtcgcatctctcacggaagcgtacgagcaggccctctcgctgtggaacaacaccacgttcagcagcgaacagaacggtcttgtctccaatgccgccacgctccttaacacggcattggacggtctgaagcttcgggaaacgaagcctgatgaccagccgggcggtggcgaggccaagccgaatgacaagcagccctcgaaagacaagaatgccagcaaggccgatggaaaaccgactgcggacttgcctcgcacgggctccgacatcgttcccattatcgcggtcatgcttctccttgcaggagccggaaccactgccggtacgttgatacgccgcaagcatgtgtagcggtatgttctagaaaccatcaccagataaatggccggtcgaagcacattagctgcgaccggccatttatcagatggggtatggtgattagaagacgctgtagccgccgtctacgcgaatgtcagtgccagtaacgtacgaggacgcgtcgctggcgaggaagagcaccgtgctggcaatctcgtcattcgtgccgaaacgatgcatcggcacgacctcgagcatggcgtcgtggccaggcatgtcgatacggccattgaaaattccagaccacacgtatccgggggagatggtgttggaacggataccatccttggcgagcgcggcagcaaggtaacgtgagtgttccatgatggccgctttggtggcgccatacgcgttcaccggcgtcggacttcccatcatgtagttcgcgttgtgtccggacagggaggctgtgaagatcagtgagccgccatgaccgtgttcgcgcatgatttcatgcgcgatgcggccggtacggtaggtgccgttgaggttgatgttgatggtgcgcgtccatacttcttcggtggcgtcttgatcgtcgcccggtacgttgactccggcgttgaggaacgcgaagtcgacggtgcccagctgttccaccaattgtgttttgagttcggctacttgttcgacgttggtgacgtcgcaggtgagcgcgatgacgttggtgccgaaacgttcgctcatgtctttcgccagttcggtgagcttgtcttcttggctgggcaggtcgactagtgcgacgtctgctccggcttgggcgagcgcggccgccgcgttgcgtcctagaccgcctgcggctccggtgacgaagcctttgcggccgcgcattgagaatttgtcgagtatcgagtagtttgaatcctcccatttgtcgaggggataacgttcgtcgaagatttgttcgacggttttctctggaatcttcgatgattcgtctgccatgtttcgctcctttgcgtgatggtgaccgcttttttggatgcgtccgcgcatcatgttttgcgcatctatggaccatgtttgcggttgcctatgttcgtgcctgcggtcgttcggcgtccgtgccgaaccaatccgagtatagcaaataaaacgatggcggtgctgtcagtatttgtcaggtaaaacgtaatgaggaaaccgtaaggtcaatataagaagatagttgatgattgaaaggggagtggtgatgacggatttgaaaatgttttccaagcctgtggtgttcacggatttcgatggggtgctcaacgcctttccggatgacaagcttttgcgcaggggcggcgtgaacaaagttatgacctgggcgaagcccgacagtccctacgcgaaaatgtacaatcctgaaaaagcgttccacctggacggcaacgaaaaagcccacacgcccgtaggctcatggcgcatccactggtccagcgaactatccgacgccatgtacgcgttggcagttgacggcattgtggaattgtggtggctgtccacctggcagccatactgcagtcagattctcgacccgatgctcggatgggatcccatgctggtcgatgtcatcacctggtacgatcctgtcaccaaatggggacgtgaggcaggcaaatggcagaccatccaacgacgcgtacgcatcgaatgcgaagagaatgaacccgcgccgatcgtatggatcgacgatgatgaatgcttcgaacagcgcgcgcagctcttggaggaactccagccgaaagcgccggtgcttatggtccgcccggactatcgtatcggcatcagccgtcgccaatggaaactgatcgatacgttcgtacaccatcccgaacagttcgacacggtcacgttcgacatggaaccaacctgcaggatatacgacatccaccacggtttctagcctaaatgaattaccatgggaggatagtcgagcggaatgaaggaaggatggggttatggcggaacgtatcgtggagcgtcttatccgagagcgtgatactcgatatggtgacggcatttacacgaccacgcaaatccagttcgcatggaattccaatcatatggaaggttccacccttactgccaaacagaccgcgcagctatttgccaccggtacctataccacggatggcagcgaacaggtcaatcctgatgatgcgttggaaacccgtaatcattttgctgcgttccgttggattctcgaccatgctgatgagccggtggaccgggatatggtctgtcacctgcatgccattctcaagcagggcaccagacaggtctccgactcgcttttcaacgtgggcggctacaagactcggccgaactttatcggcaatcctgtcactccgacaaggaccgcgctgccgcaggatgttcccgaatttatggacaggctgtttgatatgtgcacgaaacttgaggacgagccatatcagatcgcccgtgtccattggacgtttgagaagattcacccattttcggacggcaacggtcgaatcggacggcttatcatgttcaaggagcttttgcgtatcgatgcgttgcctgtccttgtccatgacgcgtatcgtgcggagtacgtcaatggcatcagtaagtttccggacgagccaggatggctggttgatacgcttctattcgaacgggacctttaccggtcgcatgttctgaaaacggatgccgaggcattgcgttacacgtaccatgaccaatggaatatggctgagcatcgggtggaacgagatgaggatctggaattcgccaagctcatcgacacgaaggcccagccgttgttcgatgaggagtatcagcagcgcgaacggctcctatggggcgaatagcggtccgactgtgtgttcctccttccaaacgtgacatgaaccgaatgtgcattgagatgtgcaatttgtgcacattgcggtcgccggccgttcaccttggtgtaagaaggaatcagccttcggactttagcatgaggtgcaatggcgcgtattgaatgcgcgcatacgaggaagtgagagctgcatacatgcgtgtattcgacttcgatggaaccatctatgacggagaaagcctgttcgacctgtacctgttttcggccaaatacaatccgaaagtattgcggtacatcgccccggtactgcgctatgccatcaaatacaagctcggacgagccacgttcgatcaaatggaatacggtgtgggcaagctatgccacggatatttaagcgaacttgccgaatcgttggaattcgaagaattggtcaacgccttctgggatcagaacatgaagcgcatcaaaccctggtataagccacgcgaagacgatgcgatcctcaccgcctcgttcgatatcaccgtgggcgaggcctgccgcaggcttggcgtgcaacatttggtctcgtccaccatcgacggcaacacgttgaacgtaaactacctcaacttcaacaccaacaagcccaaacgattccgcgaactctacggagacaacgttcgagtggacgaattctacacagacagccgattcgaccagcccatgatcgacatggcccgacgtgcctacatggtcaaaggcaacaaaatccaccaagtcaaatagccggaaaggctggaacggaatacggcggcaaggaccgatcctgacatctccccttcggcatggacgccttgcacgagccaggatgggcgtcggtcggtcatattgccgtatatggaaaatacgaccgaccgcaaaaacagttagaacgacacgcgcttggactggtttacggcagaaacctcgcacacgatgccaacaactaccgcgaaacacgcttcacacacaacaaataaatcaaccaagcaacaggcatcgccaacataaacaccggataaaaccacacagcaggcaaatgcccatacaccaaaccacccacaaacggaccaaccgacatacccaaatcaatacccgcataatacgtactattcgcaataccactgcgctcgcggcctgcgattaccacggcctgcgcctgcgtgactgaactcatcagaccgtagccgacagcggtgaaaatcgcagccaacaacagcatccaatcattgaacaggaacgtcatgcatgcgagcatcgccagcatgcccaacgagcagaccgtcagccagaaacggaagcccttgctgtcgaacaggtcgcgcaagcccagtcgcaacaccaataacgcgaccgcgtaaaacatgaaaaacaggtcggatgataccggcagatgacgagactgaacataactcacgatgaaggactgatttgcgaaatacgctatcgcaaacatcatgaacgtcagcgacaacggcaccacacgcggttccagaatcgaacggatcggaaaacgatgctttttggttgcgctagcagaaccgtcaatgtctacggcagtggagggattctccgttatggaagtctgctttttgcgtaccggctgtccgccattcttcaccatcagtgtggcgagcagcatgatcaccgccagcaccagcgaactcaaaaacgtcagacgataaccgatgtatttttgcgcgcgaatacccaatgccggtccgaccgccatagccagcgcgttcatcgtgccatacactcccatgcctgcacccatatgccggatcggcagcaaaagcgacatccacgtggccaggcagaccgagcagcatgcgaaaccaacgccgttgatcacgcgagccatgatgagcatgatgggggagtttgcgaaatagtacagcagtccggcggcgaaatagagcaccgtgccaaccgccacaagtgtgcgcttgctggttttgtcggaaagattgcctgcgatagggcggcagaacagtgagatgaaactcatcgacccggccaccgcacccatcagcatgccgtccgcgcccaacgattccgcatatccggcaacgatcggattggcaagcatattgctcgacatgaaacagaacgtcgcaagcatgaccaacgccatatcacgggtgatgagacgatcatgcttacgccggggctgttcgggctggttcgattgttgtgccggttgcttctgtcgtaccgattcagatgcgggtatcgttggtgctgtcatgctcgttcgcctccgagcatgcaactgtagcagccttgacgaaaaacggccgtccacatatcgcggacggccgatggagatggctttaacgatgtgaaagtatgcttcgcttacagagtttttacagagctttagcggcctgctcgacaaaaccttccataccgtcgatgtcaacgacatggtcgaaacgcacgtcggcggtctccaaaccgcgcaacgcggccggagcggtagtgccggtcgcctcggcaagcacgtccatgcattcgaaatccgtgccggaagcatccaaacccaaggactcgttgaccacgcgcgggaacttgtacgggctggcggtgctcagcagcacgcgcggcgtcagcggatcgcgaggcatctgctgcatcacgtaataaccgcacgcggtatgcgggtcgatcacataatggttcttgttccagcaatccgcgatcatctcacgcacctgatcctcatcggcccagccggtgccgaacagggaacgaatcttggccagcatcggttcgggaacctcataggcgccccactggttcaaatcgttcatcagcatggcgatcagacgagtgtccttgtcggacatgtaatacagcatgcgttccagattcgaggagataagaatgtccatcgacggggaaatcgtctgatagaacggacgctgacggttatacgtgccggaagtcaggaaatcgaacagcacattgttcttatcggacgcaacaaccagatgcttgaccggcaagcctaacagcttcgcataatatccggcgagaatatcgccgaaattaccggtcggcaccacaaactcgacctcatcaccgacattgatgacctgctgttcgagcagctgcgcgtaagcggagaaataatagacgacctgcggcaccaaacgtcccacattgatcgaatttgcggaagacagtaccacatgcgaatcggaagccaaacgattggcaagctcacgatcaccgaaaatgcgtttgacagcggactgagcgtcatcgaaattgcccttcaccgcgcagacattcacattcgaaccagcctgcgtgctcatctgcagttcctgtacctggctaaccttgccttccggatagaacacggtgatgcctgtgccctcggcatccgcgaaaccagcgagcgccgccttgccggtgtctccggaggtggctgtcacgatcatgattttctcgttgccgtcgccgccggccggggtggtgcgtgccatgaaacgcggcaggatctgcaatgcgacatctttgaatgcggaggtcgggccgttaaacagttccatcacgtagtcatcgccgagcggcttgaccggggtgatcttttcgtcggaccattgcgcgccgtacgcttcatcgatgcatgccttgagttcggtttcggagaagtcgggcagcagcacgctcagcacgtcgaatgcgatctgctggtaggacttgcctgcgagagatgcgacgtctacgtgggtttcgcccagtgagtcggttacgaacaggccgccgtcgtcggcgatgcctttgcgtatggcttgcttggaggtgagtgaatcggtggtgctgcgagtgctgtggaacgtggtcactggatttccttagcaatagaacggacaatgaacgtcaaacaatattgagtgtagcgttatgggcgggaagaagcgtgtttggcgtccgtggaatgggacgatgcgtgtttatgggtggtgattgtttcctgcttgtttcgtgattgcttccatgtttcgaaacgccctattccctcatgcgatttgtgcacgtacacttcatcgttaagcctgcacgttcgtacgggcaacgtatttatcctccaagccaaggagagctcaatgaccgcatcgcctctcgcgcaaactccgaacgacatgttcaacgcgcctatcgccgaagcagaccccgaaatcgccgaggtactcaacgctgagttgtctcgacagcagaacggcttggagatgatcgcctccgaaaacttcgtgccgcgtgccgtgcttcaggctcagggttccgtgctgaccaacaagtatgccgaaggctatccgggacgccgctactatggtggctgcgagcaggttgacaagatcgaaaccattgcccgtgagcgtgccaagagcctgtttggtgccgaatacgtcaacgtgcagcctcactccggcgcacaggccaatgcagccgtctaccaggcgctcgtcaagccgggcgacaccgtgctcggtcttgccctcgaccatggcggacatctcacccacggcatgaaaatcaacttctccggacgtttctaccatgccgaagcctacggagtcaatcctgaaaccttccgcatcgatcctgaaatcatccgccagcgcgcgcttgaaacccacccggccatgatcatcggcggctggagcgcctacccgcgtatcgaagacttcaaggccatgaaggaaatcgccgacgaagtcggagccaagttctgggttgatatggcacacttcgcgggccttgtcgcagccggactgcacccgagcccggtcccgtacgccgatgtcgtatcctccacggctcacaagactcttggcggtccgcgttccggtttcattctcgccaagcaggactatgccaagaagctcaactccgcggtcttcccgggtcagcagggcggtccgctcatgcacgtcatcgcaggcaaggccgtcgcgttcaaggtcgcagcctctccggagttcaaggaccgcatgcagcgcaccctcgacggtgccaagatcctcgccgaacgcctcatgtccgacgatgtcaagaacaacggcatcagcgtcctcaccggcggcaccgacgtccacctcgtcatggttgatctgcgcaacagcgaaatggacggccagcagggcgaagacctcctcgcccagtgcggcatcaccatcaaccgcaacaccgttccgttcgatccgcgtccggcaagcgtggcttccggtctgcgcatcggcaccagcgccctcgccacccgcggcttcggcaacaaggaatacgaagaggtcgccgacatcatcggaaccgcactcgcagcaggcaaggatgccgacgtggaagccctcagggctcgcgtcgacaagctcgccgaagacttcccgctgtatccgggtctcgatcagatccactgattccatgtcgaataacggttgatcgagaacggtttcggatataaatctctgaggacacgtgacgtgcgaaatcgcgccctgtttccgatgctacgacgaaataatggtcgaagctacggaacaaggcgcgatttcgcgctaatctaggaaactatgacgaacccacagacccaatccaacgccatggagcccgatgtgctcaacgaggtgtgcgccaaagccgacgccgcccgaatcgcgcaagcgcaacttgcccaaaccaacacgcagcgtaaaaacgaacttctcaacgccatcgctgacgcactcgacgcgcgcgccaatgaaatcgcggaagccaacgccatcgacatgcagaaatccgccgaacatggcatggacgcaggcaaactcgaccggctcaaatttgacgtaccccgcgtcaacgcagccgcacaaggtgtgcgccacgtagccaccctacaggatccgatcggtgaaatcgtgcgcggataccacctcgacaacggtctgcgactcgaacaaacccgcgtgcccatcggcgtgctcggcatgatctacgaagcacgacccaacgtcaccgtcgacgtcgcgtcactctgcatcaaatcaggcaacgcggcactcctcagaggaggacacgcggccgaacgcaccaacgcagccaccctcaacatcatcgccgacgtattgcacgaacacggatatgatgccgcactcatcgcttccgtcgacgaatacgggcgtcaaggcgccaacgccatgatgcaggcccaaggccacatcgacctgcttattccacgagggggagcgggcctcatccaagccgtcgtgcaaaactccaaagtacccgtcatcgaaaccggagcgggcaacgtacacatctacgtcgaccgaaccggcgaccaaaacaaagccatccccatcattctcaacgccaaaacgcaacgcgtcggcgtctgcaacgccactgaaaaactcctcgtgcacagtgacatcgccgaagcgttccttccgcaaatcgccacagcgcttgccgcagccgacgtcgaagtgcatgccgacgaacaggcctacgagatcatcgacaaaaccggtattgacggggtgaaactgatacatgccactgaggaagactgggataccgagtatctcgcgttgaagatcggcgtcaaagtggtcgactcactcgacgaggccatcagccacattaaccgccactccacagggcataccgaatccattatcgccgaagactattcggccattgaggaattcacctcacgcatcgactcggcggtggtgatggtcaacgcgtccacgcgtttcacagatgggggagtgttcggcttcggcgcggaacttggtatctccacgcaaaaaatgcatgcacgcgggcccatgggactacgcgaaatgaccacgaccaagtggatcggctacggaacaggccaggtacgggcatgaacgaacacaacaataatgacggccagatggaggaaacaatgactgacgctaagaacccatggaatgcggatctcaatgacccctatctgggattgaagctcgcatccgaacgattaagcatcgtacgatacgtgtttctcgtgcagatcgaggacggcatcgcatcggcggcacagcgtgcttcactcgaatacgccgacgcggtgctgatcggttggccggaagtcgatgccgaagacgtggtggaactcgacgaagagaagcttaaaagcgtcgatgagcagatgcggctcatggaacagtacatcgccaaattcagcgccatggagcgcgaacaggatattgacggcatgaccgatacgctgattcgcgtcaccgaacgtgtggcggaagtgcgtcgcgcctatcagccggacttccctctgccgactttcgcggagatcaggcgcgtcgtgcaggacgagtgggatgaggatatgggcaaaatcgacccggacaacgcatcgccaacggcagacagcatcggccgtgagaccgcggacgccgatcaggaacaaaaaaacgaggatgcctcatgaccggcccgaaacgcatgcggcccgaatccgccgaagccgattccgaacttgccatcagctatgtggtggaaccggaacggcgcatgtccgacctttccgtggaatcagcaggttccgcggtggccacaggccgacgttcagcacgcggcaactggcatagcaggcctcgcatcggcatcatgggcggcacgttcgaccccatccacaacggccacttggtggcggcctcagaagtgtcgtgggtgtacgacctcgacgaagtgatcttcgtgccgacgggacgccccgtattcaaactcgacaagaacgtcaccaacgcggaagaccggtatctcatgacggtcatcgccaccgcgtccaatccgaaattcaccgtatcacgcgtggacatcgaccgtccgggagtcacctataccatcgacacgttgcgagacatccgtgcgcaacatcccgacgcggaactcttcttcatcaccggagctgacgcggtcgcggaaatcatgcaatggaaagacgccgacaaaatgtgggatctggcccacttcgtggccgtgacccgccccgggtactcatcgccggaaggggtgaaactgccggaaggcaaggtcgatacgttggaaataccggcactggcgatttcctcgaccgatgtgcggcgacgtgcggagcatggggagcctgtttggtacctcgtaccggacggcgtggtgcaatatattggcaagcacggactgtaccggtaaatttcaggtgaacacgcgcgggtgagacggtctgcgcagatggttaatatgggtcacgtccacttgacgcgaaaacagacgtttggagacatggtgagcgcaatccttgaaggaaagccggataaaaaccttatccttgtcacaggcagaacacatccgaaactggcggcggaagtcgccgaacaacttggcattgatgttctggaaaccacagcatacgacttcgccaacggcgaaatgtacgtgcgctacaccgaatccgtgcgtggcgcggacgtgttcgtactgcaaagccacgcagccccgatcaaccaatcgattatggaacagctcatcatgattgatgcgctcaagcgtgcatccgcgcgttccatcaccgcggtctgcccactgcttggctactcgcgccaagacaagaagcatcgcggccgcgagcccatttcctgccgtctcatgttcgacctgctgaagaccgcaggtgccgaccgcatcatgagtgtcgacctgcatgcggcgcagtcccaaggcttcttcgacggtcctgtcgaccaccttatcgctatgccggtgctggtcgactacattcgcgaccgtttctccaaccagcttgacaatgttgccgtcgtctctccggatgcgggccgcattcgtgttgcggagcagtgggcgcagcgtcttggcggtggtccgctcgcattcgtccacaagacgcgtgacatcacccgtccgaaccaagcggtcgccaaccgagtcgtgggcgatgtcgaaggtaaggactgcgtgctcgtcgacgatctcatcgataccgccggaaccattgccggtgcatgcagcgtgcttaaggatgccggtgccaagtcggtgactgtcgtcgccacacatggcgtgctgtctggtcccgccgtcgaacgtttgaagaacagcggagcccgcgaagtcgtgcttaccgacaccgtgccgattcctgaagagaagcgttgggacggtttgaccgtgctgtcgatcgcgccgctgctggccagcgccatccgtgctgtgttcgaagacggctctgtggctgagttgttcgacacatatccggagcatcacggacagggcttcttgttcgcctgatgacgcgttgcgcgggcatgcttagcgtacgttccgcatgtttgtggggtaactcccatatcagtgaagcgagtaccgttgtttaaggtgcgcataacactttttgtgcaccttaaacaacgttttttactagtgcgacacgtcgagacacgcggtgttggcgacatgtggcataatagacacttggcggtaaccgcaaggttttccgccattcccccatggtgtaatggcagcacacgggtctttggaaccctttgtcttggttcgagtccaggtgggggagcccattctcagacggctctgcggcgaatgccgcagagccaatttttttttatttttcttgagcgcacttagaggagtgtatgcccggtaacataactttatgtgagcatatacgaacaaacatgatcattatctttcagtgaaggctaatgccgttcatttttactaagcgtttttgagacgaacttagggtttttcgccaaagaaggattctctttgctttttcaacgatatgccaccttttttgtaatgttttaggggtataaaatttatctttagggtgttctaaagtgtttgaaatatctgaagttatccacttatccacaagaatcaaatgtcaacttgacgggggatggcttttgtgccttaatggttcttacaccccctctcaacgatgagtcgggcgaataagaaagggattcatcatggatgattcatgtgaaaatgatgttccgccgccggaggctaacgagcccttctcggaggttccaccttctgaccagggatcagcggccaatgcgaagcgcgctgataaaagtgggaagaaacgcgagggagaaaacctgacagagtgggaaaggatatctcttgagcttggcagaaagccggttttcgattacgataaaacgcttccctcgtatgatgggtttcttaattcagatcttttcggcaggaaaataccattccattacatccagataatgcctgggccgtgcgatgctgaatttgcctactccatgaacatgttcgcggcgcagttgatctgcaatgttgtcgatatcttccgtggcaggcagaaagaagcacgcgtggaaagggtattgagcgaggcctgcatgagaaagctgagaaatgcctccgctcagatcgcagcacagatgaagaaggatgtgaggatatacgcgcagttgggtctgcttccgatcaccgtatattacgttgacagctggttggtctctccgacatgcttcgaaagcaccgtgctgatgggcattggaggacgaaggctgtgcagcaatttgaagtgcgtcctcaagggatctgcttggaagtgcgaagtcgctgatttcggcgtgtgacgtataacaagtaaccattcaaaacccttggaattggctgaattcagccgttttcaagggttttcagcgtgccttgagcatactgcaactactatagggactcatgttgagagaatttgtaccggaacctgcgtatagcactacggatgaggataccgttttcgcactgctctccagacgcgctaaacgtgatcctgatgatctcatcgcccaatggcaggacgacgagactcgtcgatggcatgacgttacggcgggggagatgcttgagcgtgtgcgcgcggttgcgaaaggtcttcttggcctaggggtcaaggccggaagcatggtagtcatctattcgcctacctgctacgaatggggagtcatcgattttgcctgcgccgcaatcggcgcggtaagcgtgcccgtgtatgaaaccgattccgccaggcaggccgcgtccatcatcgaagaggtggatccgatcatcgcctttgccggtgatttcgcgcatacacaaacgcttgaacagattcgcgatgagcacagcagcctgcgctacgtcttcaacttcaaggcggatggtcttgatgccgttgctgattttggagaaggtgtcggcgaggacacgctcgatcaggtgatttccagggtcaaggccgatgacatgctcaccattgtgtacacgtctggttccactggcaagcccaagggagcgatgctgtctcaccggaatttcacgcatatcgtgctgaacggctacatcattctcgatgaaatgctatatcagccgaatcgtctgatgttgttcctgccgttggcgcactgcttcgctcgctatattcagtatgttgcgattggcgggcagggggtggtcggctatctgcccggagccaagcatctgcttgccgatctgcgtagcttcaagccgacctatctgctgggagttccccgtgtgttcgagaaagtgtataacgcggcttcgcaaaaggccggagcgggtattcgtggaagagtgttcgccaaggctttcgatcattttgtgcaatggtcgaaggacgagcaggaaaccggacgccattccattgtggctcgtgccgaacattcgttctttatgtctgtcataggcaaatccattcgttctgctttgggtccgaacatgagatatctggcttgtggcggcgctcctttgaacgtcgatctcgcccatttcttcaacggtatggatggcattaccttcattcagggctatggcatgacggaaaccgccgctcccatgattgtcaactggcaggacgccaaccgcgtcggttccgtaggcaagcccgggccgggcatgggcgtgcgcaccgatgacgacggcgaactgcaggtgatgggccccaacgtgttccttggctactacaagaagccggagctgacagccgatgtcaagatggctgatggctggctgaagaccggcgatttgggaaccatcgacgacgacggattcgtgtacattacgggtcgcaagaaggatatcatcattacggccggcggtaagaacgtcagtccggcacctatggaagatgtcatcaacacttgcccgatcgtgtcgcatggtgtggtggtcggtgatggcaagccgttcatcggagctttgattgagcttgatcaggagatggttcgttcctggcttgcacagcagggacttgatagcaacatgcccatggagcagatcgcgaagaacgatgccgtgcgcgcattcattcagcagtatgtcgaaaaggcgaatgcgaatgtctctcgtgctgaatccgttcgcaagttcgaaatcctcgacgaggagttcagccaggagaagggcactctgacggcgagcctgaaagttgtcaggccgaaggtgcttaagcggtacgaaaatgtcatcgacaatgtgctgtatgcgccgaagccatccaacaaaccgctgccaaagacggtgcagattcttgaccgaaccaccgaaacggtcaagcaggcttccgaatccatgcgtcaggcttccgaatccgtaagtccgaaggttcggcaggcatttgataccatgcaggagaaaattaagaagcagaccgaagacgccggcgagttccaaacgccggaagactcatcggaaactgaggaaacaaccatgaacgaggagcgataatcttggcaattcgtgagattcgagtcgtacctgatccggtgctacgtaccccctgtgatcctatcaaggaaattacgccggccgtgcgtcatctggtacaggatctgcttgataccgttgacgatccaggaagggctggcttgtcagctaatcagattggcgtgaatctgagggcattttcctataacatcaacggcaagatcgggtatgtgctcaaccctgtcctcgaagagaccagcggtgaacaatacggagatgagggatgcctgtctgtgccgggattgtggtacaagacccgtcgcgctgattacgctcgtgtgcgtggcatcgatttggaaggcaagacggtcgtgctggaaggtcatggcattatgggccgcatgttgcagcatgaaaccgatcacttgaacggtcatgtctatcttgatcgtttggagaaagaggaacgccgagaggcgatgcgctacatgcgcaatcaccacaagtgattgttcgcatctcaccgatatgacgacttggggtcacgtctttgcgaaaagacgtgaccccatggtattttatgccttgtgtgccatccggcgaagggctttgtcgtgaaagtcctgagccacccaatattgtcaaccggcatacaaccaattcgcgtcatgttcgcgacgacctgtgtcggtcggccgacgccgcaaggctttggctgcacgcaggaacgcatgaccaggcaagaaccgacagaaagaggtagtaataccatggctcagatcaatatgagcgacatgctgaaggcaggcctgcacttcggccaccagacccgtcgttggaatccgaagatgaagcagttcatcctcacccagcgcaacggcatccacatcatcaacctgttcaagtcgctcgacatgatcgacaaggcctacgacttcatcaaggctaccgtcgctcacaacggcaccgtgctgttcgtcggcaccaagaagcaggctcaggaagccgtttccaatcaggctgtccgcgtgaacatgccgtacgtttccgagcgttggctcggcggtatgctgaccaacttccagaccgtgtccaagcgcgtctcccgtctcaaggaactcgaagagatggacttcaccgacgtgcgtggttccggtctgaccaagaaggaactgctgcttctcgagcgcgagaaggacaagctggctaagcagctgggcggtatccgcaacatgaaccgtactccgtccgccatgttcgtggttgacgttaacaaggaagctttggccgttgaggaagctcacaagctgggcattccggtcgttgccatcgtcgacaccaacgctgatccggagtccgtcgagtacccgatcgcagccaacgatgacgccatccgcggcatcgaactgctgaccagcctcatggctgacgcagtggccgaaggcctgctggagcgttccggcaaggccgctaaggctgagggcgagaccgagcagccgatggccgcttgggagaaggagctcctcactgagggcgctccggccgccgatgcaccggctgaagccgaagccgaagctgaaggcgaagccaaggctgagtgaaaatatccactatgatgggaggtgttgtgcctcccatcatatggggcatcactatttttcagaggagacaaatcaatggcagcaatcactgcagctctgatcaagcaggtgcgcgaggaaactggcgccggcatgatggacgttaagaaggctctgaccgaggctgagggtgacgtggctcgcgccaaggaaatcatccgcgccaagggcatccaggccgctggcaagcgcgaaggtcgcaaggctcaggaaggcaccatcgcctcccaggtcgtggaatccgccaatggccagaccggttacgccgtcgaactgaattccgagaccgacttcgtggccaagactccgaagttcgtggagttcgctgacagcgtgctcgaagacgccgtcaaagccgaggccgcttctgtggacgaagtgctggcagccgcttccggcgaagccaccgtgaaggaagccgtcgaagaggcggccgctctgttcggtgagcacgtcaaggtcggccagttcgccaaggtcgagggtccacacgttgagatctacgcccacaagaagtccgctgagatgccgccgagcatcgtggccatgatcgccaccgatgaggccggcgctgctgtggctcacgaagccgctctgcagatttccgcaatgggtgcccagtggctgacccgcgaggacgttccggccgatgtggtcgagtccgagcgccgcgtggccaccgagaagtccttggccgaaggcaagccggagaagatcgttccgaagatcgtggaaggccgtctcaatgccttctacaaggagaacgtcctgctcgagcagtcctatgtcaaggatccgtccaagaccgttggcgacctgttcaaggaagtcggcggcgcagccgtggctttcgctcgtgtcgaggtcggcaagggcgaggctgagtgaattcggcttcaatggtgaatccgtgcgttagacgctagagattccatgaggttggccatcatccacagggtgatggccaactttgttttcttctcgacgctgtgtcgttgcggtgtggtgtctgtgtttgccgatactcttgagagcggtaaatttcgtgagttctcgggcaagaaaggcttttcatgactggcgaaaacactggtgataatccacgcagagtgctgctcaaactatccggagaggcgtttggcggcggcaaagtcggcattgacacgtccgtcatccgccgtatcgctgaggaaatcgttcccgcggtgcagcagggcgttcaggtcgccatcgtcgtcggaggcggcaacttcttccgcggcgcggaacttcaacaggctggaatcgaccgctcccgcggcgattatatgggcatgctgggcacggtgatgaattgcctcgctctgcaggacttcttggagcaggagggacaggccacgcgcgtgcagaccgccatcaccatgggtcaggtcgccgagccgtacattccgctcaaggccattcgtcatctggagaagggccgtgtcgtgattttcggcgctggtgccggtatgccgtatttctccactgacactgtgtccattcagcgttctttggaaatccattgcgatgaggtgctgatgggcaagaacggcgtggacggcgtttataccgccgatcctcgtaaggacgagaacgccaagcgtttcgccacattgagctataatcgtgccctcgtcgacaatctcgccgttatggatgcatccgcgctttccatggcccgcgacaacaagcagcgcatccgtgttttcgggctcgaaggcaatggcaatgtgacccgcgcccttctcggtgaggaaatcggaactatggtttccaccgcggagtccacactcgctgaataacgacattcaacgtcgaatatcgatcaaacaaccaacaacaaggagtacaaatggcaactattgtcgaacaggccaaggcacagatggccaagtccgtggaatccaccaaggagaacttctccggcattcgtaccggccgcgcgaatccggcgctgctcaacggtatcaccgttgattattatggagctccgaccccgctgaaggccatcgccaccatcggcgtgccggaaccgcgtaccctgtccgtcactccgtttgacgcgtcccaggccaatgccgtcgagaaggcgttgcgtgattccgatctgggcgccagcccgcgtcgcgacggcaacgtcattcgcctgaccatgccggagctgaccgaggaacgtcgcaaggaatatgtcaaactcgccaagggcaaggcggaagatggcaaggtcgcagtgcgcaacatccgacgcaaggccaaggaatcccttgacaaggccatcaaggacggcgagatgggtgaggacgagggcgatcgtctgctcaaggagcttgacaagatcaccaagcagaccactgatgaacttgataccctgctcgaagccaagcagaaggagatcatggaggtctgagagacctttatctcctgaaaagaatcgacgcacagccagacagggaacatgatggaacatcaggaacagctcgaaaaagaaaccgaagaggccatcaacgccatcaacaagaagacggggcgtaatatgccgcaggccatcgccacaggggcggtgctcgtcatcctcatcttggcgtgtctgctgatcagcattgacttgttcgtctatctggttgtgctgttcatggtgcttgccctttgggagctgcgcgtcgatttcgccactgcgggacttcatattcccgtggcggtgttgtgggtatgttcggcggcgacgttgctgtccacctattacagcgaacgtcatatcgtcgccatgacggtatgcgtgctggtgtctttggtggtcgtagcgatcgccgccagcgctaaagtgacgttcggcagccgcatctctctggccgtggcggataagctttcccacaccgatgcaggcgcaagacttgaatcctccttcaaccatgagcagggagaggtaagccatagcaggctgagccatgtcgcggtctccatgttcaccgtgctgtacattccgcttctggcttcctgcctcatcatgccgttgacattcaatgatcatcccgtcgcgcatgctattatgatggtattcatgcccgcgttgagcgataccggtggtttgttcgccggggcatggctgggcaagcacaagctaagcccccgcatttcgccgaagaaatcgtgggagggtcttgcaggttccattctgttctccatgatcggatcttttgccgtgatgttctgcacgtacgggtcggatgtgtggatttcccgctggtgggtccctgtcgtggccggtttcatgatcggcatcgccggaacgtttggcgatttgtgcgcatccatgttgaagcgagatatcggcatcaaggacatgggacacctgcttaagggacacggtggcgtgatggatcgtgtggattccattctgctgtgcgcgccgttcgtgtgcgtgctgctgtgggcaactggaatgtgagaaaggcaaacacaagcatgagcgactccgtgaattccacgaaggatttgccggaaaccggtattactccaggaggcactaccggtgccttccgcgacgtgctttccaaagatcatgcgcgtcgaggcaagccgccgctgcattttgctgatatgactgaagacgaacgtatcgcgaaagccaaggatcttggacttccgaaattcagagtcaagcagcttgccaatcattactatgggcatttcgacgtcgctgccgaagagttctctgactttcctgcagcgaaacgagccgaagccgcagaggcgtttttcccaacgctcattaccgaagtgacccgtcaagtggccgatgagggcactactatcaaaacgctatggcgtctgttcgacggttctcttattgagtccgtgctcatgcggtatcccacccgcaccaccttatgcatttccagccaggtaggctgtggaatgggctgcccgttctgtgccacaggtcaattgggtctgacgagaaacatgtcggcaggcgagattctggaacaggttcgtgtggccgcgaaagccatgcacgacggcgaagtcgctggtggtctcgggcgcctgagcaacatcgtgttcatgggcatgggcgaacctatgggcaattacaagtccgtattgagcgctgtacgccaaatcagcgccatgccacctgaaggtttcggcatttcggcacgcaacatcaccgtctccacggtcggtgtggtaccaggtatcaagaaactcacggcagaaggcattccggtgcgtttggccgtgtccttgcacgctccgagcgatgagttgcgagacgagctcgttccaatgaacaagcgtttcaatactacgcaggtgcttgatgcggcacatgactattacttggcttcgaaacgtcgcgtaagcatcgaatatgctctgatgcgcggtatcaatgatcaagccgagcatgccaaattacttgctaagcgattgaaccattatggtgacaattgggctcatgtcaatccgattccgctcaatcccatcgaaggatcgaaatggaccgcttcgaagcctgaggatgaacagcagttccttgatatccttcataaagcaggcattactgcgacgttgcgagacacgcgcgggcaggatatcgatggtgcatgcgggcagctcgcagctaaggaacaagattagatttcaaggaaagatgcttgttctgtccgctactcggacttccgacgaacatgcgtaacgtaaaacggttactcttgcattcgttgcacacatgattatgcgcgaaggagtaaaacagcatgtcactggcagtccgagtcattccatgtcttgatgttgatgcgggacgagtagtcaagggcgtgcatttcgagaatcttcgcgatgccggcgatccggttgaacttgccgcggaatactaccgtcagggtgccgacgaactgactttcctcgatgtgaccgcttcgagctcgcatcggcagaccatggtcgatgtggtgagtcgaactgccgaacagattttcatcccattgaccgtgggtggaggcgtacgtgcccctgaagatgtggattctctgctgcgttgcggagctgacaaggtaggagtcaacactgcggccatcaatgatccgacgctgattggccgtgtcgcagaacgattcggcaaccaagtgctcgtattatccgtcgatgcacgccgtgagcagggcgagcgacacactcagtcgggctttgaagtaaccaccatgggaggccgcaaatccaccggcattgacgctatctggtgggtcaagcgtgctcaggagttgggcgcgggggagatcctgctgaattccatggacgcggatggtacccaacagggttttgacttggaaatgattaaagccgtgcgtaaggaagtgaagattccgatcatcgcttccggaggtgcgggcaaggctgccgatttccccccggcgatcgaagccggagcggatgccgtgttggccgcgtcgatcttccattacggcaaagtcaccatcggcgaagtcaaggatgccatcaaggccgccggctataccgtgcgatgaaagccgaaaaccgcaaaacaggcgaataacgtaatcaataatcgaagaaacaaatcaataacaccatcatgaccaacgaagcatacgacaacagcactattcttgacccacgaatcgcagaacgtctcaagagggacgataaaggactggtggcagccgtcatccagcaattcgacaccaaagaagtgctgatggtcggctacatgaacgacgaagccatacgacgcaccctgatgactggtcgcgtcacgttctggtcgaggtccaggcaggagtactggcgcaagggagacacttccggacatgcccagtatgtgaagtccttcgcactggattgcgatggggatgccattctggttgaagtcgatcaagtgggagcggcctgccataccggcaaacgatcctgcttcgaagaaggcgggcaactgcccgtggtcgtaggataccgtaccaaggaacaggagggccagcgatgagtgaatgcagcgtacaagcactcaagtggggcgccacctggccgagtcgcgaacaattccacgaattggctgatcagggatatcgtgtgattccgattgtgcgccgacttctggctgattcgttgactcctgtcggattctatgaacgccttgctgcaggacgttccggcacattcattcttgaatccgcggaatttggcggcacgtggaacagatacagcttcatcggtgtgaattccatggctcagttgcgttccaacaacggcaaggccgattggttgggtcaggttcccgcaggcgtgcctaccgaaggcgatgtgatggaagtcgcgcatgctgcgctgaaaacactgaaagcgccgcatgtcgaaggactgccgaacctgaccagtggtctggtcggtaccgtcggttgggatgcgattcgccattgggaaccgaccttgcgtgccgaggcgccgaacgagaccgggcagccggaaacagttctggcattggccacggatattgctgtggtcgaccatgtgtccggatcggtatggatgatcgccaatgcggtgaacgtagacgatcgatccacccgtgccgatgcggcatacgacgaggcggtggcgcgattggatgatatgcagcgtaaggccgccacgcctgtcgaaggtgaagctcgcgtcaatgtgttggatgagaccattagccagcccgagcttcgtttccgtacggagaagagcgattatgagcgttccgttgaaatcgccaagcagcacatcatcgatggtgacgtgttccaggtggtcatttcccagcgtcttgacattgattcgccagccgatccattcgacgtgtaccgcgtgcttcgtacgctcaaccccagcccatacatgtatttcatgtcgttgaccgatgcgcaggggcgtgacttcaacgttattggatccagcccggaaacgctgatcaaagtggacaatggccatgccatgaccttcccgattgccggttcgaggcctcgtggcaccactattgaggaagacgagcaacttgccaaggatctgcttgccgatccaaaagaacgtagcgaacacatcatgctcgttgatctttcccgcaatgatctgagccgtgtatgtcttccggaaagcgtggaagtcgtatccttgatggatatcaaacgattcagccacattatgcacatctgttcgaccgttaccgggcgagttaaccccgacatgacgtcgttcgatgtgttcacgtcggcattcccagccggaacgctttccggtgcgccaaaaccacgtgccattgaaatcatcgacgagcttgagcccgcagatcgtggcatttatggcggcactgtcggctatttcgatttttcaggcaacctcgatatggcaatcgccattcgaacggcattcatccgcgaccatgaagcgagcgtgcaggccggagccggaatcgtacttgattccgtgccggccagtgagtggcaggagactcgcaacaaggccgaggccagcgtcgaagcggtgcagatcgcctcgcagcttcgccagttgtgagtcaaatcaagctaaccaatcgagtaaaatgctgaaaggaacaccatgtctgtactcgatgaactggtggcgggagctgtcgaagaccaacgagcacgtgaacagaacatttcccttgatgaggtgaagcgtcagacattcgaagcgccggcccctattgatgcgcgacagtggctgaaaaaagcggatggcattccggtgatcgcggagattaaaagggcttcgccatcgaaagggcaccttagcgacattcctgatcctgccgcattggccagagaatacgaaaaaggaggtgccagcgcgatttccgtgcttaccgagggacgtcgctttttgggatcgctagatgatttcgataaagttcgtgcagctgtgaaaatcccggtattgcgtaaggatttcatcgtcacggaatatcagatttgggaagcgcgtgcgcacggtgccgatctggtgctattgatcgtcgccgcgttggacgacggcaagctcaagtccttgcttgagcttgcacatagtctcaatatgacggtgctggtcgaaacgcatacccgtgaggaaatccagcgtgccattgatgcgggagcgcgagtcatcggcatcaacgcgcggaatctcaaggacctcaaggtcgatgtgaacaaatacaacgagctggccgctgatttgccgaacgatgtgatccgtgtagcggaatccggagtgttcggttcggttgagctggaggattatgcccgcgccggagccgacgcggtgctggttggcgaaggtgttgcaaccgcagccaaccatgagcaggctgtggagcgactggtaaaggcaggagcaagagtgaaagcatccgaacaaaccccattggcaagccacgaaggaccatatttcggccaattcggcggacgttacgtgccggaagcgctgatcacggcgcttgacgagcttgaacgcgtctatgaggaagccaaggccgatccggagttccataaggagctggcacgactgaaccagcagtatgttggacgtccatcaccgttgactgacgctccgcgtttcgccgagcgtctcaaagaaaaaaccggtctcgacgcgcgtgtgttcctcaagcgtgaggatctcaaccataccggcgcgcacaagatcaacaatgcgcttgggcaggctctgctggtcaagcgcatggggaagacccgtgtcatcgctgaaaccggcgcgggacagcatggcgtggccaccgctacggtgtgcgccatgctcggcttgaaatgccgcatctacatgggtcagatcgatgcgcgtcgtcaggcgcttaacgtcgctcgcatgcgcatgctcggtgccgaggtggtggaagtcactttgggagatcgcattctcaaggacgccatcaatgaggctttgcgagactgggtcaccaacgtcaaagacacgcactacctgcttggcacggtcgcaggtccacatccgttcccggcaatggtgcgcgacttccagaagatcatcggtgaggaagccaagcagcagcttcaggattggtacggcatcgaccatccggatgcggtttgcgcatgcgtcggcggcggttccaacgccatcggcatcatgaacgctttccttgatgacgaacgcgtgaatctgtacggctacgaggcgggcggcaatggccccgaatccgggcgtcatgccattcgtttcgctccgggaaccggcgaactgggcatgttccaaggtgccaagagctatcttctcgagaattccgaaggccagaccctcgacacgtattccatctccgccggtttggattacgcatccgtcggcccggaacacgcatggctcaaagaaatcggacgcgtcaactattcctgggcaaccgatgaggaagcgatgagcgctttcaaggatctgtgcgaaaccgaaggcatcattccggcgattgaaagctctcatgcagttgctggcgcatacaaggcagctgaggatctcaaggccaagggatacgagcacccagtcatgatcatcaacatttccggtcgtggagataaggacatgaacaccgctggcaaatggttcggttatttgaccgatgaacaggccaaggcgctcgaagccaatggagcccagggcaataacgcggacggcgagtgaaagaaggagtatccattatgacgaacgcaacagtaaccacgccgtccgggcagcctctcggcatcagccataagccgagtccgacggaagccatgttcgatgaattcaaagcggcgaacaagcctgcattcatcggttatcttccatatggattccctgattctgactattcgttgaaagcattccgcaccatggttgagcatggtgtcgatgccgtcgagattggtctgccgtattccgatccggttatggatggtcccgtcatccaagcggcttcgcagatcgccattgacaacggcgagaaaatcgcgaacgtgttcaaagccgtcgaaaccgtggccaacgccgggggagtccctctggtgatgagctattggaacctcatctaccattacggcgtggaacgtttcgcacgcgattttgaaaatgccggtggcgccggcctgattactccggatctcattccagacgaggcaggtgaatggatcgaagcttcggaccgtcatggacttgaccgaatcttcctcgtgtccccggactccaccgacagccgtttgaaggtcgtggcaggcaacgctcgcggcttcgtctatgcggcagcccgtatgggcgtcactggcgaacgttccaccatcgatgcttctccggaagagttggtggcacgcacgcgcaatgccggcgcgaagaacgtctgcgttggcatcggcgtttccaccgccgaacaaggcgcgcgagtcggctcatacgctgatggcgtcatcgtcggatccgcattggtgcacaccatgcttgacgaatccgggaaaaacgcagtcgatgaggccacgggtctcaaggcgttggccgccaaagccgaagagcttgcggacggcgtccataacgcgcgtgtcgcaaagtaaaccattctgacgatttcggtggtccacgcaccatatcggatgcgtggactaccatcaggaaaccatgacacttgcatacattccatcgccaacgatttcgcagttttccatcggtccagcaacgattcatatctatgcgttgtgcattttgatgggaatcgtccttgcagtatggataaccaccacacgttggaaaaagttgggtggcaatttcgaccaagtgcttgatatcactctggtcagcgtgcctgcgggcattatcggcgcacgactttatcacatcatcaccacgcctgaacgtttcttcggaccggatggcgactgggcggaaatgttccgcatttggaatggcggacttggcatctggggcggcgtgctgttcggagcgctggccgcatgggcatggtgccgtcataagcactatccaatggccttgctggctgacgccatcgctccgggcctgttggtagcgcaggctgttgggcgtttgggcaactggttcaaccaggaactgtatggcgctccgacaacgcttccatggggtttgaaactcaacatggaaggcactgccatcgggcatagcgaacagtgctatgacggagccacatgcccgagtggcacgctgttccatccgacgttcttgtacgagatgatctggaacctcatcggcgccgcgattatcgtatacatcggttccaaagccatgaagaaactcaaggcaggttccctgtttgccgtgtacatcatgtggtacaccctgggacgcacttggattgaatccctgcgtatcgattatgcgcacgaattcttgggcgtgcgcatcaatgtgtgggtctccatggcggtgttcgtgctcggcgcggtgtcattcatcgtcgtgcagcaaatgggcaaagacactgacctgttggcggagaagcttcgtaccgtcaccgaaatcgagcagcgtcttgaaaacggtgaatcggaggattcttcggattccgtggtgtctttccccgagcaaacggttgatgaaatcaaaaccaacgatgccgaaactgtctcgaataccgacaagcagcccggcatcaaataacagcaagtcgattacctttcatagaataagagccatgactattcaaatcgcaccaagcatcctgtccgctgatttctgcaaccttgagcgcgacctcaaggccatctccaatgcagatctcgttcacgtcgacgtgatggatcatcatttcgttccgaatctgaccttgggcgagccgattgtggctcgtatctgcgaagtcaccgatcttccggtcgacgtgcatctgatgatcgaggacccggatcgttgggcacccgaatatgccaagttgggcgctgcatccgtaagcttccacatgggggcaacccacgctccggtgcgtctggcgcgccagctgcgcgagatgggttgcaaggcttgcttcgcggtgcgtccggccgaacctgtcgagccgattttcgatattctcgacgaattcgacatgattcttatcatgaccgtcgagcccggcttcggtggccagaagttccttgacaaccagatggccaaggtacgtcgtctgcgtgacgagattacccgtcgcggcctcgccaccaagattcaggtcgatggcggtgtcagcccgaagaccgcgcacattgtagccgaggccggtgccgacgtactggtcgcaggttccgccgtgtatggtgccgaggatcctgcggaagccattgattccatccgtgagaaggctgaagccgcattcaaggcctgaacctaccaatatttcgaggatagatacgaataatgaagacttttgaatccctctttgctgaattgagcgagaaggccgcagccaagcaggctggctcgctgactgttgacgaactgggcaagggcacgcatttcatcggcaagaagattgtcgaagaggcgggcgaaacctggatcgcagctgagtacgaaggcgccgatcgtactgcggaagagatgagccagctcatctaccatctgcaggtcatgatgatcgaccgaggcatcacactcgaagacatctacaagaatctgtgagtttttggccgtgccataggaggcgtggcctttttgggagggaaaatgctgagaatcgccgtgcccaacaagggcatgctgtccgaacctgcatggaacatgctggccgaggccggctatcgcctgaggagcaatccgcgtcagctggttgtggaggatcccgacaatgacgtggagctgttctacctgcgtccgctcgatatcgctgtctacgttggccgaggcaccatcgacgtcggcattaccggtcatgatctgctgctcaactccggtacggatgccaaggagcatatggagcttggctttggcgcttcaacgttccgttttgcagcccccaatgattctccgattagcaagctcgaagatatcgaaggcaagcgcgtcgccaccagtttcgacaagcttgtgcatgattatctggctgagcatggcatcaacgctgaaaccgtacaccttgatggtgccgtcgaatcgtcagtgcaactcggtgtggctgatttgatcgccgacgtggtatccacgggcaccacgctccgtaacgccggcctgcgtattttcgcggaaccgctgttgcattctgaagctgtgctcattcgttccccgcgtcttgctgaagatgatgatcgtttgacgattcttagccgtcgtctgcagggcgtgctcactgctcagcgttacgtgctcatggattacgatattccagtcgagaaggtttccgcggctgtggacatcacgcctggattcgaaagcccgacggtttccccgcttcatgacaagcagtgggcggccgtgcgtgtcgttgtgccgaaggccaaggtcaaccaactcatggaccagttgtatgaagttggtgctcgtggcataatcgtcaccgctttgcaggcctcgagaatgtaatgttgctcgaagtatgagcaaactgattatcaaaaaacagtacagtccggaaccgcgggatatctatttcacggttccgaaccttatcagcctgttgcgaatcatttcgattcccttcatctcggtattggtctctcgccatgagatggtgcttgcattgattgtgcttgcgctgtcggcggtgtccgatggcttggatggtctgattgcacgctcgttcaatcaggtgagcaaaatcgggcagatcctcgatcctattgcagacagattattgattttctgcagtattctcgcgcttggagtcgctgacatcattccatggtggatgctgatcgtcgtcggattgcgagatttgatcatggcgattcttgtactggttttggcgcagcgtgattacggtccgctgccggtgcatttcgttggaaaagcaggcaccgccatgctgatgattgccattgtcgccttgattttcgcagatatctggtctaattcggctacggatactttgcatttgtgtggtctcgccaccggcatatggggtgtgggattgtactggcttgccggctatatttacatacgtcagggaatccagcttctgaagaacgataaggattgactcacatgatgcatgatgctccggaacgtgcgtcgttcccggtgtctccggagaatacgcctacgaagcggcgcgccgttttctcggcgtccttcgccgggctgacttcgcatcatgtgcagcctgatatcgtgacatccacttcgcgcagaaggcggaatctggatgatgactcattgcggcttattgacgatttgaccaatcgtccgatggacgtgatgtacacggactcgaggctggccaccaaaactccgtcattgttttcggtctggttcacccgggttttggtattccttatctgcattgccgtaggcacggcgggaagcgtgttcgtccgacagctgagtaccgatccacgtaaggaagtacgcaagcaactgtcaagtcagttatctgatcaaacgaaaaacgtcgaaaccctcgccaaagacgtgaacgcgctgcgagcccaggttgaggaagaatcgaaatccgtgtcgaactggtctctgaaccagaccatacaggatgacgaaatggtcaatggcgtacttcctgtgcaaggcgaaggcatcacgctcaccatcgccaatccaatatcggtgagcggagacaacgcggattcgtcactgccaagggaaaacggcagccaagtccgtgtggtcacggattccgatctgcaggtgcttgtctcgctgctttggcagtccggtgcggaggcgatcgccattaacgggtatcgtctcggtgtgcagacttccatacgaacggcagggacgacgatccttatcggcgtcaattccgtgcaaagcccctatcgcatcgaggcgatcggcaattccagtgcgcttgccaatgcggtgagcaagaaaacgcaaaaacgtttgtacgatgatttcaaagaagccggtatctatccgcaggtgagcagaagcaaatcgattacgctggaagcggcggtgaccggcgaagtgacatatgcaaggaaggtcaagtaatggcagcggtcttgggacttatcataggcgtggtcattggcgtgttcgtccggccggacattcccattgcgcttcagccgtatctgccgattatggtgctggcggcgctcgatgcgctgctcggtgccgcccgagcctattttcagcgtagcttttccgataaggtcttcgtgatttccttcttctcgaatgttattacggcaacattgttggttttcctaggcaaccagcttggcgtcggttcccagctgcagactgcggtcatcgtcgtgctcggcattcgaatcttcaccaatgtgtcatccatccgacgtttcatcttcaagggatgacggcgtatgagcagacgcaacgatgccaacaaggatgtactctccaagatccacgagcagatcgtcaaagaccaaaacaacgacagcacccaaaccggatcgtttcctgtggtcaggcgcaaaccgaagagggtttcgctgaatgcgaaggccactcgcgcgcgcctgtattcaagcgtgctcgtaaccgtgctttgcgcgttgctgggcttcagctacgctatccagctgaacaacacgacctccacatatgagacgatgagcgaggacgagctgaccaagcttattagcgaaacgagtacgcaggtgcaaaagctcgaacagcgtaaaagcgaactatccaatcagcttgactctctgaaggataccgccgacaagaacgagaaggcagcggaaatcgccaggcagaacgctgaatcgaatggcattctttccgggcgtttaccagtatccggcgaaggcgtggtcatccgtatttccaaaggatcaaagcgagatattgacgcgtcgattttattcaccctacttgaggaactacgcaatagcggcgcggaagtcattgaaatcaacgatattcgcgtgattaccagtacatacatcagcgatacggcggatggtctcgattgcgacggtacgaatatcaaggcgccgttcatcatcagggcgattggagacagcgacaatctgcagaacgcggtcaatctcgctggaggcgtcggttcacgtttgaaagtgaaatacggagccaccgtgtcgatcgtgccatccgataaggtggagatcacgtcgacacgaagcgcgccacaatacacgtacgcgcatgtcgtcgaatagcatcaaatacgatccgttaaaatataatcgcgctgtagcatgctgttcactctttcagcgtgccgatgtctgcactcaaccctatcttgttcatcgttgacatacagtccaggcctgcacattagtaccgcggaccccgatagcaaaggacaactcatggctgaacagaccatctccattacactcaacggcgaagcgaaggaggtggcagcagatcagactggcgtccagctcttcgcggaagacaagaatatcatcgcagtgcgtcttaacggcgaaccccgcgacctgtataccgaactgcacgacggcgacgtcgtggaaccgattgcattggacagcgaagatggcctggccatcatgcgtcactccgcaacccacgttatggcacaggccgtgcaggagatccgtcctgatgccaagctcggcgtcggcccggtcatcaaagacggtttctattacgatttcgatgtcgagactccgttcactcctgacgatcttaaagagatcgaaaagcgcatgcagcgcattatcaagtcctcccagtccttccgccgccgcgtggtgaccgaagaggaggctctggcagaagagtccgatcagccgtacaagattgaactcatcaaagacaaggaagcccacctcgatccagaagccgccaccgaaatcagcggcaaggaactgagcttctacgacaacgtcgaccgtgacggcaatgtggtgtggaaggatctgtgccgcggaccgcacctgccgaacactcgctatatcaaggcgttcaagatcgagcgttctgcagccgcatactggcgcggaagcgaagccaatccgatgctgcagcgcatctatggcgcggctttcgccactaaggaggacctcaaggcatatcaaacccgccttgaggaggccgccaagcgtgaccaccgcaagctcggcgcggaaatggatctgttctccttcccggacgagatcggtccgggcttggctgtgttccatccgaagggcgccgctgtgatcaacgcgatggaggattactcccgcgaaatgcatcgcaagcaccactacagcttcgtgcagactccgcacatcaccaagggcggtctgtatgagacttccggccacctgcattggtacaaggatggcatgtatccggcaatgcgtttggacgaggaaaaggatgagaacggcaacgtcgtcaagcagggcttcgactactacctgaagccgatgaactgcccgatgcacaatctgatcttcaaatcccgtcagcgttcctaccgtgagttgccgttgcgtctgtttgaattcggcacggtgtaccgctacgaaaagtccggcgaagtgcatggtctgacccgtgtgcgcggcttgactcaagacgattcccacatctactgcacccgcgagcagatgaaggacgagctgaagaacctgctgaccttcgtgcttggtctgttgaaggactttggtttggacgacttctatctggagctgtccaccaaggatccgcacaagtacgtcggctccgacgaaatctgggaagaggccaccaatacgttggctgaagtcgccaaggaatccggacttgaactggttgacgatccatgcggcgcagccttctatggtccgaagatctccgtgcaggctcgcgatgccatcggccgtacgtggcaggtgtccaccatccagcttgacttcaaccttccggaacgtttcggcttggagtacatcgctgccgatggcacccaccagcgtccggtgatgattcaccgtgcactgttcggctccattgagcgtttcttcgccgtgttgctggagcattatgccggtgctttcccggcgtggctcgctcctgtccaggtgcttggcgtgcccgttgccgacgaattcgccccacacctgcagcagttcattgccagcttggaagaggagacggttcgttgcgaaatcgacatgtccgatgatcgtttcggcaagaagatccgtaacgcttccaagtcgaaggtgccgttcatcctcatcgtcggcgaggaagacatgaacaacaacgcggtgagcttccgcttccgtgacggcagccagctcaacggtgtgccggtcgatgaggccaaggcgcagatcatgaccgtgctgaagaagcgcgttcaggtcaacaacgtcgacgatttcaaggccgccatcgcagactgatctgattcgttcacgttcggtcgcatacggttatgaattatgggggcgtgcaagcatcacatactgacgcttgcacgcccttttgctttccgaagaacaggaattcgcatgttagaacatctccgtgcaccattcaaaagacttatcgagccattcgccaaggcactggtatcccttggcctgacagcgaatgcggtgacggttattggcgctattggaaccattgtggtggctttcgccactggcattacgggatggttgttcgccggagcggtggtgctgacgttgctggtgctcgccgattccctggatggctcaattgcggcactgaccacgggaggcacccaattcggtgcttttttggattccacattggatcgtatcgctgattgggcattgcttgccggagtggtcatcttcttcatcctgcatgccgattggtggtatgacatcaaccggtcaagcccggattgcattagttggattggtatcgccgcagccatggtgtcgatgatgacgtcgttcgtgacgtcgtatgcgcgcgcccgtgccgaatccgtcggtttcgaagtgaaaaacggcattgcaacgcgtgccgacagattggtcatcattctggtgggcatggcgattaccgggctcacgcaccaagggttatggctggccatcgccatggtattgcttgcggttttgggactcattaccgtattccaacgcattcttgaggctcgttgccagatggccgtcggtcataagacgtatcagttgtgaaccggctgcatgaaacggccgttgacgcgcctgacatacgtatgtcgggcgctttgtcttagaaccgctttagaatcgtttcgtttgaaacatccgcaacctgcctaggagcattatgtcaggtcattccaagtgggcgaccaccaagcacaagaaggccgccatcgacgcaaagcgtggcaagctgttcgccaagctgatcaagaacatcgagatcgcagcacgtatgggtggtggcgatcctgacggcaacccgtccctgtacgacgccatctacaaggccaagaaggcttccatgcctgccgataacatcaagcgcgcagttaagcgtggctctggtgaagaagccggcggtgccaactatgaagatatcgtctatgagggttacgctcccgcaggcgtcggtctgatcattgaatgccttaccgataaccgtaaccgtgcggccgccgaagtgcgttccaccctgaccaagggcaatggctctttggctacctccggttccgtgagcttcaacttcgagcgcaagggccagatcatcgttccggccgagggcgtcgattttgatgatctgtttgagaaggccgcagaagctggcgctgaagatgttacggacgacggcgacgtgttcactgtcgtcaccggtccgtccgagatgatcgacgttcgtaaggcccttcaggacgctggattcgattatgattccgctgatctggtcatgatgccgaagaacgaggtcgaattgactctcgaagatgcccagaaggtgtccaagctgatcgacaacctcgatgatctggacgacgtgcagaacatctactccaactggaccgcctctgacgaggtcatggctcagcttgacgaggagtaatcaagcgtgattattcttggcgtcgaccccgggctgactcgctgcggggtcggcgtgatcgaagccggcgcataccgccggctttcttttattcatgtggacgtggtacgttccgatccgaaaatgtcgcaggacttacgtctgttagccatctataacggtttggtggaaaagatcgaacggttcgcaccggatacggtgtccatcgagcgtgtgtttgcacaggagaatcgcaacaccgtactggggactgcacaggccgccggactggccatgctggctgcggcccagaggggcattcccgtcgccttgcatacgcccactgaatcaaaaatggcgattaccggcaacggcaaggccgaaaagattcagatggaacgcatggtcgcccgtattctggggctcaataccttgcctaagcccgccgatgccgccgatgcgttggctatagcgatttgtcatgcgcttcgccccgcaggcgcgttacaggggggagagcgtgaacaacacttgaccgatgcacagcgtcaatgggctctggcctcacagaaggcggcgcgacaacgcggcgtccgtaggggaatgtagactatcgaacagatgttctacagttgtatgcgggaggtgacggcatgataggcatgttgcatggccaggtcgatttcattgacgccgcttcggcgattattgaggtcgggggagtgggatatgagacccgtatgccttcggcggatttggcgtccatgcacgctgggcagacggtgaaggtatacacgtcattgaatgtttcgcaggatgcgattacattgtatgggttttcttcgcttgcctcgaaacgcatgtttttgcaattacagaaggtcagcggaattggtccgaaagtcgcgctttccttgctttcgacgttgcctccggaacgtttggcgaaagctgtggcggacggggatgccaccgcgctggcgaaggcgcctggtctaggcaagaagggtgcgcagaagattattctcgaactcaaggggtccatcgatctcagtcagatcgagggggcttccaaagaggttcgttctgcggaagatgccggttcggaacaggtcgtggaaggtctgatgtcactagggtggcgtcagcaggatgccttgcatgccgtgcagacagtctgcgagagcaatcatatcaatgttccattgagggacgatgatgtgccccgcgtgctcaaacttgcattggcttctcttgaccgaggtaggtgaaacgcatcatcatgacgaacgacgtcgcattcgaacagtcgaataccggtgccaatgaggaatcgcttcgcatggtttccgcgtcgcctgtcggcaacgagccggtaagcgatgaggaactgcgtcctcacgtcctcgatggttttattggacagccaagactcaaggcgcaattgcagctgtttttggatgctgcccgtaaacgtgacgttccccctgaccacatcctgctggcggggcctccgggcttggggaaaaccacgttggccatgattgtagccaacgagcttggagtgccgattcgagtcacttccggacctgctatccagcatgctggtgatttggcctcgattctaagctcccttgacgcaggggaggtgctgttcatcgacgagatccaccgccttccacgggcggccgaggagctgctgtatatcgccatggaggatttccgtgttgatgtgatggtgggcaaagggccgggtgcttcctccattccccttactttgccgagattcacggtgattggcgccaccactcgcgaaggcatgctgccatcaccgttgagggctcgttttggttttaccgcgcatcttgacttttatccgcatgaggagcttgaaaagctcatcgaacgatcctcttcggtgctgggcatcagtctcgaagagggagcggcccatcagcttgccatgcgttcaaggggcacgccgcgtatcgccaaccgattgcttcgccgcgtaagggattgggccattgtgcacgatttagaaactgtgcatccggacgatgtcaaggaggcgttggcactgtaccagattgataccgagggcttggatcgtttggatattgcggtattgaaagccattgtcaccaatttcaacggcggtccggtcggtctgaacaacctgtcggccatggtcggtgaggaatcggagaccgtggaaacggtgtgcgagccgtatctggtccgagaaggattccttgtgcgcaccccgaaagggcgtgtggcgacgcgcaaggcatgggatcatctcggcttgacttctgacgaatctcaggttgatgtcagcaagctagcttagactcggtgttctggacatagagtcctgttcgagcgtccatcccaaggagttgtgctttgaattacatgtttcttatcgtcatcattgtcgtcatgtttggcatgatgttctggcagtccaagaaggctaagcagcagcaggccgagcgtcaggatttccgtgccaacctgcagccgggcactgaggtcatcaccattggtggtgtgatcggcaaggttgtttccgtcgataccgaatacgaggagatcgtcatcgattccgaaggctctcagattcgtttcggtttcaacgccatcagccgcgaatacgtgcgtcctgcgtacgtacacgacgatgaggtcgatgaaaacggtaatcctctttccaccgattccacagacgaagatcaggctgctcaggagccgattgaaggcgaaatcgaagcggcgcagactgagaccgagcagaagaacagctgacaagctcattaaggcatcggcgaaaatctcatttttgaggttttcgccgattttattcctgacggaaacctataatgcaaagtgccgtagcactacaaaagaaggacaatacagtcatggcatcgtcggatattaccgtttccggtcttagcaagattggaaacgaaaacgccgagtaccttgtttcaaagattcgcaccattccgggattccccaaggaaggtattctttttcgtgatttcatgcctgttctggcagatgcgcgtgccttcggattgctacttgacgcactcgaagccgcgttgccggtcgctgccgatgaattcgatatcatcgcaggtttggaagcccgcggattcctttttggtcctgcgttggcagcgcgcctgggcaagggcttcatcgcagtgcgcaaggctggcaagcttcctccggaaaccgttagcgaaagctatgaccttgaatatgggcaggccaccgtcgaaatcgagacgaatatcgtgcatgagggatctcgtgtgcttgtcgttgatgatctgattgccactggaggaacagcgcgtgcggctgcttcgttgatcgaaaagtgtggcggcacggtggcaggtttcagcttcgtcatggagcttgtcggcattggtggcatggcatcgctgggagactgcccgacaagttcactgatcaccatgcctgcgtgagttaagtacattcttcgtaaataaccaatagcatcaagggaaaagaatccatggatctctatgagtaccaggctagggaactgcttgaagagcagggtattccaacgcctaaggcagtgttcgcgcagaactctcacgaagtggctgaggctgccgagcagattggctaccccaacgtgattaaggctcaggtgaagattggccaccgcggtcaggctggtggcgtcaagctggcgaagaatcgtgatgaggccattcttgcatccgaagacatcctgccgatgaccattcacaagcacaaggtcagcggcgtgttggtggccgaggcaaagaacattcttcacgagtattatgtctctatttccgtggatcgttcgtctcgcgattttgacgtgctcgctactgcgaatggtggaaccgaggtcgaggagatcgccaaggaacacccggaatctgtgaagcgtctgcatatcgacgctctggaggatttcgatatcgaggctgcgaccaagatggcggaaagcattggcttctatcatgccgacgtcaaccaggcagcacagattctgctgaagatgtggcagtgcttcaaagagaacgacgccacgcttgtggaaatcaatccgcttgccaagatcggcgatccggatgacgagtcttccaagacattgtgcgccctggacgccaagatttctttagatgacaatgctgcgttccgtcatgatggctggaagcgcttcgctgacccagtgcatgtggatccgtttgagcagaaggcgcgagagcatggtctgcactatgtgcaccttcggggttccgtcggtgtcattggcaacggtgctggtttggtgatgagctcacttgacgcggtttccggagctggagaagatcagggcaccaatgtcaaaccggcaaacttccttgatatcggtggtggtgcgtccgccgaagtgatgtgcggcagtttggagatcgtgctgtccgacccgcaagtcgaatcggtgttgatcaacgtgtacggtggcatcacatcctgcgagcaagttgccaagggcattctggaagcccttgacaagcttggcagttccaagcctctggtagtccgtttcgacggcaacgcggcggcagaaggtctgcatattctggctcaggccgatcgtgtcaatctgcatgttgcacagaccatggaagaagccgcacagcaggccgcgcgtcttgcggccaatggcaaggaggttcgctgaaatgacgcttttcattgaggatggcgcacctgtcatcgtgcagggtatgaccggacatcagggcatgacccataccgcccgcatgctgaaggccggcaccaatatcgtcggcggcgtcaacgcccgcaaggccggccaggaagtcaatttcccagcggccaaagacggcgaggatgttacgttgcgtgtgttcggcaattgcgccgaagccgtggaagtcaccggcgcccaagcgagcgtcgtgttcgtgccgccgcgtttcgccaaggatgccgtggtcgaagccattgaagccggcatcaagctgattgttgtcatcaccgaaggcattcctgttgccgatagcgcgtactttgttgaactcgcattgcgcaaggatgtgcgtattgtcggtccgaactgccctggtctgcttaccctgccttctacggaaggtgtgaatggttgcaatcttggcattattccggacggcatcgtctcccgtggacctttgggtttggtgtctaagtccggtacgctcacctatcaactgatgggagagttgtctgacattggttttaccgcatgtttgggtgctggcggcgaccctatcgtcggcactacgttgcaggaggcgcttgaggcgtttgaaaacgatgatgccaccaaggctgtcgtgatgatcggtgaaatcggcggtagtgccgaacaggatgcggccaagtgggcatccgagcatatgaccaagccggttgtcgcctatattgcaggcttcaccgcgccggaaggcaagcagatgggccacgctggtgccatcgtttccggaggcaagggaactgcgcaagataagaaggaagcgctcgaagccgtgggtattcgtgtcggacgcactccggggcagaccgctgaaatcatgcgcgaggtgctcgtgcggaatcctggcggaacaccagcagacgcttggactgctggtcatccgtggtggaagtgatggaaaacaccgaacgcggccatccactgtccgtggaaatcacggcctgcgcaagatcagttggaatcgtggtcttgcggtcaagattgcccgtgacctgcgccacatgaagttcgctagtgcgaatctcaagttccggcccctccaaaatcgaaccgagggcgtcgatattgcgatcgttattgcactggtcaagcgttttgagaatattcgtacggatggttttctcttgcttggcggtcagattcggcgcatcttgacgttgcgtggttttcggctgcggcagctgtccctcgcatccgcacatgccaacgaccattcccaatgcgagtacggccgccgcgattacgttgaaacgcttcttcatcacttggcctcctcgttgtcaggttcgtcggacttgtcgttgtcggattcgtcgttttcggatgtttcgttggatccgaccgactcggtcgttacggccatttcgtcaacttcgttgggcacgttgatttcatcggataccgcgaattctacagatcccgaggccgctgcggccgcactgctttcctcttgtgcgagacgtgcgaaatatgcggcaagctcgtcttgcgaaatcacggaagtctgttcgaaatcgtcgttttcttcaacaccatcagcggcagcgttctgctgatcggcaacgagattgcgcgcgccgggatcgacaatcgtaggctgcgcaacttcgttttggctattttccgaaccactcgcgcgatgcccagcatgacggcgacgcttacgcttcggcccgctcttttcgctacgggcggcactcgcttcggcgttcttcacccatgcggcaacctcgtcatcgtcaccctgcgtggaaccgatgccgtcaaccatggcaaacgcgcgcttgttgcgacgcttatgcggaggcatggcaaacacggaagccgaaagcaccgcaagtattgccagcaatccgccggaaagatagaacggcatggcgaaattcagcatcgaacgacggttccaatcaagtgtgaccgaacctcccttgcgattgccataatcgataatcgcaacggaatcctcggcattattcgtattagcacccttgaactgcatatcaacggaaccggcattgcatttgacggtgcgccacatgtcggaatcctggaaggcgacctggccttcggaattatcggcggtgccctgagccgtggtcttcagtgtagacagggtggaccagtcggacagtccggtgacgcgcgtgtatttggatcccgcgatccatccggcgatatcgcgggcggaaccgatggcgatgcacacgttcgcggatttgtcgcgcgacttcgccgaaatggtgacgcgatcgtcaaccaattgcagcacattcggatcggtgaccacatactgcgatcccgtaaccgaggcggacgccgtgacctgtgccgagggcttccaaatcgtcgcgttcaagacgccaagcacgatgcaagcaatggcaagcaagccgaaaataggcgtgacaatgccgcgcataatcttggcgtgtcgcgtgggacccgccttggactgcggcttttcctgttcttcctgcaataaagtcatagcattcactattctacattgcctctctgcaaaagcctgaaaaaactatgaaaatcaatgattgccactaaagtggaacctatgcgcaaatctactcttttcaaagccgtcgcagccgcctgcacaacgatcatgtgcttgggtttcgcggcatgcggaagttccgacacgaagtctgattcctcctccgattcatcttcgtcttcttccgattcctcgtcgaagatgaatcagatcgccggtgtgaccgccacaggtgagcccggtgagaagccgaccgtctccttcaaaacccctatgacggtggaagacaacagctacgtcgtattgcagaaaggcaatggcgaccagattgaagacggcgaccgcatatgcacgcagggtatcgccatcaatgtcaaggatggttccgaactcatgagcacctgggagaaaaacacccccgattgctctacgatggtcacctccgacaccagtcagatgactgaggattattacaacattttcaaggatcagaagcttaacgccacgcttgcgttcggtgtgaacgattcgaattccgctggcacctcctatttgatggtgctcacgatcgtgtcgaagtcgaaggatctgacgaaggcaacgggcacgaaggtgcttgacgttcctgccgatctgccgaaggtgacgcttgcgaaggatggcaagccgtcgatcgatatgaacggatacaagggttccgacacgttgatctcgcaggatttgatcaggggcgaaggcgccgaggtcaaggatacgcagaccgtgatcgcgcactataccggctggctgcttgacggcacacagttcgattcctcgtgggatcgcggtgcttcgtcgagcttctcgcttgatgaggtgatcaccggttggaagcagggcttggcagggcataccgtcggctcgcaggtgctgctggtcgtgccgccggaccttggctatggagacaaggattccggcaagattccagcgaactctacgttggtcttcgtagtcgacatcctcgccgcctactgatctacatcacgattcgcttataaaaaactccctgcataacaacagggagttttttataagctagaagagtcgtagggagtcgtcttcggcacctttcatttcgtcatagtcgaggatcaggcagtcgaagccgcggtcctgagcgagcacgcgggcttgcggcgtgatggtctgcgcggcgaaaatgccacgcacgggggccaacagcgggtctcggttcaacaactcgcagtaacgggtgagctgctccacgccatcgatgccgccgttacgtttgatttcgatggcaacatgcttgccactgccgtcgatggccataatgtcgaccggtccgatggcggtcgggtattcgcggcgcaccaatgtcgcaccttccccgatgcgttcgatctgttcggccagatacttctgcagatggtcttcgacaccgtctttgatcagccccggatcttcgcccaaatcgtatgtttcgtcggaataaatatgctgcaatgtcacttcgagcacgtcattggatttatccgccgaagcacgaatgactttctgcggaacctccgtagtcacgtcgtcgtcggcatgttccggagtgatgtctttgatggtgcagggcgccgccatccagttgagtggcttgtacgaaccaagttcggagaaaatcagcagactgttatcggctttgataagcaacacacgcttggcgagcggcaaggacgcattcaaacgcccggaatattcggcagagcaatcagcaacaataattcgcacgaggcactaccctaccatgattgtcgtaagccatgaatcccacgatatgtacaatcctatttttgttttgattaatcttttttttaaaaaaaacagtccgtctgctgcaactacagaatcgcaatcatatgcaattgctgcaatcgcaacagacggaccgtcagaagtatgctaccgagtgctactctgccatcttgacgtcacgtccacgctcaaccgcaacggtgagcttgttcgaatcgaaggagatgaaaccgtcggtcacttcgaaggagcgacggctgccatccggatccaccacaacgatggttccttccttgattacggtcaatacaggctcgtggttgggcaggatgcccattccgccttcagaggcaggaatggtgacggacttcgccgtaccgtgccacacggggtggtcggcggcgacgatgttcacctgcattgtcaatccggccatcacgcaccgtattccttctgcatgtcgtgccacttcttctcgagatcgtcgatgccgccgataccggagaatgcctgctccggaacgtcgtcgtacacgccgtcgcaaatgcgggtgaacgcttcgatggtctcatcggccggcacgtaggagcccggacgaccggtgaacttttcagcgacgtagaagttctggccgaggaactgctcgatcttacgagcgcggttcacggtggtcttgtcttcttcgccgagttcgtcgataccgatcagagcgatgatgtcctgcagctccttgttacgctgcagaatcgccttgacgcggttcgcgcaatcgtagtgagcctggcccacgtaacgcggatcaaggattcgcgaggtggagctcagcgggtccactgccggatagatacccttggaagcgatgtcacgggaaagctcggtggttgcatccaagtgggcgaaggtcgttgcaggagccgggtcggtgtaatcatcggccggcacatagatggcctgcagcgaggtgatggagtgaccgcgggtcgaagtgatgcgctcctgcagggcacccatttcgtcagccaggttcggctggtagcccactgcggacggcatacggccgagcagggtggacacctcggaaccagcctgggtgaaacggaagatgttatcgatgaacagcagcacgtcctgattttgcacgtcacggaagtactctgccatggtcagtgcggtcagcggcacgcgcagacgggtacccggctgctcatccatctggccgaagaccagtgcggtcttctcaagaacgccagcctcatccatttcgccgatcagatcgttaccctcacgggtacgctcgccgacgcctgcgaacacggacacaccgccgtggttctgggcgactcgctggatcatttcctgaataagcacggtcttgccgacgcctgcgccaccgaacagaccgatcttgccgccctgcacgtacggggtcagcaaatcgatgaccttgataccggtttcgaacatctgggtcttggattccagctgatcgaatgccggcgggttgcggtggataggccaacgctcggtgaccgtgatggtttcgtcatccttcttgttgaggatgttgccggacacgtcgaacacgtgacccttggtgacatcgccaacaggaacggagatcggaccgccggtgtcgagcacggtggcgccacgaacgaggccgtcggtcggcttcagcgccacggtacgcacggtagagtcgccaaggtgctgttcgacctcaagcgtgatcttcttcgtggtttcgccctcttcgttggcggtgttggtcagctcaacggtaagtgcgttgtaaatgtcgggcaggtggcccaccgggaattcgacgtcgataaccgaaccctggatacgcgtgacgcgtccagtggtcggctctgcagccgtctcgggagccgctgtggtctgattctcagccatatgcgttcctactcttccttcttattcagcgcgtcggcgctgccgatgatttcggtaagttcctgggtaatcgaagcctgtcgcgaagcgttgagcttgcgggtcaggtcgtcgatcaggctgcgggcgttgtctgtagccgtatgcatggcgttctgtcggcttgcagtctcggatgccgccgcggtgagcaggcattcatgaatacgggactggatgtacttcggcagaatcgcgtcaagcacttcgtcgacgctcggctcgaacgcataaagcggggtcgcggcatcggcatcggattcgggcacagggccggagtcctgctgttccggaagcacgagttcaacgggcagcatacgcagcacgcgcaccttctgaacgaccatattcacgaattcggtgaacacaatgtagagttcggaaactccaccttcgctcgccggcttcatgtaggcgtccatcagtgccttcgagatggactctgcgacttccacgccgggctggtcggtatcaccttcccaagtaccggcaacatcacgattgcggtacttgtagtacgtcacaccgcgacgaccatacacatacagttccggctgcttgcctgccgcatcgaggcgggccagcagcgattccgtttcgcggatgatcgaggaggtgtacggacccgccataccacgatccgaggtgagggcgaggacagccacgcgagggttgtcctcgtccttcttcacgatcggatggtcgatatgggtgtgggccaccagcgcttgcacggcgtcgaaaatcgcatcggtatacggcttcgcgttcaaggcgacgtcacgtgccttggcgatatgcgaagacgcgatcatctcctgcgcgttgaagattttctccaacgacgcggtggaggcgatcctagatttcaatgcgagttgcgagcccatggatcacttctctcctgcgacgatcttttcctgctcgaccggggtggcgttcttgacgttaggcttcttctcgaccagcggcttgcccgcgctggtcacgaaagtctcacggaacgcttccacagccttgtcgagggcagcctcggtgtcggcggtgaaatcttcggtctcgcggatggtcttgagaatatcggtgttgtggtccaggtagtccagcatggccttctcgaacggcagcacgtcgttcagcggcagatcatccatcttgccatgggtgccggcccacacggagacgacttcctgttccatggaatacggggagaactgcggctgcttgagcagctcggtcaagtgggaaccacggttcagctgggccttcgaagccgcatccagatcggaagcgaacatggcgaaggattccagggaacggtactgggccaaggagatcttcagcgtgccggagaccttcttcaacgccttggtctgtgccgcgccaccaactcgggacacggagatgccgacgtcgacagccggacgctggttcgcgttgaacaggtcggactgcaggaagatctgaccgtcggtgatggagatcacgttggtcggaatgtatgcggacacgtcgtttgccttggtttcgacgatcggcaggccggtcatcgaaccgccgccgaggtcatcggaaaccttggcgcagcgttcgagcagacgggaatgcaggtagaacacatcgcccgggtatgcctcacgtcccggcgggcggcgcagcagcagggagatcgaacggtaggcttcagcctgcttcgacagatcgtcgaagacgatgagcacgtgcttgccgttgtacatccagtgctgtccgatggcggaaccggtgtacggtgcgatgtacttgaagcctgcggaatcggaagccggggaggccacgatagtggtgtactccatggcgccggactcttcgagggactgcttcaccgatgcgatggtggagcccttctggccgatggccacgtagatgcagcggacctgcttcttcggatcaccggattcccaattacgcttctggttgatgatcgtatcgattgcgatagcggtcttaccggtctggcggtcgccaatgatgagctggcgctggccacggccgataggcgtcattgcgtcgatggccttcagaccggtggacattggctcgtcaaccggatgacgatgcataacgtcaggtgcctgggcctcgagaatacgacggccttcggtcttgatctcgccaagaccatcaatcgggttgcctagcgggtccacgacgcggccaaggtagccgtcgccgacgggcacggagagcacttcgccggtacgacgcacttcctggccttcctcgatacctgcgaagtcgccgagaataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcagtcgcgacataaccgacttcctgagtcggggtatccgacggcttgtacgactcgacgaactcatcgagcgccttgcgtatcgtggtgggatcaatggtaagttctgccatgatcactccttattgttgtttataaattcagtcaagtcttgtttcaggcttgttcaccgtgcggcgaaccgtcaggcggttgccttcaccgtgcgctgaagatgctgcagctgtgcgaccaccgtgttgtcggtgacctcgtcgcccacctggatgcgcatgccacccatgacggtcggatcgaccaccgagttgatgtgcaccggatgaccggtcttcgccgagtaaatggcgatgagcttttccacctgctccttgctcaacggcgttgccgtggtaacagtgaccatcgattcgcccatatggcgggagaatttgttgatcagccactgaatggtctgcaagtagcggcgattgcgcagattgcaggtcgcgtgttcggccagacgcttggtcaccttggtgaaatccgcgtctccaatcaggctgtacagcagcttgacacgggcttcactggaaacggttgcgtcatacagcttggtacgcacgaccggaaggttgagcagtgcggaatgcaactctgcgagctcgatggagacctgcaaagtcgtattggtgtaatccgcgtagtacatcatgccatcaacgccgaaatcctcaacggcattggcgatatcagacacgcggctccaacggcgagacaccagatcggacatgatctccatcacgagcggatgggcctggtctccgatcagagtcttgactaccgcaaccttgtcttcgactgggcgcgacgggtcggtgagggcacgttcaagctggatattgtggtcaagcgcgctggtgatcgtgaacagttcgttcccgatacgccatgcgtcctcaccgctgtcacgcagcttgggggccagcgagtcacgcgatacgcggtctgcgatacgcgatgcttctcctcgcattggtcacctccctttcttgaaggtttcgatcacttcttgtcgctgtccaagtcggcgatcatctggtcgatcatcgacgactgcacatcgtcattctcgagcttgctacccaggatcttgccggccagtgccgttgccagcacgccgacctcacccttgaggctcaccagagcctgctgctgctgcgattcgatggaacgctgggcggtggcggcgatctgcgccgcatcgttttcggcacgagtgcgcgcgtcagcgatgatatgcgatgcctccgtacgtgcgtcgtcacggatcttggatgcctcgacgcgagctttgctcagctgagcctcatacttcgccttggcttcatcggcatctttctgggcctgttcggccttggcgatgccaccttcgatcttggcagcgcgctcatcgaacacggcctggaacttcggcaggaagaacttgtagaagaacacggcgacgatgatcagaatgaccaacgaccagaaaatgtcgtagcttttcggaaggaacaattccatttcgctagctgcggtcaccatagtgtcttcctcctttcatgttcgtttgcgtcttcggtgttaccttgaatcaagtcttacttgatgaaggcgagcacgaagccgagcagtgccagcacctcgacgaatgccagacccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacaattaaaaagccggcggtcagtcgatctccggatagctcatattgatgtatgcggtggtcaggatggcgaagatgtaagcctgcaggcaagcgaccagcgcttcgaacaggaacatgaacatgccagccgcgaaggtgacgacgccgaatggcatgaacaccttgttcaccacatcaatgaggaagtactgcgtggccgaaaggcacagcgcaagaatcaagtggcccgaaaccatgttggcgaacagtcggatcgtcaacgagaacggacggataatcagcagctcaagcagctgaatcggggacagcagaatgtagatcggggccggaacacccttcgggaagatctcatccctcaggaagtggccgaggcccttttcacgaatgcctgcaatccagtattggcagaagcaccacatggcgaataccagcggcagcgtaatggttgcgcttgccgcgatattgaagcctgggatgatgccacacagattgaagaccaacaacgtgcagaacacggtggtgatcatcggcacataacgcttgccgcgcagctcgcccatcacctgatagacgatgttgtcacggacgaattcgatcaaccattcgactgctccctgccaacggctggggatgagctttgcacggcttgccgtaattccgagaaccagcaacatgatgacggtcgcaaggatgcgaacgaggatgatgcggttgatggcgaacggcgtgccctgaaaaacgaacggatcgggaaggaagtcatcgacactgggcatttcgggaccatcagcgatggtcagcatgccctttcccaatgcaccaatcattcacgcctcctgctcttgtgtcagctgttagtttaacccaacaaccgagtcgaatgtgacgttctggttacttaaccaaagcgtacttcgaagtgcgcgtcgacgcgaacggagtcccgtgcgacgcattcgactccgaatggctggataggattattagcccgtgtctagacaacatccacacacttgggcttttccatactcccatttggttttcccggcgtttcgcagcaagctgtactaactagacacagctttgtgaatcgtcggatagccgacgcaaccaatagtttgttttacgaaaacagcatattgataaaacgtttcaccaagtatatcacatataacacaggtgctgcatataaagaaagaggggccgcatacgcaagcccccaccagtaaacagccgtaaagtcacgcgccaatcacggccgcacgtcaatcacatcaatatgcggatcaatccacaaatcaatcgtgaatcacgccataaccgtcacgcacgaacggcgcaaacgcgtcgacacgcggcgaacccggctgatgacgaatcgaacgatccgtgccaagacgcttctgcgcacgaagctgcggaacctcgctcaaatcgtatggcgtggtctgatacacccaattcagccaattgcgccacaggagattggcatgggcgcgccacgcgaacaccggctccaactgcggatcatcatgcgggaaatagttttcggggaacggcacattcgtcatgcccttcttcatatcacgctcatactcctcggccaaggtgtacttgccgtactcccaatggccaagcgcgaacacttccgaaaaatcacgagtggcgatcagcccaggaccggacttcggaccccacgtgagcacctgcaactccggattgcgcgcgatatcaccctcgtccacccccgcaaggcgagaatgcggctgcaggcaaatctcatcgaagccgttcgtcaaaaagcagtattcatcctgcaaatactgcggaaacacgccaaaaatcttctctggcaaattctctttacgcacgttatagcgataattgagcgcacccatcgcaccccagcacaaatacatagtggagaacacatgcgcggaagcccagtcaagaatctgcttgaactcatcccaataatcgacctgttcgaaatcaagatgctcaacaggggcacccgtcaccacgaagccgtcgtaatagttgtcttggaacgcctcaatggtctcatagaacttcaccagatggtcggcgctcacatgcgtaccctcgtgcgtggaggtcttcatgaaatcgatctccacctgcagcggacttttcgagatcaaacgcagcagctgcgtttccgtctcgattttcttcggcatgagatttaagatcaccagcttgagcggacgcacgcgctggcgctccgcttcaggcttttcaagcgcgaaaatacgctcggagtcgagaatgtctctggccggaaggccgctggggatcttgataggcatgcttctattatggtgcgggctcggatatggcgcacttccctgcccccacgatcagccgaaaccgttataggaaaaatgaataacgcgctatttgcaacgcggttttgcatggccggactgatgcgacacgccgatttgacatatttggaagtaatcgtaaagttaatagagctgtcttaaagacaagccgacgcggggtggagcagctcggtagctcgctgggctcataacccagaggtccatggttcaaatccatgccccgctactgatgaaagctaggaattgcaacaattcctagcttttttgttttccgtcaaatctcaccaaaaccaatttccggacaaaatctggacaaaatccgacaaaaaccgggtatatcagccgagttcatcaatcgcatgtgccgaaagtatggagaaaatgcgccggatccgccaatcgcatgtgccgaaagcgaagattgccgctcaaggctgaaaatccaacgttctccaaggttgcacgcgctacgttgacctcgccaaccacatatcaccagatataaggagaacaaggcaatgcattatatgaatcaagcgaacgcgcacaacgcgacgcaggacaccacaatgcaagacagcgcaacgcacgatacggcaacaaaggcaacgcaggacaccgcgccgctgaaaggcatcaccgtgattgactggacgcaggtgcagtccggcccgtcgtgcacgcagatgctcgcatggatgggcgccgacgtcatcaaggtggagaaggtgcagggcggagatccgacacgtaatgaaatgaacgacgtggatggctcgtactccctgtacttccttcagctcaatgccaacaagaaatccatcacgctgaacatgagagatccggaaggcaagaaaatcctcgccgaactcctgaagaaagccgacgtgttcgtagagaatatcggcccgggagacgtggaaaagcttggtttcggatggaatgacgtacatgcgatcaatccgcgtctgatcatggcgtcgctgaagggcttcaacaagggcagccggttcgagcatgtcaaggcgttcgagccggtcgcgcagtccgcgggcggtgccgcttccaccaccggctggtatgacggcgagcgcaatgtgcccacgcagtccggcgccgcattgggcgattccaacagcggaatgcatctgctgatcgccattctttcggcgctgttgcagcgcgagcataccggtgagggttgctatgtgtaccagtcgatgcagaatgcggtgctgaacttgtgccgtgtcaagctgcgcgaccagttgattctcgaccgtttgggcaagctttcctactatgactgctacccgaattatgagtggggcaagcaaggcaaagccattccgcgcgcagcgaatgcggagggtggtttggtgcttggctggtgctaccgcgcgaaaggctgggagcatgacccgaacgcttacgtatatatagtggttcaacagtccaagaagggcttcgagaatttctgccatgcgatgggattcgaggattggctgaccgacccgcgtttcaataccgccaatgcgcgtgacgagcataaaaccgaggtgtaccagcgtgttgaggcgtacaccatgcagttcgacaagtacacgctgaccaaggaattgggtgcgaagggcgtgccggtcggcccggtgttggattggtatgagttggagaacgatcctgatttgaatggggatggcacgattgtgaccattgaccagcaggatgcgcgcggcgatttcaagacgatcggcatgccgtttacgatgagtaatttcgtgccggattaccagcgtgcgccgaagctgggcgagcataaccgtgagattctgcatgcgttgggatatgacgacgatcagatcgcttcgctgcgtgattccggtgtgatcggcggcaacgatggcgtgcaggctgatttgaagtaacgcacgttagcgcgcactggcgcacgaataagggcggatcacaagattcgcccttattcgttatgcgtcacatccattgcagttcacgccccgcacttccgcacacaatcccatgtcttacgtcttacggtttaccgtcacaaaaagcgcatgcagtaacggaacgttggaatttcaacgttccgttactatatgcgcttcgtgagctacagtgaggatactgaatcagcccacgcagaaggggacgagccagatccacagcagacaggtggccgcgaatgccaccgtggcgacggccgtggtcgaggcgccttcttttacataaatgttgtaacggctggaaataatgatgcctgagaacgccggcggcaacgcgaccgccatcaccagcatcgaaatcttgttcatgtcaccgcccatgccacacaacagcgccacgccaaggaacactgcaggcgtcagaatcaggcggaagaacgtgttccagatggtttcccaaccgagcgagaatttcaccgtggaaagcgcgaggcccgcggaaagcacggccacaccggaattcgctttggcgatcagatcgaaggtcggcgccacctggcttggcacatgaatgcccaccaacactaggaaaatggccaataacgacgcccagcagatcggttgcttcagtgcgtcgagcaacgcctgcagattgccgttgcggttctttcccgtattcgacgtgccatgcaccataagttcggcggttttgtcggttgcggcatctcgcgccgggtcaagcgtgatatcgccttttgcattggcctttgcattgaccgcgttttcggcctgcacgctaaacttcgctcggtctttggcctggccgaggttgatcagatacatgccgatcggaatggtcaccacgttgaccacgatggaaataatggctatgacgagattcgtgctgacggtgttgccgtaaatcggatcaagcacagcgaatccaaggaaaccaatcgtcggagatcctgcgatcagagcacagacggccgcctcctgaatgctgcggtggaacagcaaccggcacagataatagctcaccataaacatgacgatgacgccgatgaaactgatggcggtcaatgttgcgtctttcgcaagcattgcacgggtcgatttgatgatggacacaaataacgccgcaggaagcgcgatattcaacacaagtttattaagtccctgccgctgatcgtcatcaaaataactgaattttccacaaatataccctaatgccataatgacaataattggcacgatgtcgtcaacaagtatgtttatcactgtcgttctttctttatattttttctatctgcaatcttctgcaatattgtttgattgctgatattgcagatacgttgatcggatcattggttttcaggcagaaaaagtgggcgcacgcattccaccgttcgcacgcccacatgtcataccgacaaccgatgcgctacatgcgagcgccggtcgcgtagtcgtacatggtgacttcggaatcaacgagggctccgaccaccggcttcggattcaacgctccgatattgccggattccttgcccgcatactgcgcgatctgcacatgcacgaagcttggcttgcctgattcgaccgcctcgccgaccatgcgttcgacttcttccggagtgctggcatagtaacctttacccccgaacgcttcgaggaccttctcgtaatgcgcgttgtaagtaagcgtcagcggcgacggatcaccgtccgctccaaggttttcgaagtcgccgcggtagataccgccgttgttgagcaccacgaaggtgatgggcagctggtagcggcaggccacctccacttccataccatcgaagccgaatgcggaatcgccgccgatgtacagcactttcttgccagtggaaagcgccgcgccaatcgcatagccggtgccgcagcccatcacaccccacgtgccgcagtccaaacgatggcgcggttcgagcatgtcgatgatgttgcggcaatcatcgagcgaattggctccctcattggtgagaatgagatcttcatggtgtttgttgtacacctttttgatggctcccaaggcgttgaaatggctcatgggcagctgatcggattgttcgcgggtttcaaatttcgccacgtttttcgcgctggcttccttcagcatgttcagccaggtttcgtcagctttgaacgggtattcttccagagatccgttgagcagcgtcatggcggaacgaatatcccccacgattggtacgtcgatactgcgcgtgttttcgatttcttccggattgatgtcgatttggatgaatttcacatgttcgttccacgttttgccctggccgaacgacagcatccagttgagtcgcgcgccgaccagcaataccacgtcggcgttgcgtagcgcgatggaacggcagcttgccgtgctgtgtgggtcggtatcgggcactacgcctttggccatggacattggctggaatggaatatccgttttcttgacgaattcgcggatttcctcttcggcgcgggcgattgcggcgcctttgccgatcaccatgagcggacgttcggcctgccgcagcaatgcgagcgccgcgtcgatggatttgcgtgccggcaccatggcgggggccgggtcggttgccgtccacatcaggcggtcggcttcgctttggctcagggtctgcgccacggtgtcatcggggaaatcgatgtacaccgcgcctgggcgtcctgaagaggcgatatgcatggcacgggccaccgcgagcggaatatcttcgatgcggtcgatgcgcagcgaagccttgcagaactgcttggcgtagttcatctggtcgaggccttcgtattcgccttcctcaaggtcgaccacatggcgggttgaggagccgccgatcatgatgaccggatagccgttcaccgtggcttccagcagtgccggtagaccgttgaggaatcctggagcggataccgtcaacgtgacagccggccgaccggtgatgaatccgtcggccgcggccgcgttcacagcgtcctcctcatggcgcatgcccacgaatcgcatacccatgccctgcgcgatgcgcgcgaaatcggtgacgggaatgccgaccacgccatacatgtttcgtatgccgttggccatcagcacccgcgccagataatgcggcgcatcggtgaccttccgatcatcggctccctgccgttcggcatccgcacgcatgctcgcgaccatcgtttcatctgcatgttcttctgtcatcgcaacctccattcgtatcgacgacgccatgattgtagatacgtgaaaatgggagttcgtcagcagaaaaatatgttcgtctgcggcttaatttcaacgttttcagcatgatatagccgtattctcacgcacatgcggaatatattgcagctgaaatatcgcaactctcatcgagaagcatcacctccgcgagacgacatcatcgccgcatatcatcgtcgccgtaccgcatacagcatgaacgccccgcagcacatcacggcagccgccaaacccaacaccagccccatcggacttcctgtctgcggcatttcctgctcgggggcataaaggttgtcgacattgaacgtcagcaggctatcctcacgttccaccacatcgttcagcaccatcattttctgcgcggtgacggcctcatccaatcccacggactggtatccgaccttgatattgacctcgccggcacccgttgcatgccaatacacggtggttccctccagttcggcccagccgactgccgtgggctcgtcgtcctcgtcgaacacggccggaccttcgatcgtcgccgtgaatacgccctcgatcggctgtccactcgaatccagcaactgcacgaacaggcttccggaccgcaatccctgccgatcatcacgcgtcaccctcgaagaaaccggcagcttgttcgcggcctcctcccaaagctcgttgaccttgctttccagcccgtccatcaccgagaagaggtattgctcatgcctgacccacaccttttggtcgtcatagttgcggtgcaccagcacgccgatcgccgcatacgtgagcaccggttccccgtcatgttgatattcggacagcagccatgcgaggcgccgcgccgcttccgtattttccacggtggtggtttcggtgaccttatagtcggtcatgctttcgatttgccggcaataatagaatttgcccgatctcgattccgcgttcaccccgatcacatacggttttccatcgagaaaatagttgtaatgcttgccgttcgcgcgcagcagctgttcggcggccagcgcggccgggcaggtcattcccacgattatgatgcaggccgccaataccgcggccagaatcgcaagcgtatgtcgtttcatcgcattcatcgcatcgtcctttcgatatgcacatcgttgttgtcgtaattcaacaggcttgcatacttgcgattgccacatggcctttttcaagggttgtggtcggaggacgttctttttgccgtttttgtggacaacttcgcttgtcagcaaacgtaacttatccacaaaaaacgttttatcaatcgtaggtaaacaagttatccacaaagggtggaaatcgctggtcggaagatagttcacccaaatccaccttttctcctctataatcggcggtatggcagaagaagataagagcgcggaaccgcgcaccaccgcaaccaagcaaccagccgtcaagaagacgaccgccaaaagcgcggccgccaaaacggcatcggcaacgtctcagacgcctagcaagcgcaccgccgcagccaaaaagtccacggcatccaccgctcgcaagcgcaccaccaaagcgaaggccgccgcaccgcaaacggtcggcgaagccccagcccccgtcatcgaacgcaccagccccgaacagttcggccgcgtgaacgtgctcgacatcaccccgaacgttgagaacggcctgttcccggcacgcgtggagctcggcgaagcattcaacgtcaccgcccaagtgttcatcgaaggccgcaccaaggcaggagcgaccgtgtccgtgcgtaacgcacgcggccgcgaggttgaacgtttcgccatgacctgcaccaatccgggcctcgaccgctgggaagccatggtcaagatcggcgaacacagcgatctgaagccgtgggatgccgattatgccgccgtcaagcgtcagctgggcaaatggcagatcgtgatcgaaggctgggaagacacctaccagtcttggctgcacgacgccgccatcaaggttaaagtgaatgacgacgtggagaatgcgctggaatccggcgcacagctgctcgcacgttgggctgacgcgaaggattccaagctttccgcagccgacaagaaggtactgcgcgacgccgccaagaccatggaaaacaagtcgctgagcgccgaagagcgtctcgccgcagtccagagcagcgacatcgagcagctgcacgaaaccaacccgttgcgcgacggcctgtccgagtcgaatccgcagcgtttccgtgtggaacgcccgaagtccagcttcgcctcctggtatcagttcttcccacgttccgaaggagcctactacggtgaagacggcaagatcgttcccggcaacctcaagacgtcgatcgccggcttggaacgcgccgcagccgaaggcttcaacattgtgtatttgccgccgatcttcccgattggcgtgaccaaccgcaagggacgcaacaattccctggtagccggcccgaacgatccgggctccccgttcggcatcggctccgaactgggtggccacgacaccgttgacccgcagcttggcaccatggacgatttcaaggcattctgcgagcgcgcccacgagctgggcttggaaatcgcgcttgatttcgctttgcagtgctcgcctgaccatccgtgggtcaaggcgcatccgaactggttccgcaccaagccggacggcaccatcgcattcgcagagaatccaccgaagaagtatcaggacatttacccgatcgacttcaatgccgacatggaaggcatcgaaaaggaagtcgaacgcattatggatctgtgggtcaaggcgggtgtgacgatcttccgcgttgacaatcctcacaccaagccggtgcgtttctggcaggatgtgattgccgccgttacgaagaagcatccggaagtgctgttccttgccgaggcgttcacccgcccgggcatgatgcgcgcgctgagctatgtgggcttcacgcagtcgcactgctacttcccgtggcgtaacaccaaggaagagctcgaagagtacctcgaagagaccaacggcaatggcggcttctaccagcacaacacgttctggcccaccactccggatattctcaccgcctacgtgcgcgacaacggcattgccggccatgcggtgcgtgcggtgctcgccgctatgggcagcccgagctggggtatttacaacggctacgagctgatcgaaaacaagcagcgtccgggcttcgaagagcagatcgacaacgagaagtacgaagtcaaggtgcgcgattgggacagcaccgaaaagtacggcatcgccgaactgctgacctcgctcaacaagatccgtgacactcacccggcttgccgcagctaccacaacctgcacattctgccgagcgacgacgcgggcgtgatcgcattcctgcgtcagactccggccgaactgaccggtaccggcaaggcagatacgatgatcgtgatcgtgaacctcgacggacacaacgcgcaccagtccattgtgcacatcgagcttggcgacttcggtttcgccaccgacaagccgctcaaggtgcatgatgagctgaccggccgcgacttcgaatggggttacgacaactacgtttcgctcgccccttgggccgacgtggcacacgtgctcaccgtagtcgaagactgattgagtctcaatcgatctgattaatctcggtcagctcgactagaaattcgtttcgattcataccacaataccggttccacttcggtggaaagcggtattgtggttactgataatgcaaactgcccaatctcaaggagaaatgacatggcagaaaccttcaacgtcgtggtggaaattccgcgcggctccaagaacaagtacgaagtggaccacgagaccggccgcgtgttcctggaccgcaccctgttcacttccatgggttacccggatgactatggctacatcgacggcactctgggcgaggatggcgatccgctcgacgcgctcgtcatgatcccgaactccgtgttcccgggctgcgtggtggaatgccgcgccgttggcctgtaccacatggtcgacgaggctggcggagatgacaaggtgctgtgcgtgccggctgacgtacgtttcgacgacatcaaggatgtcgaagacgtttccgagtaccacaaggctgaaatcaagcacttcttcgagcagtacaaggctctggagccgggcaaggaagtgctgccgggcgattactggaccggtgccgccaaggccgaggaagaaatcgtggccgcccgcaagcgcctcgaagaatccgagaagtgatttccacgcctttctagatagctttaggtagcaatccgaggaaagcccgttgacgtacgcactcgcacacgtcaacgggcttttgcataccttccaacgtccagattccgccagtcactggaagaatcctcccgcaaaccagcccctcagcgggcaaaaacctccactcactggaacaatcaccccactaacacggcttccagcggacaaattcccccagtcactggaagaaaatgcccgcaaatcaacttctcagcgggcagattcctccaccgattggaggaaaacggacaaaaccataccctccaagtgtccagattcctccagcgagtggaagaaacagcccgcagacgggatacactcatactgcacgcgcatattcgccggggccgctatagtggaacacgtaattcacggcatgcgaacagtattcgcagaattcaaagcccgctggctggcgcggcagttctatgtcggtacccctaggcgtaggcggacgtgagactccgtcgaggcccatcccgtgggaaaccggcgggatgaacctatataccagctatgttgattcaaacattacttattgccgtttccgtatcgatggacacattcgccgtttccatcggcaaaggtctcaccgtcaaaaaactacgcggcctcgacgcgttcaaaaccgccctctggttcggcggatttcaggcgcttttcccactgctcggctatttcgccgcctccacgctcagcaaatacgtgaccgccgtcgaccattggatcattttcggcctgctcgccctcatcggcggcaacatggtgcgtgaagcattcgaagaggatgaagagaacgccaaggaaaccgctgatttcgattggaagcacatgcttccgctcgccgtggcctgcagcatcgacgcattcgccgtcggcgtcagtttcgcattcatgtcgttgaacatttggatttcagtgatcatcatcggcatcaccaccggcctgttctccgcagccggtctgtatatcggtcgcgcgttcggctcgcgctggcagaagcccgcacagatcgcaggtggcgtcgtgcttattctgatcggcgtgaaagtattgctggaacatctcggattcctcgcataataatcgcaaatcagatatacaaataaatatacaaacttacagcaaaagcccgtaattgcacatgattatgggcttttacattaccgcttgccgcaaatacttgcgattattttcctgcgctttcgcgttttctcgcgattgcaggaatcacactattagaacatgacggtcgcgtacgatgcgataccgaccacaattccggaaatcataaccggcagcagcgcaatgccgatccacggattcttggattgcggatcgggatcggcatcacgattccaccaatacgaacacgcgtcaagcgcgataatcagcaacaacgccacaatcaccgcaacagcccacgccgtcgtcgagccataatcggtggaagccgcgttttcgccggaacgaatcggcagcagcgtcgataggaagcaccagcccgcgctgccaatcatggcaacgccttccacaacattgtgcgacagcgaacgaatcagatgcgtacggttctcacgcgccatctgacgcccgaacgaaaccacaatcagcaggatcagcagaccgccgacgccggcgatccagccttcctgcatccaaaacgtgtcttcgtcacccaaaccggcagggaaaatcgcacgtccgagcatcatcgtcgtggcacacaccacggaaagcaagcccgcaatcacggaaatcgcatgccccgcaacaccatcgcggaacgggttgaacacggcaagcagcgcaatcatcgccacggaagccacaaccgtgaacgacacgattgcgggctcttccgcattcccataggaaatgccgggaatcagagcaagcacaaccagcaccacatatgcggcgatttggacggcaaacaccttgccgaacgaggctttctgagccgacttgacggcaactttttcagaggcggtcatttcgtccccttttcatgattttccataatgtggtcattacgtatgcgataccattaaatgtagccgcaagtgtccacatagttcagataaaattaatgaaacgccgacaacacacaacaagagtacaatcgcggcaacgatacaaaaccagtacaagagacaaagggagctaacgtgacggatctgacgcttatgacgttcgctagcgacccagctaccgtgcttccttctctggcgctgctttcccaccgcgtacgcgtgctaccaatggacgcggcaagtctggtgaaaatgccggaaaacaccattctttttctggatgcgcgagatgatctggccacggcgaaaacattgtgccgcctgattcatgcatccggactgtccacgccgatcgtgctcgtcctcaccgagggtggcttcaccgtggtcaattcgcagtggggcatcgccgacgtggtggtggcgtccgcttccccggccgaagttgaggggcgtcttcgcttggtatccgagcgcggcaactcgccggtcaatgcggtttccggttccggagaatcgggcgtgcagaacgaagacggcatgatccactccggcgacctggtggtggacaccaacggctatacggcaagtctgcatgggcatccgatcgacttggcatacaaggagttcgagcttctcaagtacctcgtgcagcatccgggacgcgtgttcacccgcgcgcagctgctgcaggaagtgtggggctatgactattacggcggcacccgcaccgtcgacgtgcatatccgtcgtcttcgcgccaagctgggcggcgaatacgagcatgtgatcggtaccgtgcgcaatgtcggctatcgttttgatcctccggaagaagaggaaggcgaggcggcagccaaggacgccgcagcccacaacgcttcgagcgaaaactgattgtcgcactattcgcattgcaagcattgcctgcgatttgcgatgcttgcgattgccacgatacttgcgatctgactgtcggctatctcactttcgtacgcgcgattgcatattcatgcgacggtagactggtgccatgccccgggaatcgaaacaagcgcgactgtcacgcatgcatcaggaatacgccgtattgtgcgaggagattccgcatccgaaatgcgcgctgaatttttcaaacccgtttgagctgctggtggcgaccgtgctaagcgcgcaaaccaccgacaaacgcgtgaatatggtcacaccggaattattcggcgaatatccgggaccggccgcacttgcgagcgccaatcccgaacacgtggaaagcatcattcattccatcggatttcatcatacgaaggcaaagaacatcatcggactttcttacgcattgtgcgaacggttcgacggcgaggtgccgcaaaccatggatgctttgacaagtctgcccggggtcgggcgcaaaaccgcgaacgtggtgcttggcaatgcttttggcgtgccgggattccctgtcgacacgcatgtgatccgtgtgaccgggcggctgcgctggcgttcggactgggcgagcggctcccccgaccccaaagccatcgaacgagagatcaccgcctgcttcccgcccgaagagtggacggacctgtctcacaggctgatattgcatggtcgtgccatatgccatgcgcgcaagcccgactgcctcaactgcccccttaacgacacctgtccgagcgcattcgcagcgtaacgcgcatgcccgctgtagcctgtgccaactagactcagcaccatggaagacaccatggaagaagaaaacgggcgggaagccaagctgaaagccgaaatcacgcgatggctgatctttttcggcgtcgccatcatgctcagcgtcatgacctggctgggctggtcgctgacgaaccgcaaaaatccgattacctccttcaccacgctcgtttccgactcctccgtggccatcggcattcagggcagcgcgccggaatcgctcgacatccgcaccgaacagggcaccgcgctggagcaggcgctgctcgaaaacgtgtacgaaaccctggtgtcacgcagcgaaaccaacaaactgcagccgtcaatcgcgaaatcatggcagatttccgacgacggactgacctacacgttcacgctcaacagcaacgtgaccttctccaacggacacaagctcgactcgtccgacgtggtctggtcgctgcaaaacgtcatcaacaacaattacgtgggatccgaccaacttggtagtctcaaggaaatcaccaatcccgacgaaaaaacggtggtcatcaccctcaatcagccgaatccgtgcctgctgcgcgcgttgagcgggcgtgccggcattgtttacgatgaggaaagcacggcgaattacggcaagaaagccgtgggatcgggaccgttcaccgtggaagcctcgtcgaaaacacagatcgtgctgcagcgcaacgactcgtattggggcaccaaagccgccgcatcgcaaataacgctgtattactacgcttccgaagattcgctggtcagcgccatggaagccaagaaaatcagcatggcattgccgttgagcgcgtctgccgccgatgagctcaaccagcaaagcggcatcaactccgacagcggcatcagcttcgacaaagtgatgctcgccttcaataacggcaccgaaagcccgttctccgacgagcagatccgcaaaatgacgagatacgccatcgacgcgcagaccatcgccaaagacgctccggacgcctattcgccgctcggaggcccgataagcccgctggaagacgggtatgaggatctgagcgaactgttcccctacaatcttgagcagggccagcagatgcgcagctatttcggcgcatactatatcgccgatatcgatctgctggtgcccaaggaatatgagcagatcggcaacaccgtgaaatcggcgatcgaacagctcaatatcggcgtcaatctggaagtgctcgattccgcggcgcaagtcacggaacgcatgaacgcgggcacctacaatatcgcgctcaccaccatgagcggcgaaaacgatgcgagcgtattcaccgacggccagagcgtgttccattatgagaacggcgatgtgcagcaggcatatgcggacgcgatggcggccaccaatgatgacgattatcaggcacgcatgcgcacgtatgcacgcgccgtcagcgaaaacgcggcaagcgactggctgtacacgcgcaagaatttcatggcggtaagcgaccaattgcagggatatccgaaaaatctgaccgaccgtctgctgccgttgagcagagtgaagttgcagtgattttcccgcgattgtcaatcaatcgccgaacactgcggacaatccgtgtgttgcgctgattttcttgcgatttcggcattcggctgcagttccgtaagttgtcacattcgctttctagactagcgtttatgactgaaagccaagataataccatcaacgcgaacctcacgccgctgcccgacaaggtcggcgtggacggtctcgaagacaagtggcgcgaagtctgggacgaaagcgaagtctacaagttccagggcacccgcgaccgcaaggccgtgtattccatcgacaccccgccgcccaccgtttccggccacctgcacgtgggccacgtgttctcgtacacgcataccgatgtgatcgcgcgattcaagcgcatgaacggctacgacgtgttctacccgatgggctgggacgacaacggcctgccaaccgaacgccgtgtgcagaactattacggcgtgcgtgtggacacctccctcaagtacgatcctgatttcgtgccgccgttcgaaggcaccgatggcaagaagatcgacgccaaggatcaggttccgatctcccgtaagaacttcatcgaactgtgcgagaagctcaccgcccaggatgagaagcagttcgaggcgctgtggcgttccctcggcctgtccatcgactggacgcagacctaccacaccatcggcgagcacccgcagcgcgtggcccagaaggcgttcctgcgcaatctggcccgcggcgaagcgtatcagaaagacgctccgggcctgtgggatgtgaccttccagaccgcagtggcccaggccgagctggaatcccgcgaatatccgggcttctaccacaaggtggcgttccgcttcgaagacggcactccgatctacatcgaaaccacccgtccggaactgctggcagcctgcggcgcactgatcgcgcacccggatgacgagcgttacaagccgtatttcggccagtacgtctactccccgctgttccacgtgaaggtgccgattctggcgcacaaggccgcggaaatggacaagggcgcaggtatcgccatgtgctgtacgttcggtgacgtgaccgacgttgagtggtggcgtgatctgaacctgccgctgcgttccatcatccagcgcaacggacgcatcgtgatggacaccccggactggatcgaagacgaggaaggcaagcgcgtcttccaggaaaccgccggcaagacgacattctccgcacgcaagatcatcgtcgacgcactgcgcgaatccggcgatcttgacggcgaaccgactccgaccaagcgtatgacgaacttctacgagaagggtgacaagccgctcgaaatcgtcacttcccgccagtggtacctcaagaacggcggcaccgatcagaagctgaacgccgaactgatcgaacgcggtcgcgaactgaacttccatcctgatttcatgcgcgtgcgttacgaaaactgggtgaacggcctgaatggcgattggctgatctcccgtcagcgcttcttcggcgtgccgttcccgctgtggtatccggtgaaggaagatggcaccgccgattacgatcatccgatcgtgccgagcgaggaccgcttgccgatcgatccgaccgacgatgtgccggaaggctacagcgaggaccagcgcgacgtgcccggtggcttcaccgccgaacctgacatcatggatacgtgggcgacctcgtcgctcaccccgcagatcgtgacccgctgggaagagccaggcgaagagaaccaggcaattttcaacgccaccttcccgatggatctgcgtccgcagggtcaggacatcatccgcacctggctgttctccaccgtggatcgcgcgcatctcgagaacaagtgtctgccgtgggccaatgccaccctgtctggatggattcttgatccggatcacaagaagatgtcgaagtccaagggcaacgtagttgtgccagacaagccgatcaagcagttcggcgccgacgcggtgcgttattgggccgctgcggcacgtttgggcctggatgccacctacgacgaaggccagatgaagatcggccgccgtttggccatcaagctgctcaacgccaccaagttcgcactggccatcggccgtgaggatgagaaccaccatgtgggcgctccggcaaccgcaagctggaaccctgccgacgtgaccgagccgctggaccgcgcagccatggccaagatggccctcgtagtgcgcgaagccaccgaaagcctcaacaactacgagcattccaaggctttggaagtcatcgaaaactacttctggcagttctgcgacgattacatcgagctggtcaagaaccgcgcgtacggcaccgcagactccaccggccatgtgccgagcgagaaggccgtgaagtccgctcgcaccgcgctgggactgggcttggatgccttcgcacgcctgctggcaccgtacctgccgtacgccaccgaagaagtgtggagctggatgcatgagggcgaaggctccgtgcaccacgccgcatggccgaaggctgaaacgtacgatgcggccgcagcagccgtctccccggagctgttcacccatgccggtgaagctctggccgcgctgcgtggcatcaagtcgaaggccaaggtttcgatgaagaccccgatcctttccgtgcagctgggcgtttccgatgaagcgcgcgaatccatcgaaagcgcattgggcgatatcgccgaggccggtcgcgtggtcggacgcatctccttcatgggagcggccgccgcactgaaggccgtcaaggaaaccgccgaagcagccaaggaagccgtcaaggaggccaaggctgatgccgaagccgccatcgacgtgattgtggccgacagcgaacttggagagccgccggctaaaaagccgaagaactaatggcaactgtaggtgaaaccggcagccttcgtggcaaagccgttcacttcacctacagacagtccacaggactgtctgcttaacggctcagccggctaaaaaagcctaagaggggatcttccacgattggaaggccccctctttgtgtatctggatcctatgtttatacatttttataaaacgggaactgcaagcagatattgagattgcgcggccttagcaggctgcgattgcacaggcatatccggatacagcttctgcaaagcctgctgcaatatttcggcagcggccgcaatttcaacggtctcgtcaatcaaatcgctattatcaggcacaatcaacgtgcgatttccggaaccagcaatgccgtatgctgcaatcggcaacgcacttgtcatcaacatttcggaagatgcggtttttcctgttgttccagtattttcagatgcggaatctaccgaatcgccatcgctggatttctttgattccactcccccgactttcgcaacgttcttcgacgtggtatcggcagccgcgccaaatgacgatcgcaggccgcccgcgtagctcatcacatcatccatgctgatggcgttcttgtcgtccaccaagctggccgcagtaccgtcggaagcgttctgctgattggccgcatccgcctgcgcgcgttcctctttgcgttgggccttgatacgcgcccgctcggcacggcccgcaagcgacgtctccgaagccgaggcaagtcccatagaccccttcaacgtaacttccgaaccatcgacagtatcgtcggaactggtcgaatcatcacctgcatcaagctgatccgcaaaacgaagcacgatctcgtggaacgcactggcctgacccgtgtgctcgctcgcatccgccaacgtctgcatcgcatcgtcaaccttgcttgaagccgacttcaacttctcattgccgtcaatgctgttgcgcacatccgcaatcgcctgagattccaagttttgcgccgaacctgcggaagcccccaattccttaagccgagcggtgtacgcgtcggtgaaatccatggaatacggaatcatcgccgaagaaagctgcgactggccggcactgtaatccttggcgccacgctgctgctcctcgcccgcacgcttgttgagttccgccaccaaaccggatgtgccacgctgttcgatggtgcgaatcacctcgttcaccgcgtcggcggcacccgtatgtcggtatgcggcgctcacatcgttgaccgcgttggccagatcgaccacggactgcgccaccgcagtatcgccgttcaattcggccgcggtgccgagaatggcggtaagttgcgtggtatcgccaatcgatccggaaagatgcgtcgtatacgagccgacgtacgcgtcgatatacccgttgaacgcctgctcatgttcctgctcacgctgggcgatggtcgtttcggcaagctccttttcatgatcgcgcagttgttcgagctgcgcgatgagctcatggttgcgttgcgatccgacattcgtcaaaccatccaccaatgtggatgcgcgatcggtcaaactggtgagattgccatagcagccagttctttcggaatcgcaggcaacagcggcgacagacagcgaactcatggtgaagtttttcgcagtcacatacgtatgaatcgtaagatcctcacccggcttgcctaccgcagcgaccaatgtcgacgaattgccggcagacacaagcacgccttcgtctgaggtcgcgtcattgccgacgcggttgggaatggtgaacgcgacgatcggcgtcagatcagccgtttcctccggtcgttccgatttcagatcgatgcggatgccgaccacgcccgatgcaccggaaatcttggatgcgctgacggtcggaccgtccaaagtaaaggtcgccgttatatcccacggcagttccacacgctcttgcggcacgcgctgcgaagacgtcgcgccctcatctgcattcatgtccgtatcagttgcagaagcggcgtcactcgtcaaatacaagcggcccggctcatcaacggactcatatgcgctcatcacatcgtgcgaggccaccgccgagacgtactcgccgttccgacgcaccacatcaaccacattcgaaaccccgaccgcgcatacgggagccgccgaaaccagcgttaccgcaatggacgcagccagcatgtgccgcagatggacactcgccacacgcatatcacgctcaccacgcgtgctatcggcatgatgggcacaagatgcacgaaacgcaacagaacgacgcatgccgagcctctcaatcgcaatcaaaacaacgttccaaagcaatcaatgtagcgcgcggcatgccccggcaagaaacgatttcgcggaaaacagacaggtcaggcgaatacgtcgagcacacccggatcgacgccgttctcggcgatgcgcttatgcctgcgcttggcttcggtcaccacgaattcgcgatacatttcggcgatgtcgggatccaacccggcatcgacagcaatgcggtgcaaccgttcgatctggtaatcctcacgcttgtaatcggccggcgcgaaacccgcgcgggctttcagcacacccacttgggacgtgtatttgaagcgttccgccagtagggaaacgatggccgtgtcgacattgtcgatcgactggcgcaatgcagcgattttcgccacggcatcggcgacctcgggattgctttgcgcggtgcccgcatcgatgacggtttcggtttcatgctcttcttctggccgaagccagtcatgttcgctatcgctcatgcgtacaagactaccgcgcgcatgtcacttggagaagtaccgttgcagcacaatcgtggtttccgtgctcaccggcaccgtttggtggatgacgttcagcagatcctcaagcttgcttggcgaggctgcgcgcacggtcagcatgtagctgggtgacccggccacggaatcgcacgacatgatgccttcgatatcctgcaatttggcgggaatctcggcttccttggaataatcgatcggcgtgaccgcaatgtaggcacgtacggcgaggccacgcttttcatcgtcgataacggccttgtagccgagaatcacattacgacgttccagtttctgcacgcgcgattgcaccgcggaaatcgacagtcccgtagcgtccgaaagctgagacagcgtagcgcggccgtctttctccagcatgctgagaatggtctcgtcgatatcgtcgaattggcccacgctcgcatgcgtggtgtcgggttcgttgccattgcctgtcatagatgcccctttccaacaagcattctgcatcagtccggtaggaccgactcccctatgcagctcacgtttccgtccattaccatacccaccccaacacacaatccgtcaactgcattttcgtaacatttccaacgaatttcgattttcaatcatttttctcctatttttttcatataccccctatatagcaatactattttcgtctttttactttcgatttcgtattttttcgtgcgtcgatttttacataccgtatgtccacaacgtgatcatccacattgccgaatcgtgcggaactttcgaaaaacaatcgaaacgcattcgaaagtagttgaaaactgcaaaacggaaaaacagccgaacagaaagacagccgaacgaaacaaaagggccgcatggcgattgtcatacgacccttggatgcgtaaccgcagattgcgattacctgcgattagctgttgccgttattcgcggtattgccgctctgctggatcagcgacgccatgaaatcacggttggtcgcggtcttcttcagacgcggcacaagcgtctggtaagcctgctcaggctccagaccgccaagcagacgacgcagacggtagatgatcggcagctcctgcggatcggtgatgagttcctcgcgacgggtgccggaagcgttcacgtcgatggccgggaacaggcgcttgtctgccagttcgcggctcaggcgcagctccatgttgccggtgcccttgaactcctcgaaaatcacctcgtccatcttggagccggtttccaccagtgcggaggagatgatggtcagagagccgccgttttcgatgttacgagcggcaccgaagaacttcttcggtgggtacagcgcctgggcatccacaccaccggaaagaatacggccggaagccggagcggcgatgttgtaggcacgggccagacgggtcatggaatcaagcagcaccaccacgtcctggccaagctccacgagacgcttcgcgcgttcgatggcgagttcggcgacggtggtgtggtcggaggccggacggtcgaaggtggaggaaatgacctcgccctgcaccgtacgttccatatcggtgacctcttccggacgttcgtccacgagcacgaccatcaggtggacttccggattgttggtggcgatcgcgttggcgatgttctgcagggtgatggtcttgccggccttcggcggagacacgatcaggccacgctggcccttgccgatcggcgccacgatgtcgatgaggcggccggtgagcttgttcggcgcggtttcctgcttcagacgctcctgcggatacagcggagtgagcttgttgaactgcggacggttctgtgcggcctccacggtcatgccgttgatggagtcgatggactgcagcggcacgaacttctgacgctggttgcggcggtcgccctcacgcggggtacggatggaaccgtgcacggcatcacccttgcgcagcccatacttcttgacctggcccatggaaacgtacacgtcgttcggacccggcaaatagccggaggtacgcacgaaagcgtaggaatcgagcacgtcgacgatgcccgcgacaggcacgagatcctctttcggctcctcgtgacgctgttcgcgttcaacattgcgatccgtgcgctcgttgcgctcgacgcgatcgttacgctcgttgcgatcattgttacggtcgccggtacggccacgacgctcgtcacgctcgtcataatcgcggtcacggccacgcaggcgacggccacgacgatccacgcggtcacccctatcgctgacgcgaccgcgaccacgacgcgcgaaatcaccgtcttcagcctcgtcacgacgttcgtcatcatcactgccctgcgaaggcaacgtggcgagaatgtcatcaagatcgcgcacaacgtcctcatccttcggcccttccaccgcacgacggcgacggcgcggctcaacgtcggacgcatcatccttacgatggcgacgacgatcatcctgcttcggcgaagcatcgtccaatcccagttcggccagcagatcggtggcagcgtccgcatcacggcggcgacggcgcttcggagcctcatcgatgctgtccagggcgttcaccgcggccatgacatcggccgcctcctcgctcgtcggagcctcagcctgcttgcgacggtcagcacgctcggtgcgctcggcacgttccgtctgttcggagcgctccgcacgctcagcgctatcagcacgtccggcaagggtcttcctaacggttttggccgtctgcttttcggactgctcagcctcgttggctttgctttcggcagcctcgttggacttgccggattcctcagccgtgttcgccgcgacctcagcgtctgcggtttgggcttcagcatgagccaccggagcggccggtgcagcggacttcggagctcgcacggtcacaccggcaggcgcttcaccgccggaacgagcggcctgaagcgtcgcgataagttccggcttacgcatggtggaggtgccgcgaaggcccatctgcttggcgagctccttgagctcaggcagtttcatgtcttcaagattcgggctggttgccactggtttttgcctttcccctagctttcgcaagcacacgcctgcaacagctgtaaaaagagatacggaaatttccgccactgaaagtccgccgcgaaatatcacggttttcgaacttccctaaccatacaacgtcatccagaccaacgcaacgtaggcgtgccaacgtattcatgccaatcaagcattcaagtcaatgacaaatcgcaaatcacaatgcgaaagacccgccatgcgatcacatgacgggtctttcgctttaccacatgctttacagcaacaggtgcaggtcttgccggaacctacttttcctcgtgatagctcttgtcggtattgacggaccatacgttcttcttggacgtcttgccgttcttgatattgccgacggcctcgattgcggtggccatggaatgatccatgttgttgtaacgatgctggccgttgcggccgacgcaatacagattgccgaaggaatcgaggtattccacgagctcaggcatgcgatcgtaggtgtcgaaatatgccggatacgccttcttcacgcgctcacgatgggagtcgatcacgtcttgcggaccgttgatgatctgcatgcgcgtaagctcctggatggcgaacttcttcgcttcctcgtcagacatgttccagaaggaatcgccttcttcgcagaagtattcaagaccgatccacacggtgttgtcaacgtccttgaccaggtacgggctccagttgttgaagatctgcaaacggccgaccttgtagcccggatcctgcacgtaaatccagcaatcaggcacgatcggcgggttgccgagggtgggaatgtcggtggtgttcgacaggcgcaggtgcttgacgagcagaccaacggtcacgaagtcgcggtacggcaggccgttggcgatttcggtcatgtccttcggcgcgggctggctggaagcgtccacggcgttgatgagatccttgacgggcatggaggagatgaagtcgtccgcggccatttcggtgcggttgccttcggaatcctcatataccacggatgcgatcttgccgtcggcctggcgaatctccaccacgttcgcgtcggtgatgaccttcacgcccgcggcctcgcagttggcctcgacggtttcccacagctggcccggaccatacttcggataccagaattcctcaatcagcgaggtttcaacctcggcattgctgcgcttcttcggcaggagcttctggaacgcgttcttcagcacgcccataatgctcaggcccttgacgcgctgcgcaccccaatcggcggaaatctgggacggatggcgaccccacagcttctcggtgtacccctcgaagaacatggaatacagcttgcggccgaaacgattgatgtagaagttctccagattgtcttccggcagcttgtgcaccatggacttcaggtagctgaagccggcaacaagcgtaagcttcggacccatggccttcaacgtgttggcgctcagggaaatcgggtagtcaaagaagtggcggttccagtaaatacgagacacgcgatgacgcttaagcatcaccttgtcttcgacttccggatccggtccgcccggttccatatcgtgctcgcgaccgagcttcttgtcatcatagcttggcgcgccctgcagcggcaggacccccttccaccaatccatgatgcgttcgtccttcgagaagaaacgatggccgccaatatccatacggttgccatcatgcttgacggtgcgggagatgccgccgaattcgcgggtcgcttccaacacagtcacgtcgtagttctcggagccaccgtccttgacgagctcccaagcggcagtcaggcctgcagggccaccgccgataatcaccacggattgcttttgcgtcactttgaggtctccttatgaaaacaaaaatccctgatagtctacccgagggtagggaaacgaacaccgcaacttgtgcgaatgcttacaaaatcaagccaagtcagccggatatacggctatcgcatcatgcaaaacgcaatcatcaaaccggccgatgcacgacccgactgcgcggccaaagcgcgcaaccacattacgcaatccaactacgcgaccagcaaccgcacaactggcaaccgcgtgaccggcaactgcgcaactagatggaatcaggaatgtcaatatcggttttctgcacttcctcaacattgacatccttgaacgtgacgatacgcacgttcttgacgaaacgactggaacgatagacgtcccacacccaagcatcagtcaggcgcacgtcgaaatacacgtcctggcctgcggaacgcacattgaaatcgactttattcgccaaataaaagcgacgttccgtttcaacaacatacgtaaacagcttgattacgtcgcgatactccttatacagagccagttccgcgtcggtttcgtaattatcgagatcctcggcgctcatcacttaccttccgtatcgcgcttgcgaccacgaccaagcgtgcgccaccaagcttccttcgacgtcttacgctcgcccgccgtgtacggccagctgttttcggcatcggcatcgccagtaacggacttgcgatcatcatgctcgctttgtcgcgcaggttccgcgccttccgcgtccttccgcacagcctcggccacgtcaccagcaccatcggaagaagctttctgcacggattgcgcagctgccgcggcatcgttgacatccgtaccttccgcatcatgcttcgaagcattcttctcattcagtcggatggcaatggaatgctcgcgcgcgctcaacgcttccttgacgcccggattatcttcgatcacatgcatgccgaacgcgtcaagcgaacggatcgggtcgaactcgtcaaccagcgtgtccataacgatcagatcctggtaacggttctgcgaagcgttccacaaggcgtcgcgcgaacgaccggacggcacgaatcccaacgactggtacacggacacggaacgcgtgttctgctcgggcacggcaacccaaatgcgatgcatgccaaggcctgccggttccggcgcaagtccgtacgtcatcacgcgcggcatgatgtcacgcgaatagccacggccgcggtaatccttgccaagcaccacctgaatgcgcgcggaacgagcccaaccgtcaatatcgatcaggaaaatcatgccaatcacattgtcggaattcgcggcatcgatctcgccatcgccatcatggtcggcttcggtgatgatggaccatgcgatcgtgcgacgcgactccggatcccccacaccggattcggtcggcgtttcgccttgggaccatgccacggaacgacgcacccacgcatgcaccgcgccacgctcggcaacccgatccttgccggtgattccggaagcgccgatgtacgccccaatggcgtccatacgttcaagatcttcgatcacggacggacgcagatgcaccatctcgcccttgatagacggaatgacgatgagatccggcaattcacgcgactgctggtccaactgctcctgtgtcgcagcctcaacttgttctggcattattcctgtcccctacatcattgcaggcacgaccgtcgccgcacccataccgagggtattgtacccgactgtatgtcagctgtgaatccgcgcggcggcaatcgctgtacatattcctctaccagcataacctgatgttgaaggacatgtcggcaatcgtaagaaaatgcgcttcgcgattatgcattctctttctttgaaatcccttttccggaataacgaaaagaaaacgcacgtcccaagctttttggaacgtgcgttttcctgcgattcaacaatcggctgtaatcgtcagcaatcgttgtaaacgttacttgatcttgctcatcacgatcttggtgacggcctttgcgtcagcctgaccgcgagtggcacgcatgacggcaccaatgatggcgcccatcggcttcatattgccgctcttgagcttttcaacgatgtcaggattggctgcgagagcctcattcacggccttttcgagagcgccgtcatcagacacgacctggaagccatgcttcttgacgacctcatccggagtgccttcgccagcaagcacaccggcgacggtctgcttggccagcttgtcgttgagcttgccatcggcgatcagcttctcaacctcagccacatcggccggagcgatcggtagctcttcgaggctcacgcccttgttgttggcttcacggctcagctcgcccagccaccacttcttggcacctgcggcggtggcaccagccttgacggtctcctcaagcagatccagagcgtcggcgttgagcacgtcacgcatctccaaatcgttgaagccccactcgcccttcaggcggttgcggcgctcgcgcggcatttccggcatctgagccttcatctcttcgatgtgctccttggtgatgtgcagcatcaccagatccggatccgggaagtagcggtaatcgtcggcatcggacttcacgcggccgcctgcggtggtctgcgaagcctcatcccagtggcgggtttcctgcagaatctcgccgccttcgctcagaatggccgcctgacggcgaatctcatactgaatggtcttttcaataccgcggaacgagttcacgttcttggtttcggaacgggtgccgaacggatcggacgggctgttgcgcagcgacacgttcacgtcggcacgcatgttgccctgctccatgcgagcgtgggaaatattaagcgcacgcacgatgtcgcggatggcgcgcatgtaggcaccggcgatttccggagcacgatcgcctgcgccaacgatcggcttggtcacgatttcgatcagaggaacgcctgcacggttgtagtcgaccagggagtggtcagcgccttcgatacggccgtcagcgccaccgacgtgggtgttcttgcctgcgtcgtcttcgatgtgggcgcgttcgatcggcacacggaacacggtgccgtcttcaagttccacatcaagatagccgttgccgttggtcggcttgtcatactgcgagatctggtaatcgcgcggcatgtccgggtagaagtagttcttacgcgcgaactggctccactcggcaatttcgcaatgcagggcaagacccagcttgatggcgtaatcgacggcggtcttgttgaccaccggcagagaacccggcagaccaaggctcaccggggtgagctggctgttcggatcgccaccgaacgagacttcggccgggcagaacagcttcgtggtggtgctcagctcaacatgggtttccagaccgatgaccggatcgaacttcttgacggcatcggcgtacttcatcaacttttcagccattttgttttctttcctccgatgcttcctacttgttcaagccgtcgagccacggggtcttcagggactgccagatcggaccgttccagtcttcctcgagagccgcctcaagtgccgcggcaggcttgtacatggcctcgtcacgctgctgcggagcgaggaactggaagccaaccggcaagccgtcgtcgctcagaccagcaggaatgctcatggccggaacgcctgcaaggttggccggaatggtggtgatatcgatggcatacatggccatcggatcctcggtcttctcaccgaacttgaatgcggtgaccgggctggtcgggccaacaagcacgtcgaccttctcgaaagccttcttgaaatcgtcgatgatcagggtgcgcaccttctgtgcggaaccgtaccatgcatcgtaataaccggcggacagggcatacgtgccaaggatgatacgacgcttgacctcgtcgccgaaaccggcttcacgagtgtaggccatcatgttggcggcggtctgcggaacgcctgccggcggcatgacgcgcagaccgtaacgcatgccatcgtaacgagccaggttggagctgacctcggacggcatgatgatgtagtacgcgccaagggagtacggcaggtgcggcagagacacttcagtgacttcagcgcccatctcctcaagcttcttgacaccttcgttgaagcgtgccataacgcccggctggaagccttcgccgccgagctccttgatcagaccgaccttgaggcccttcagatcacgcttcatgccttcgcgggcggccgccaccatcgggcgaggaccttccggaatggacgtggaatcgcgcttgtcgtggcctccgatcacttcctgcagcagggccgcgtcgagcacagtacgggagcatgggccgatctggtcgagcgaggaagccatggcgattgcgccgaaacgagagacaccgccgtaggtcggcttgacaccgacggtaccggtcagcgagcccggctgacggatggagccaccggtgtcggtacccagggcgagcggggcttcgaacgctgccactgcagctgcggaaccaccgccggaaccgcccggaacacgttcggtatcccacggattgtgtgtggtctggtaggcggaatgctcggtggacgaaccctgagcgaactcatcgaggttggtcttgcccagcagcggcatgcctgcagccttgagcttctcgatgacggtagcgtcgtacggaggcacccagccttcgaggatcttggaggctgcggtggtttcgatgcccttggtgacgatcatgtctttgatggcgatcggcacgccggcaagttccggcagctgtgccttttcctcatcggacttggcatcgaaggcgtcggcctgttcgagagcctgatcgccggacaccttcaggaaagccttgatgctcggctcggcggcctcgatgacttcgagatgcgcttcaaccagttcacggctggagacttccttggccttgatcttagccgccatctcggcggcggaaagcttgacgagttcgctcatgtcactcctcccccagaatgcgcggtgcaacaaacatgccggcctcggaaaccggggctcctgcggtcgcctcttcctgagtcagcggggtttccggcacatccgggcgcaggtaggcttccagcggaatcgggttcgcggttggttccacatcgtcggtagcgacttcctggaccttgttgatggattctgcgatgacgttcagatcgccctgcagacgggtgatctcctcgtcagtaagtgcaattcgggccaaatcgcccagatgcacgatttcttctttggtgaaagtaggcatgtccctaacattaacgcgtctgtgtgacgagcgcccgcccatttcgcctcgcccggcaaccccacactgcatgccgcccggcagccccacacgctaaccgcaacagcccgccgcaccaacaccccagctctgtcagagtcccaaatcccccacccactggaacaaaaggacgccaaacgctgtttcaccgggcaaatccctccagacactggaggattcttcccgccaacaagccatccacagtccaaaacctccatccacagtcccaaaacctccactcactggaacaatccgggcccaaaccagcctctcatcgtcccgattcgtccacccgctggaagaatcttcccgctgaacgctctgctggagtccggattcctccagaagatggaaggatcctcccgcggaaggccccactagaggccaaaatcctccagtcattggaacaaaacggacactaaaagcaatacaaccgtctaaaaacctccagccactggatgaattctcccactagcgcttcgtcagagcccctattcctccacccaatggaagaattctcccgcaagccagccatccacagtcccaatacctccacccaatggaggaatctggactctgaacggcatcccaatacttaaaaatatccaaccaatagaagaaaacaacaaaaattcacacaaaacaagcggatacaagcacttatctgcaaaacaaccacccagttatccacaaaacccgtaagttatccacagacacgcccgaaacagcatcctctatccacatttgccgatcgcacttccatagcagagccacaacaaggtagcgtcaaatcatgaaagcatatcctcaaatcgatgcgctgctcgatcaaacagaaaatgcgcaacgatgcgcacacagcagtgaccctctcatccagaagggactatatcgcagataccgcgcgggagatttggcgcgcccgtacccagggctattcgcccgtgccgaatattggaatcagctgaacgagcccgaacaatcgttgcacgcggcccgaaccctcagcaggctccaccccaactgggttttcgcaggaataacagccgccgcagcccacggattcgaccacccgcgattcctgcaccggcaaggactgaccataacattgcccaatcacggatcataccggccgcacgacaaactcaatatcatctacagcccatatcccagagaaaatgcggtactcgcaaacggaatccatgtcactaatccccctcgtaccttattggactgtggacggacgttagagttcatctattccctgccgattttcgatgatgcagcagcagacggaatcgaagaaaagcagatcttgcaggaatgcgcacgcacgacactcgattgctcgcgcatcttcaaattgttgagatataccgacgcaggaagtgaaaatggcggtgaatcttttgctcgggcagtcatgattgaaaacggttttgcggttcctcaattgcaagtctccttcgccgactcgcttacgggaaaacaatttagggtcgattttttatggcgcacaaccgatggacgtattattgtcggagaacttgacggcacagcaaaatacgttgatccgaaaatgactgatcgtaggagcatccaggagaccgttcaggccgagcgagaacgcgagcaagcgctttttcgcgcaggagttacggaaattgtcagattaacttttgacgatgcagtccagcaaaaaccgctgattgcgaaactgcggcgtgctggggttccttgcgtttcatagggtaatcatctgcgggaagattcctccagtaagtggaggaatcggaacgttgagaagctcgccaccgggaagattcctccagagggtggagaaatctagactctagcagggcactcagcggaaagattgctccagtaagtggaggaatcttcccgcagaacaccgtactaaagtcccaacctcgccagtcactgaaggactcaccccgccagacgccccacaggagacccaaaacctccacccactggaacaatcatcccgctgacagaactccaatcgtcccgattcttccagtcactggaggattttggacgataggagatggaggttagagctggggagcggcgtgctgggagatccatgcgtgcatggagactgctgcggcagctccggcgttaatggaacggactgagccgaactgagaaatgtagaccacgtcatcggccagctcgagcgccttttcagacaatcccggaccttccgcgccgaacagcatgaggcatcgcttcgggaaatggtaggtttccatcggcaccgcgccgggaatgatatcgagcgcaatcacccgcgcggccttcaactcggcgatacgctgattaatcgccgccaactgcgccatacaagtggactcgtttccatgttcaataccactcgtagctgaaacgtccattgaaataccagatggagcgcacccagcaacacggatctcagctaacgaagccgcctcgctcatgcaggcacagttcgctttttttgcattttcgcgcatgcggaatgcgattgcggccgcttgcgattggactgcggcgatttctccggcaatgcgcagcttccagcattcgacaagttcggttatggaagggtggttttcgacgtgctggtacagttccgtcatcagcgaccccttgcgattccacttgtgcggtccgacgatatgtacacgtttcgcttggaatgcgttggcagtgcgcaccatggatccgatattgaaatcgtgcgtccagttttccacggcgacttcgaaatcatgccgaccatgatcgtcaagatcatctttaatggccgaaaccgtccagtagcggtaccggtcaagcacgttacgacggtcgccctcatcaagcagcacagtatcgaatcgacgatcataattcggtgattgcggatcatccggacgaggttcgccaggatgcgtttggccccacggacctacgcccacctcacgaaaagccggctctccggacgctttcgccgcaatatcaataggattaggctgatgcacgattttcctcacattcgtcgtccgatatttcgtcgacaggtaacttctgttatatcttccaccattcgcccacgatcaacatcggcaatcgcagcattgcccaccgcgattttggagatcgcctgccgtcaaccgcatccgtactgccgactttatttttcctttactcatgtcagcatgaacgtcagcatgattccaacagaacaatacccgtgaaacattccatgaaacacggcggatgacatcattaaaaaaaccgccggtacaaccggaaagtcgcgctggtcagtgaagctccgactccttgaagacctccacaaacggcagttcagcttcggacccatccaccggattgacgactttgatcgacgggtcggccatatcgacgccaccaatcaacgaagcgacagcaagcacttcggcgccttcgttcttcaccacggagaagtcaaggctcaactcattgccgttacgcaaggtgaccaaagaggacgtctgcacatatgacttttcagacagccaggaatccagcaacaccacacgtttaccggcaatcgaaggccccttgatggacggatacacaaaatccatcacaaaaccgttaaggttttcacctcgagaagcggccgcctggatcatagcggaaaccagcggaaccgcagccgcagtcagcgcaccaaccgcatcgaaatcatcaacggaatagccggcctcttccaacgtatccaacaaaatatgcccaacaatcgacgctccacgatggtcgaacaacactgaggaaagttccgagaacggcttatcggccatctcggcctgcagcagcgacttgagctgatcacgcggttcaagcatggcgaaatcaacggctgcgttcacagtatcgccagcggttacggcagtggattcagcaaccggcttggtcttacggaaagtcttctcttcggtcatagtcccagcctaccgtttctactcgtcaaaagagtgacagtgttggtgtcaacaagcaacgtccaatatctcccatcaacagatggtcaacagaaaatcaacatttcaaaagtcaggccggtctcaccataaaaatgaaaccggcctgaaccgaacccaagaaaccggcgagagcagcagattactcacttaagcgcgagaatccacttcagatctgtttcaaactccgcttccaggttcgcttccggactctcatttggtctcgcttccagccccgctgacgcaccggcgcaataccacacccgctcccaccagcaacaccatcacggcgattacgccactgacagccgaaccggtattggcaaccttattgccggtcttggaagcagtattgttcttaccattgccagcagaattaccggaattaccaccagaattatccgaatccccaggtttgtccgaatctccgggcttgtccgaatcgctcttcagcgaagcctgcgccgctgtcaacgcttcagacgcctcatcgacgtccgcctgcgatagcccctcatccaaagccttagacagcgccagtttcgcagcgtcacgagcctcaacgaacgcatcccacttcccactgtcatatccgttgttgaccaccgccgcagcatccgcaacagcggaagacaacgcatcggtcttcgccatcgtgatcgacacgccttcatcggtaggattgatggtttgcatcagcccgttttcgtcgaaggtgatctcgtcgatcgcggtttcgcggtgaaagccaagcccggaagtaaacacgccaagcggagtgtagtgacggtgatacgccatgaaccagcgctcttcgccattcgcgtccaccacgtgcacttcggactgatgggccgtaccctgcaaattcttcgacgcgtccttttgcaggagcacgccatggttgtcgatatcagtcacggagccatcttccttgaacagcgacggcgaagtgccgtattcgacgtggtaattcgccgatccggcatcgtcgcatgaccacgtccagtgatagacgccatcgcgcttggacaccacaacggattcccggaagttgttcagaccgttgatccgtttgaccgttcccggcaccacgctcatcatgtcatcgctcaattgggcgatggccgccgaaccgttgccgtacaggatatacgacgtgccgtcatcatcggtaaaaatcgacggatcgatggcctgccccacagtcacaccctccatcgaacgcgtaacgatggggtctttggccgccttgtatgggccggcaggcgaatccgctaccgccacgccaatcgccgattcaccgctctcaagcttggcgcagtagtagaagtaatactcgccattctttttctcgatggtcggcgcccatgcggatccgacagaccaaggcgaaattgccgtattctcgtcgccattcgtggtcggctcgtgattcttatccacgtcgaggatcactccttcgtcggtccagttgaccaggtcggtcgagctgaaagcatggaagtaattcccactccatcccgagaagccatcagtcgtcgggaaaatccagaattttccgtcgaaataatcgatatccggatcggcatattgccccggcaaaaccggattatttgactgaaccgccttttcgagcgtccatttttcgctaacgataccaccgttgccgtccgaacattcgattacaagcgtatgcttcttggacatgtcaagcttgtcaccgctggcaaacgacttgccatcgaccgtgacactcgcatcgtcgtaagtcagcgcgaacgttaccggaacggcgttgatctcggcacgattgttcactacggaggtgatggttttcgcgtcgcaatccatgctggtacgcacgttgctgtgcttatcggtgccacgcaatgcatctgcttgcgacgaggtcggcacagtgcccacagtgatggatgcgagcgcgggcgcgttgttccgttgtgcgatttcgttggcgttcagcgttcgattccagatggtcagattgtccatcagaccggaatagtattcgccggatccccagttggctttgccgatttgcaggattcctccggtttcgccaaggatttccttgacgcccagcccggaaacgtccgtgctttcgccggcaagcacgccatcgatgtagacacgtgtcgccttcgcgtttaccgtgacggtcacgttgtgccatccgtcgccgcttgtggtggccgatgcgttgcctcgaccatctcgattgccgtcggtgttgtatcgttcgacaacaacgctgccgaccttatcaagcactccgatgtagtgttcggattggttgtacgtcggggcagccgtggacggagccgcgtagaaggtccagccggtattgccgttggagtcgggcttagcatcgtaggagacggtgaactcggtggcgtccaacagcagtgcggcgccattggtttgcgtgacgctcagccaggaaccgctgcccagtcgagcggctttggtgccgttgttgccatcttcaagcttggccgttccgtggattccggcaactgccagatcgctggtgtaaccggtttcctcatcgtcaaaggtgaattgcgcgatcggattcttctgctgtgccagaggagtgttgggcgcggtatgttcgccgtaagctgcgagcacggcggtttcctcgtcgacgtttagacggacgacggtgccatggcggaatcgctgtccgaaattggctgaggcctttgagaatgtgcccgacttcttcagggacgacagttttgcgatggtccagccggcgtagcctccgttgtcgcccatcacaatccacgccccatcagtgccttggtacacggtcaaaccttcgatgcgggtgctcaatcctgattccgaggtcttgacgactttgtctccagtaattttcgacgtgccgtcggcattgacttcggagtcgcgttcaactagtcgggtccacttctgcgcttccagagaatccgcggtgtcgatcaccgtgtaccaatccgatgtggagaaacgatagtaggatccgtcatcgccttgcacgattgtggtgtcgatgatgttatgcaggtcggccgagctttgatcgatccagatttgaggattctcaaacgtggtgaagtccgaagtgtatgctttgtacactttcagcgcggtattgccagtagtgggattgtctccgcctgttgacaggtcgcggcttgaccaatacaccagatatttgcccgcttcggcgtcccagatcgcttcgggagcccaagcgttgccgactttgccttccaaaccggttgataccagttcaggatcggtccagatgacgagatccttggatttggcgaccacaagataggtgctggcgttgatctgattccaagaaccgcccgaagcgcttccttcggcgtgcagatcggtgccgagcatcacatacttgttgccgtccgcatccggctcttccaagcgaatcagatgcggatcgcggatgcctttggtgccttgcgtggaagacatgattgcctcaccatcgttcagcgcctgccatttcaggccgtttttgctgtatccgtaattgattttttcatagtcggatgcgttgaagtacagccacagatatccggctttcttggcagcatcgtcatctttgggatcatccttgccgtcatccggcttggataccgtcacggttgcctccacgggcatgcgggagtcgtcttgagcggttcccttgacggtgaaggtgccagccttggcgtactggtccgcgtcgatgtcatcccattgcacgtcagcatcctgttcggagccgtcagccattgtcagatgcacggtttccggcatcgtcggagcggtcccggcgttagtggacacgtcaaccgatgccaccgacttgaccgcgatgctcggcgcataggcttcaagcacggtctgatactgggcgcgggtgaccggaaccacggtgccgtgacggggcttgccaccatcggaattgacggggaagttttcctcgggcatcttgtcgccgattaccgtccacttcgaagcgtcggaaatgtcggtggtcgccatgggcacgtaatggttcggacctccgtgatagctgggctggtcggcgaacagatagtattggtatccgttcacatcgccttcgttggctttgaacagcgaggggccttcgcctgcggagaaggtgccaccgtatccgttggatttgtcgttgccgatcgcggtgccgacttcgctccacgagctgccggacaatgccgtgctgtagtctttgacgccggcttttccaatggaatcggtcagggtgttggacttctcctggcgcaaggtcatcgacttttcatccttgtagatgcggtagtaggtgtcgccttccttctgcaccgtcacatcaatggaacccgctccagcttggcctctccgatccacgtcaatccacgtcttcggtttggagaacgtgatgaaatcaggcgtcgtcacatacatcatgcggttgtaacttggcgaggtacgagtgctcgaatcgtcattgtcgtacagattcgaggcccagtagaccacatattcgcccaactcatcatcccagtaggcttccggagcccacgtgttgcccgcgctgtcgtcgctgaccttgatatgacgctggttcgtccagttcaccagatcattggattcccaaacctcgatatacagcgaaccgttgtactgtgccgccgagaagctgcccttcctgccggagatcttcagatcggtggcaagcatgtagaaggtgtcgccgtcatgcgagcgcatgatgaatggatcgcgcaatccctgttcgccttcggtggaagtgaacagcggagtgccttcattgagcgtattccagtcgagcgcgttgttgcccttggaagcggcgaggcttatcttctcgcctcccacgccttcgccggtgaagaacgcccaaatgtatgcctcatctttgctttggtcggaaggcatcggcgaaacggtgatcgggaattcccggtttgcggtggcaccgttgttcgtcgccgtcgcttccaatgtcacgttgacggaatctttgccggcagccggccgattcaccgatactttggcattgttctcgttatatccttcggcgatagaagcgttcgcaccgccatcgttcttgacggaccatgtaatggcggagccattgtcaccgaccgtcggcaccacgaaattgctacgaatatcgtcggcgtccaagatattcacggcatcaagatcgctttggatcttctcatcgtccgatatgatgtgcggaaccgtaaccttaaacgtccgcaactgatcgtccgagccgttgagcttggcagtcaaagttgccacagcatcggcttcaccgactgcggggcgagtaacttgcgcggttccatcttccgtgaaccggatcgcgttgttatcgctcgaccaaacgatcggcacaccgttgctttccgtaatgacggagaagttttcggttgcctcttgcgcaacgctgatggcgttgaacgcatcggtcgccgcagctagggaactgtcgtaaatcttgaaattgtcgatcagaccggtaaagtattccgcgccccaattcgctttgccgagttgcagaataccaccgtctttgccgaggatttctgtcagatcatggctttctttggcctccacgctgttcacaagtgtgccgttgacgtacattgtggtggattcgtcggatacgactacatccacgtgcttccagccgacactggaagcaccgctgacattggctcccgtgcgaccgcccgtggtgttgttgtagcgttcgaatgtgatcttgtcggttttgtcaagaaagccgatgtaatgctcataaccataggttggtttcgccgcatcgcgggccgcgtacagcgtccagccgctgttgccgcttgatgcgggcttcgaatcgtagctgatggtaatggcatgcttgccttgaagcaccgcactaccatccgcggatgtcaggctcatccagaatccgctggacaggttggctgcagtagtgccgtcttcgccggttcccgtggccgtctggccattaatcgaagcgacgatatttcccgattggtaggttccggtttgtcctgccgtaagatcgttgaaattcagatctacaagcaggctgctttcgttcttgtatttgtcaagcgccgatggctccgatgccatcgtacttggcgcaacgagcagaacggcagtcatggttgcggcggcgacgatagcgccggtcaaccgtttgacggtgagatgttttctcgtattcataaatattccttgaagaattcagcattagtgcatgcgattcatgcataacaaggaggatgagaaaccgtccgggaaggaggtaaatagaaccggacggtttctcttacggggcttcgtcttgttttcacgcgggatggatggaatacgtggaaacggaataggcgaagcgttcatgtgaagtcagcgagctgccttccagcgacgcagaacagccaacgcaccaccgatggccaggattgcggcgaccagcgctatgcccttgacattggcaccggtattcaccacaaccgcagccttcttcgcagtcttcttggtggtggtagtaccgggcttagtggtcggagccggagtcggatcaggatcaggagtcgggtccggagtcggatcaggatccggagtctgctcgattgcatcgtcagacacgttgaccaagttatcggtgtacccaccgtaggccgccgtgatcttggaaactttgcccagcgcgccttctggagcggtgactgtggcgacgccatcagcattgagcttgacggtttcggtccagtcgccagcggtgaagacaaccgatccggccacattgccgccgtccttggcggtgacagtggcagtcagcgtgtctctaccgcgctccagcttggtcgtggagtcagtcgcatccggagtggtggggttggcggtcgtccaacgatgcatgttctcggcgatggcagcaggcacattgacgaacgcaccgtggcgggtcggggtcggcatgccattggcatacacgtagccgctcacacccgcgttctgatccttctgagtatgccatccatcggtctgcgacagtcggttgttccaatcgcagctcagcagagcggattcgctggtcatgtacggctggtatccaccggaatcagccatgatgaccatggcatcccctgcttcattctgatacttgtctccggcgttgagcttgatagcctccggaccttcgaacggcaagatgcgctggtcaagcagctgccagccggtttccggatcggtatcgggagatgcctcctcggtggtggccgtcagcaccttcgaacgctcaaggaacgtggacttgccgttggtgatgtagcttccggcagcgccgctttcctcgttcttggtgaagcggtagtagtagtcgccaaccttgatgaccgtggagtcgatacgggaatagttggtatcctgccacatcaccggttcggtgaaggtcttgaagtcgcgggtaatgcagtacagcagcacgttgtacgcgtagccggtattggtgctggtcaccgcggtggaacgggtgtcgtcggtgtacatacgtgacgagaagaacaccacgtaagcgccgagcgaatcatcccagtaggcttccggagcccacgtcatgcccgcattgtcgacattgattttaatgccggtatcgccgtcggccgcgttggtgcgagtccagttgaccatgtccttggactcccacacttcaaccttgagcgaaccatactgctggttctggccccatccttgtgcggaaaccttcagatcggtggcgatcatgtagtacttgtccccgtcatgcgacttgagcacgtaaggatcgcgcaggcccttggtatcggcgttagattcgatgaccggattggaattgttgatttccttgaaggagaagaagttgttgccttccgtggcagacatgtacagcgcttcgcccgtcttaccattcgtcttgtcggaatccgacaggaaggtgactgcggcataggcttcgtcaggcacttcgcgagtcttttccttgactatcaccgacactttggcggttttggtgacactgccgtcagcgttggccgcggtggcggtcagctctaccggcgcggcatcgccgtcaccgtatgcagggcgggtcacaacgcctgcacccttatacgggtcagcggatccgaccgacggcgcctggtaatttgtatcggttccggtgatcacattttcattggaagacgtccaagtgatggtggatccgtacttcgagccggtggaaatcagcggcagattctcggtggttgcctcgttgacggcagaaatcgcggaatccagatcgaattggaccacggtcgccggatccaacggcttgacggtgacgtcaacgcttgcggaaacgccgccggccttcgtagtcgccgtgattgtggtggttccttctccgacagccgtaacggtgccgtcgctgtcgacggtggcgacggaagtcttcgacgactcccatgtcacatcggtgctgatggcgttttcaggagaaaccgtggccgttagcttcgtagcgctgttttcaaccatggtcagtgcaccgtcaagcacgccatcgccaacgatcgtcacgctgcttggcaacgtgacgtccgcaccttgatagatcttgatgtcatcgatcgcgccactccaataagcgtcgccgctatacagggatttgccgatggttgcggcggtgctgcccagatcggccatggtgatgccggtgtttgccttgtatccgacaagttcgccgtcacgaagcatggtgagggtttcgccgtcgacgatcagcttgtagttgtgccagatattgtcattgttagacagcgaagtcttaaatccttgctcattgttccacttgttatcggaaatgacgaacttcgtggacttggtgctcaggtaccagaacaggtatttctgctggcttccacccacagagaagctgaaatagttgccgtcatcagcatgacgtgatttggcagcgaattccatggtgaacgagttgcccgccttggcgaacagctcatccgggaacgaagcatactggccattgcctcgcagagacaacgcctggttattgttcctgtcgccgaacgcttcgaccttcgcaccgccgttcatggtcaggttgtacccgttgccggatgtgtcagtcgcagttccgtcggaaaaatcatagctggcaagcaggttcagaccgcttgaagcagagggggttgccgaaccgttaccggttccggcgccgtcttcagcgaatgcgaccggcgcgaacgaaaccatcatcggtaccgtgaccgcgatggcaagcccacgtctgagaatatcgcgtaatcgttggctatgtcgtttcatgcactctccttgatttaccaccgccgcacacggttacgacatagagtgatagctagcgctctgcttatgcttcattactgcatcaccgttgttcgttctgagtcggcggcgctggtccgtatttattgtttttcttttgcttgtggccgcatggccggaccgtccatgtccaaccacgaaccgcgacgcaccctacaactctgtgaacgttaacggtctatgttctattcaaaactatggtgactttcaccacaatcccagccagtaacaattcaataacaattccagccagcagccctctttgcaacaaagacggcggaagccggacaatccccttaaaagagcctcatcaaggatttatagacccccatacaaagccaaatagcattacaacacctgctgcagcactcgccccaaagcacccataatacacccttttcacagcacctactgctcgttggtttcaggagcggtgagttcgcggatgtcggctttttcgggcgcgatcatgtttacgggttcgatgattctgctctggtcgacgcgctgcagctttcgcgcggttaccagcacgcgcgactccagcgacgatgcgaacgcattgtaggctcccacagttttggtgatggcggaccccagcttggtggcgcgatcgcccaacaccgcgaaccgttcatacaattcgcgggacaggtcgaacagcattttcgcgtcatcggtcaggctttgctgctgccacgcgtatgccacggatttcagcaccgcccatagggtgatcggcgaggtcaaagccaccttgcgtgcaaacgcgtcatccatcagcgtcgggtcagtttccaaagccgcctgcagcagggattcgttggggatgaaggcgatcacaaaatcgggggcatcggcgaacgcgttccaataggccttgtcgcccaaggtcttcacatgttcacgcactgccttggcatgcgcatgcagcagctccgactttcgcgtcagctcctcgggcgtggcggtatcgggaatctcgcacgccttctggtagtcggcatacggagccttggcatcgattggaatggttttgccgcccggcatatggatgaccatatccggacgctgcgtatgcccatccacgtcggtgacgaccacctgggtgtcaaaatccacatgttccagcagtcccgcggattccacgatgttcctcagctgcgcctcaccccacgcgccacgcaccttgttgttgcgcaacgccgacgacaaagcgttggtttcgcggtcaagacgggcctgctgctcgccaagccccttgagctgctcgccaagcgcacccatctcccgtttgcgcccttcttcgatttgcgagaccttctgctgcaaggcgtcaagattcttctgcacgggcgcgagcgcggacaataccttgctttgttcctgcagtttccgctcgttttcggcctgcttgcgttccgcttcggccgcggcccgctcacgctctcgctccactcgttcctgttcggcccgttgggcttgcgcgagctgcgatttgagataggtcaactgctgggccaacccttccgcctgcgtgcggtattgggtcatcgccgtggacaattcgctgatttcctgccgatcagcttcgatctgcgctttcgcctcgttaagatcagcggttttcgcatcacgggccatttcctgccctttggaacggcccgcaaaaaagccggccgcggctccaagcgcagccacaaccaccagaagaatcaccacaaacacaggattgtcgaacatatgttctatataacagcatgaccaagacatcttggaagatcaaagttcgcaagacatccatgcccagctgcattatgcttggagccgaaagcatgctcacgaacatgcggcaacgcgagcacgctgaatattcgagaggcattcaagaggcaatccgggggttcggaaacacatgggattcgatttgtttatgacggtggcggcgattgttgcggcggccgtggccacttgggccatcctcaggctattcctaagcgaaaacgatgacatagccccctcccaccaacgcatcaccgatgacaagcccgccaagaatcacaccgaaaatcacaccgaaaatccagacgaggcagccggcgcaacacaccgaagcgacatcgccaagagtctcgccatcgcaaccatactgaccgctcccacattcaccgtaaccatgctgacattcggcggcatcacacttccccactggctgaccaatccatggctgcacgccatcatcgccacgccggtcatgttctactgcgccgcgccgatgcacaatcgcggtatcgccgccctgaaaagccacacgcccaacgcggattcgctgctgtcgctcgccatgaccattgtgtacgtctacagtctgctggcgtgcgtggtgtcgtggattttccccgcggggtcacgcaatcagtatttcgctttcgcaagcatggtcgccgtgctatcgcttgcgatttcgctgatcgcgcaacgccccatggcaaagaaagcatcggaaggcgatattccgaccgcacaatcgcaagaaaagcaagaaatacaatctcaagaaacgcaagaaacacagcaaagcatggatacgcttatccaggccagcatcacatatgagattcgcacgcgggtaacgcagattaccgcgaccgtgacgatggtcatcgcggtgtggacgttcgctttgtggctgattttcgggcttcagccgaagcttgcgatcgccgtgttgatcggtgcgacggttttgacggtcgcaggcttggttttgcaggcatatgaccgccaaccgtcacggtaaaacggttttcgcaaaagaaaatcgcgcaatcgcacgaaaaatgggcggacccgcatgtgcgcagtccgcccaccgtcaacggttagaccgttttgtgactcggccaatcaacagtcagtcaggccaaaccgatcagccgaatgactccgaccgtcacttagcctctgccgaaaaatcgtcgtcaatctgccccggcgcccacgaggagagctccaaatggtcgccgccggtctgatccacaagcacggtgtcgccgtcgtgcacttcgccggccagcagcatgcgcgccaactggtcgccgacttcggtttgtaccaaacgacgcagcgggcgagcgccatacgccgggtcgtaaccggtgttggcgagccaatcgcgcgccgaatcggtaacatccagcttgatgcggcgatccgccaagcgggccgaaacctgcgccacctgaatgtccacgatgccgccgagctcttcgcgcgtaagcgggtggaacataaccagttcatccaagcggttgatgaattccggcttgaactgcatatgcacggcgtccatcacggccttcttcttggcttcgtcatccagttcggtgttcaccaggaactgcgagccaaggttggaggtcatgatcagaatcgtgttcttgaagtccacggtcctgccctgcccgtcggtcaaacggccgtcgtcgagcacctgcaacagcacgtcgaatacttcaggattggccttttcaacctcatcgaacagcaccaccgaatatgggcggcgacgcacggcctcagtcagctgaccaccctcctcatagccgatgtagcctggcgcagcaccgatcagacgagacacagaggccttctccatgtactcgctcatgtcaatgcgcaccatggccttttcatcgtcgaacaggaagtcggcgagcgccttggcgagctcggtcttgcccacgccggtcgggccgaggaacaggaacgagccggttgggcggttcgggtcggaaatgcccgcacgcgaacgacgtaccgcatcggaaaccgcttgaatggcttccttctggccgatcacacgtttgccgagatagtcttccatggtcagcagcttctcgttttcgccttgcatgaggcgtccgacgggaatgcccgtccagtcggacacgatttcggccacggagtcggcgtcaacgcggtccggcaccatcggaatatcgccacccaagccaccgtcagcaccgcctgccgcactgttcttggccgccgcctcgttttgttcggcttgcgcgatctccttctggatggccggaatttcgccatagttgatggcggaggatttcgccagatcgccttcgcgttcataccgttcggcttgggtgcgtagttcgtcgagcttcttgcgcaggtcgccgatgcggttgtgcccgttcttttcggcgtcccagcgtgctttcagaccgttgagtttctcgcttttgtcggcgatttccttgttgaggtcgtcgagacgttccttggcgctttcatcaagctcgttttccgctttctgcgcggcggcatcgtctttcggattgccaagcaggtacgatttttccatcttgagacggtcgacctgacgctgcagttcatcgatttcctcaggcgaggagtcgagttccatgcgcaggtgcgatgcggcctcgtcaaccagatcgatggctttgtccggcagctgacggccggaaatataccggttcgacagcgtcgccgcggccacgagcgcatcgtctccgatggtcaccttgtggtgggcttcgtatttcggtgcgatgccacgcaggatggcgatggtgtcttccacgctcggctctcctacgaacacctgctggaaacggcgttccaatgccggatccttttcgatgttctcacggtattcgtcgagtgtggtggcaccgatcaggcgcagttcgcctcgcgcgagcatgggtttgagcatgttgcctgcgtccatggatccttcggccgcgcccgcgccgacgatggtatggatctcatcgatgaacgtgatgatctgcccgtctgcgttcttgatttcctgcagcacgctcttcaggcgttcctcgaactcgccacggtatttcgaacctgccaccatggagcccagatcaagcgagatgagcttcttgttttgcagggtggtcggcacatcgccggcgacgatacgctgcgcgaggccttccaccacggcggttttgcccacgccaggctcgccgatcagcaccggattgttcttggtgcggcggctcaggatctggatgactcggcggatttcctgatcgcggccgatcacggggtcgagcttgccttctttcgcggctgccgtcaggtcggtcgaatacttttcgagggctttgtaggagccttcggcgtcgggactggtcactttcgcgcctcctcggatcgttggcacggctttgcgtagcgcgtcggcggtcacgccgtattgttccatgatttgcgcgctctgattcggctttgccgccgcgatggcgatgagcagatgttcggtggatacgtattcgtcgcccatctgctgcatttccttgccggcttgcgcaagtactgcggatagttgcctgctgacttgcggttgcgcggtggtcgatccgctggcgcttggcagcgcgtcctgcgcttggtgcacggcggcgctgatgttttgcgcgttgccgcccgcggcttcgatcagaccgcggatcacgccgttttcctggcgcagcagcgcatcaagcaggtgcagggtttcgacttgcgcgttgcctgctgccgacgcgttctgtacggcgtcggaaatggcttcctgcgccattgtggtgaacttctgttccatatcatcctccatggttcgcgccgatcgtccgtttttcgcacggtcgcgtcgacgcatatgtcgttgtctgatatgctcaaccgacttcaccaccattctattcccaaaagttgagcctgcaacactcaacttttgttcactaaacgggaaatcgcgaacaacgcagcacaaaggccgtcacccacgaaaggtgacggccttcatatcttcaatatgtcaatcagcaatcggcaatcagccgcgcaccaccacgttgcgcaggctgccgatgccttcgacgtgcacgatcgcctcgtcgcccggatcaagatggccggaagcgttcggcgtgcccgtcagaatcacgtcgcccggcagcagcgtcgtgaagctggaaatcgccgcgatctgctccggaatgccgtgaatcagattcgccgtggtgccggaagccagctcgacatcctcaccgttcagcgtgaaggagatcttcgcgtccttccaatccaaatcgtcgcgggtcacgatccacgggccgagcgggcaggaggtgtcgaagcctttcgcacgcgtccacatcgggtcaagtccctgcaggtcacgcaatgtcacatcgttcacgcaagtgaagccgagcacgtaatccatggcctgttcgaccgtcacgttcttggcgatgcgccccatcaccacggccacttccggctcgaaattcatatcgttcgagtacgacgggatcacgatcggatcgtccgggccgatcaccgacgtgctcggcttggagaagatcaccatgtcttccggagcgtgcttgatgtcggaatggcctgcttcatgcatgaactgcgcgtgcgcctcgtaattcttggccagcccgtataccttcgacgggatcaccggagagagcagacgaacgccatcgccatccaccggaaaacgctcgccggtcggcttcacaccggcaccggccagaggatgcccctcaagcgccacgagatagtccttgccgtcgctttcgtcggtctgcacgaaagcgtattgcggtacatcattatgcgaaaaacgtgcgattctcatgtctgccagtctacccgcaacaatcgtcgaatcgtccatatcatcgacatgcaacgcccgacaatcaaaaacatcgaaaaaaaaaaaacgggccatcacatcatgcgaaggcccgtcacaggaagaaaacgtcagataaaagcacgctcgccgaaaatcgcggtgccgacgcgcacgatggtggatccttccgcaaccgcaagttccatgtcgccggtcatgcccatcgacagttcgcggcaggattgcgtgcccggctcgccggattcgagaatatggtcgcgggttttgcgcaggtgctcgaatcccttgcggatggcggtttcgtcgtcgacatgcgcgccgatggtcatcagcccctgcaattcaagtccgtccaatgtaccgattttttgcgcgatgcggatggcatgcgagggatcgcagccggatttcgacgcctcacccgattcgttgacttccagcagcacgcccacggtgatgccgcgcgccacggccctgcgcgagattttctccgccaagtcaagggaatcaaccgattcgatggtgttgacgaccggcagcactttgccgatcttattgctttgcagctggccgatcagatggaacggaatatgctcacccgcaatagtggaagcgccggcatcgtcggcaacgcccaacgcgaatccgcgctccccgcaacgtgccatcaacccttcggccttcgccatcacttcctgcggacgattctcgccgatcatacgcacgccagcgtcgatcgcagccatgatctcacccacgtcgcgcgttttcgtggcggcaagcaggcgtacggaacctgcgtcacgcccggcatgctgctccgccgatgcgatgcggtccagcacacggtgcacgccatcggcgatctgcacggcacgcacaccgtcgatcgcctcattggcaagattcttatggtccatatatgcagtcatgttcagcctcttgcgttcaatcccaactacctctaccagagtaagaagaagcccgtacgacggtctgaagtgaagcgataaagcgaccgatatccgtacgggctaataaaacagacggcagtagaagggggaacttcaaagactccgtccgacagcaactatatgcaagatttactaaacacgcgccgaaaaaaacttttttcttcaaaaaaaaaatttctcagcgaactcaaattcagccttgcgattcgtctaatttgcgttccaaagcatcaacgcgttccttcaacgcaagcacctgacacgtcagcgatcgaatctgccccaactgcacagtcaccaatcgttccctggtgtcggaagacaaggcgcccgtcgtggaattgcttcttgcggccgccataatatccagatccactttccaacgtgcgatattacgttccacacgcttgcgcccgataatcgcagggctcaacccagccgacgtgaaaatcgtgctcggccgctcgccatccaaatatcggcgcatgcaactgatctgaaaatcacgcgaatacgtgatccgattttccgtaaccgactcaaccgccggcaacgcacgaagatactcgacctccgtgttactaaactgccttttcgtcatatcgaccccattcatccgacaaaacggaataccattctcgtgctcgtagattaccatcacaaacgaacgcacccgaacggcatatactaccactttaacgtaaggctatgggggctcacgccacctgaatcgccctacgctaaacctagctaaaccccaacgggtacagttgcgtactgccacagtcaacccaccaaaggagcagccatgaccggccgattcgcaccaaccccatcaggacgcatgcacatcggcaacgtttacgccatgctcggagcatggctttccgcccgcaaatcgggtgattccatacggctgcgcatcgaagacatcgacgagccacgagtggttcccggcgccgccgaaaccatgatgcgcgatctcgaatggcttggtctcggttgggatgacgaaccggtattccagtcgtcgcgacacgccctataccaggaagcgcttgagcttctcagcaagctgagctttgacgaaatcagcgatattatcagtactggttccaacgattccaagccctgcagcactacagcaggcaacgaagcagccacctctgaggcaacaccgctcatctacccctgcttctgctcgcgcgccgacatccgcgccgcctctgcgccacaggaaggcgatcgtttcaccgtgtacccaggaacatgccgacgcctcatcgccagcgaaccgcagcgtgcgaaacaacgcctcgccaacaacgaccgccactcgatgcgcatcgccaccgccgacaccaccatcaccttccacgacgaagtattcggcacccagcaatacaacctcgcccacgacatcggcgacatcatcgtgcgccgctcggacggcatctactcctaccagctggccgtcaccgtggacgacctcgacatgggcatcaccgacattgtgcgcggccgtgatctgcttcgctccaacgctttgcaaatctacattcgcaaagcccttatcaacgcgggattcaagccttccgaaccgacacagcccttccatcctgccgacggttccaataaacctgacgatgtgaccatctcatacgcgcatctgcccctcatcgacaacgcagccggccaacgccttgccaaacgcgagcgctcgctcgatctcggcatactcacggcacacggcgccaccgcgcaacagatcatcggctattgcgcatggctgctcggattgcagggagacctgaaacacaccaaaccgcagcctatgagcgccgacgaagcgcttggcgtattcagttgggatgccgttcgcaccaacacgtcagaccgcacgctcgatcaaggcgagttcaacgcatatttcggactgtaggccctattctgcagttttattctgcagctctattccgcaatcgcgttcagccaatccataattccgaatcaagcggatattcgttgatcgcacagccatccaaaaatatggactgctcctgcataagcggtgccgcttggccagccccgcgcacgtcatctcattgtcgatatgccccaaccggtgcccgacctcatgattgatcaccatcgtgcgatatcgcgccaagtcgccgcctcccgacatccacacgtccgtgccggaattccaacgatcatcgttgataatcacattgttgcccacacggcagctgtattgctccgaacataccgacgagaacgtcggcaaggtcgacgcttgggcgagcacgatattgaaatcgcaattgccgtccgtagaaggttcgaaaatcgcgcctgcgcgcccatccatgttcgctgttcagaatacgaaacacggcattcgaaaaatcttcgactgatccgacttcaccattggtgaccacacagtaatgatattgcaccatgccatatccgctgttttgcgccgtttgctgcgctttcgcaagtatttcgcttttctgatcgtccatcagcgcggccgactgctcgcgaagcgctttggtgacggcgtcttcctgcggttccgccgtttcctccgctgaggcctttgcgtctttcgttttcgacgattcctaggttttcttctctgattgttgcgatttcttttcggatttcgcggattgatccgttttttctgaatgtgttccggaattgccgatctgcgccgttttcgcatgtccgttcagtaccgcgttgaccagcacggcatgcacgctgcacgacgtacatgacacgatgacgcataatgcaagaatccaagccacgacgcttctgcggatgcggaacgcttccgtccgttcccggcggctcatggtggcggccgctttcggatcgagcgcacgcagaatggtacgaattcgcttcaatccggcctccttataaccctgccgtcacgcaggtggcagcatatctcttccgcggcaacactaccagccaacagtaggcatgcaaaaagcccgcttcccccgtaccggaaattttccgaggaaaacaggctttatgcaacagttctcatatatcaaacgcaacttatgcgacggtcaggcaaacaagtcacgaatgattgaatgcgatcaggcgaacaacttgaacacgaacgcacccacgatagcgcccagaatcggggcgacaaccggaatccaagcctcgccccagcgggaggagcccttggacgggatcggcaggatggcgtgcagcagtcgcggcatgagatcacgggccgggttcaggccaggaccggtcgggccgcccatggaagtcacgagaccccacacaatgaagccgaccacgatggaagcggcagcgtggtccgcttcgccccacggcatggacaggcagcacagggcgccgaacacgagcacgagggtgccgaagaactcgttgacgaagtagttgatgcggtcgttgtgggcgtcggtggtgcagaaggtgccgaggatggcgttggcgttttcggtgtccttatagtgcgggtagtaggtgatgtacaccacgagctgacctgcggcggcaccaagcagctgggcgatgatgtacggcagcacgaggctccagtcgaacaggccgttcacagcctgggcgatggtcatggccgggttgatgtgcgcgccggagacggcaccgaacatgagcaccgggatcatcacgccgaagccgtagcccatggcgatgttcagccagcccgcatggtggcccttggtgttcttcagttcaacgttcgcgacagcgccgttgccgaagatcatcagaatggcggtaccgaagaattcggccgcaagtttgacaaaagtcgagtattccactgctgtttcctctattgcttcttctcaataagaatcagattgatgtcgattccgctctcggcggacaacagcgtccaacactactccccgcactggaagtcagtatgccactaggtatgacgtcatagcgctggtttcatatgttggatattgcactcgtagtttgattcggcaaaccgcggtttcgccagttccaccattatcgtcagacctgccgccttggcagagaatccccatgtgccaatgagattgcctttcgcagccttcttcggtgtggtcagcgtggccacaaccatggtgctggctttatctatagatgatgaatccactccgaagaactctgcaataccgatgtcttcgccatccctgtagaaatgaagattagagatgtcgtactgcgcgttggagcctgtcgacctgcccttgccaagagtgcccacgatcttgtcttctgcaatcagagtaatacgtcattattctcagacaaagaagcaaatcgatgatcggaccgcacgtgggcctttgagcatatcggaaccaaagttattgtctataccctcggaagttattaccagggtggacgcgccgggggattgaacctggaacgcgtgtcttcatggagtgatgaggcgtcggccggcatgcgggagccatagtgagtccgtcgcgggaagccagtagggccggtgcgtaagtccatccacgggaattcatcgcaaagccatttccttagcatcccatttcctccacccgctggacgttttgcccgctggaaggcttgctttccgggtaaattcccccagtcactggaggaatcaggactccgaagcgtgcgccagcgggtagatttccccaccggctggaagaatcaggacgctgagacgccagtcgatgggtggattcctccaccgactggacgttttgcccgctggaaggcttgctttccgggtagattcccccagtcactggaggaatcaagatgctgaagcgtgcgccagcgggaagcttcccccaccgactggatgtttcgcccgctgaaaggcccacttccgggaagatccctccaccgattggatgttttcggactctgggatgcttacaaacgggaagattcctccactgactggaggaatcaggacgctggagaaccttgccgatagtacggatgcggagtacgaggaggataggcccgagaaacagtttctacgcaaactgcagtggatgtgggagtagacatgcgagcatcagaaaacaaaaaaaccttggaaccggagttccaaggttttgtctgtgccccctcagggattcgaaccctggacacgctgattaagagtcagctgctctaaccaactgagctaaaggggcgttggtcttgcgaggttttgttctcgctgagcacgagaagtaaatatactcagaatcaagaagaacgcaactctcggcgtgtcgcgattgtagaaccgctatttttcaacgatttcagcatattgcataaattacagaaaaatgcgatccagccatcatgttccctatctaaacagcacagccaaggcaggaaatcacaatttcttcacaactgtcgttccgcgtaatccaatcgccccaaacacttccgccaattcatttcgctaatttatttgcacggccatgcaatcattctccccgaatccattgtccgaacaccatgcacgcgcatcagccaccgaaccgaactcctccccggaaagaagcacgtaataatcggcctcatgcccataccgcgtgtagtagctgtagtccgcggcccacgccaacaccgccttcggccatgaagcgcgcaatgtaagatactgcgcgtaaatatcgcggtattgctgggttttgccgtcgacttccataccgtatttacgactgaacagctgcgttgtcggaatgtcgtacagtccggaaaccgccgaccggtcatgagacagctgccagctcaacgccagctgcgcatagcgttccgcatcggagtcggcaatgttcgcaccaccccttgcgtctcccacactcgcaaccgcattaccgttcggcgtcgcacccttctgcaccaccatgctggtcgacttggtttcgatctggtcggacgcacgccagtactgccctatcgcgtacgccagctcgagcgtcgctgtgccgcttgtgaactgcatcggatcggatgcgaagtcgtacaccgcgggcgcgatcacctcattgctggaatccttgatggagattgtgacgtcctcgcctttccacgcggtgtcaccgcaggcgtgtgcagagaacgcgacggtcgcaatcatcgtggttccatttttctcgacactctccaagcccgcgtcgggcgttgtcgcgcaatccttggtttgcttggccgcatcgttctgcttggttttgttggattgctcatccgcgttttgcgccgtcgaagaaccgttttgcgccgaatcgtcaccgctattacgattggttgatttccatacaacaaatcccgcgattaacgctatcaccgcaataattacaataattgcgatgatgattggcttcttgcggttcttgcaatcattggcttgcggatcagattgcgttccggactgcatgtctagctgcaggcttgatggcgcgggcatgggaaccggaggatatgcggccgttgccggcggaacatcgatttgagtggtctcagccggctgagcaccttgtgtccccaacggaaaaccgcaggaaccacagaatcgcatatctgcggtgacggcgacgccgcactgcggacacacggaaggaattcccgcagccgcatggccatcctgcaattgcgcggcgccgcgtttggcgcttatatgctggcgcgtaagtccgcactgcgtttcaagtggaccggtgcgatcagttccgctatcgtcggtgtgctttccggtttggtggttgttattctcgccgccattttccctgcgaaaatcggaggatcgtacgcatattactccgcgtccgcatcgctttccggagcatcgttccgcacgttcttcatggcgttcctgctggctggactcggcgcattggccggctacgctctggcgcaatttgctcccgattccaataacatgttctccgccacttggcgttgggctcatcgcacgcgcggtttcgtacgcacgcttgttgaatctgctgcgatttacggcgtattgttcctggcgctcggtctcgttgcactgattgtggcgacggccgcttccggaagcgcactggccggcatactgctgattccgctgctattgcctgccgtaccgttcgtactgttttccgtatcttcgttcggtggtgtcacggcttcggtttccggtcaatcctcctacacgctttccctgttcaatgtcgccagcgtcacccaatacgcttgggcactgtggatttgctttgtgcttttcatcattgcaacgatttacattgcgcttcgtgagacggcccgcaacatgtatgacccgtattatgcgaagtgggagaacacatggaaggctcctgtcgccgtgatggtgttctggcttgtcgcggaattcctgtgcacgaatttccttgccggatacagctcgaatacggtttcgacgatggtgccaatgtggtatttcatcgtcgccggcgtctgggctttcctcgttgaagtgattgcgatgacgtttggtccgacgttggttgcgtcgacgccgggattgtggaagattcttgttggcggtaccgtacagcagactccgcagaacgtcgtcgattacgtcaaggcttgcgatccgcatttcggccaaccgaaggcagccaggaccgcagcttccgcgcagaccacgcagaccgcgcaatacaacgcgcaatacaacgcgcagtacgccaatccgtccgcgccagcaacgtcaccagccgcgcagaccgctcctacgcaagcgatgcccgctgttccaatgccaaccacgccaatcccagcgccagccgcttcggttccaccagtaccgcagtcaacggcttcggttcctcccatgccacaatctccggccgacattccgatgccggccgttccacagggtgaaggaaagccactcgacccaaaaactaagaagacgatcctgatcggctgcatcgtcgccggtgcactgatcgtattgggcattgtctatggtgtgctcaattcgaccgtcttcagcgcgaaatccatggcggaaagctatgtgtcggcaatcgccagcggcgattacgacaaggctaacgacattgccgatcctcaagtgggtaaaaaccaacgcaagctgctttccaacagcgtcgccaagaccgataacgcgaccatttcgaatgcgcatgtcaatggcgtgaaatccggcaatggcacaaccaccgcatcaatcagctactcgttgaacggcgaaaccgtcgatgaggaactcacgatgcgcaaatccggcaacaaattcctgattttcccgaactggcaaatcaccacgccactgatcaagtccatcaatgtttccgtgccaagcagtgtggaatcgttgacggtcaacaaggttgcggtcacagccaaaaacgcggagaagacggattccggcgaatggcagttgcgcgtatacccaggcacgtacaacatttccgttacgagcacggattatatcgtcagcgaaacggtggtattccgcacgaacgaagacagtgattcgccgaccacgctgaaggtgacgaccaccagcaagttcaaggatgcattaagcaccgccgtgaacaacgcgctcgacaagtgcgcggaatccaccgactatgcgccggaaaactgcccgttcggcttccgcgtatgggatgaggataattaccgtaatttcgcgtggtcgatcagcatctatccgaaaatcgacgaagtcgaccttgattatggcgcttttgatactaaaaccggtaaggcaaagtgcacatacgaggtgaaagacggcgattcttgggattcggatgatgatagtacgacgttcaatgcgagcggatcgttcgctatcaaggatggtaaggtcacggtcacgcttgatgacggtggctacagctattaaatgaagtatgaaaatccccctgcatagctgttttcagctggtgcagggggattttccatgcttaagctcagacgtatctcagtctgaagtcattcgccgtaaccgcaatgaatgcagccatagcgaatggggccgaatcactcagcgacaaccttcacggtgaaggaagcggagatttccgggtgcagagcgacggttgcagcgaactcgccggtggtcttgatcggatccacggtgatgttcttcgggttgacggcagccttggaagacagcgcgatggcgatcttgtcggcggagatgccaccgaacagcttgccggactcggagaccttggcggcgatttcgacgacggaaccctcgatgagttccttggcggcaacagcctcttcgcgggtggcaacggccttggccagacgagcgcgcttcatggcctcgatctgggcggcagcgttcttggaccatgcgaagcccagaccctgcggaatcaggtagttgcgagcgtagccggccttgacggacacgacgtcgcccgggtgacccaggtgattgacggacttggtgagaataaccttagtttcagccatttttcaaacctctctaagatcagcgaccggaagtggcgtacggcagcagagccatctcgcgggcgttcttgatagccttggcgagctcgcgctgttcctgcacggaaacaccggtgatacgacgggaacgaatcttgccgcgatcggagatgaacttgcgcagcagggcaacgtccttgtaatcgatctcggtgaccttagcggccttcagtggattcggcttcttcttaaacggcttgaccggcggctgcggcctcttgcgtgacatcttgatgttctccttacaatctggaaattgcttttcttttaagctgcgatccgggtcggatcagaattccggttcgtcgctgcttccaccaaattcggaggagccaaaggaaccgaacgatgaggaaccggaattatccgaattgccccacggatccgatgccggagcaggctgcacggcgggcgcggcattggctggagcggtagccccaccctgatagccagcgccaccggaatacccggcaccgccctgatatccaccggcattgccggcgaagccaccgttgttgaacccgccgttgccgccagcgaaagcattgccgccacgattgccggcaaaattaccaccgttggcactggaggttcgggtgacctgggcggtcgcatagcgcagggacggaccgatctcatcgacctgaagctcaataaccgtgcgctgggaaccatcgttcgcctgataggaacgctgctgcaaacgaccctgcgcgatcacacgcatgcccttgctcaggctctgcgcgcaatgctcggccatgtcgcgccacgcggagcagcgcatgaacaaagcctgaccatcttcaaactggcccgtattacggttccaggtgcgcggagtggaggcaatggtgaagctggccacggacgagccgttgccaaccgtacggatttcgggatcagccgtgaggttacccaccacagtgataatcgtttcgcctgccatcgttacctacttactttgcagcttattgttttgcagcttgaaaagcttggaattacttacttgcgaagaatcttcgtacggatgacggattcgttcaggttcagcagacgatcgagttcgtcgctggtggccggctcagcggagtagttgaccacaacgtaattgccttcggtcttgccagcgatctcgtaggcaagcttgcgacggccccagatgtcgatgttctcgacagcaccgccttccttggtgacagtttccagatactgctcggtcagcttcttcagaccgcgctcatccagctcaggatcggcaatgaacatcagttcgtacttatgcgcagacatcacccacctccttcggactatcggccatggaccttccatggcaggagtgtgtatgcgtactgccttcacgcatctatatatgaaaggtataaagatacagttcagacaacctgttcagcatagcccttctgctggacgagcggcaattgcgcacgttctgtggtgcaggcgcgtcatgggcacccgcattgttatattgaatacggctatttttgtacggttggtaccgtatttacgcgactctagatttgtggaaggcgaagcatgtcggcgattctcgaaggcaccccggataagaaattggctttggtgacgggtcgtgcgtaccctgagcaggcccatgaaaccgcgaaatacctgggaatcgacgtacttgagaccacggcttacgatttcgccaacggcgagatgtatgtgcgttacaccgagccggtgcgtggcgccgatgcgttcgtgatgcaggcgcacaccgagccgatcaacaagtggattatggagcagctcattatggttgacgccatgaagcgcgcttccgcccgttccattaccgtggtcgcgccgttccttggctattcgcgccaggataagaagcatcagggccgcgagcccatcaccgcccgactgattttcgacctgttccgcgcagccggcgccgaccgtattatgacggtcgatctgcatgccgcccaggagcagggtttcttcgatgggccggtcgaccatctcaccgccactccggtgctgcttgactacgtgcgcaacaacatgccgcttgagaacaccaccatcgtgtctccggatgccggccgcatcaaggtttccgaacagtgggccgcgaagctgggcaatctgccgctcgcgttcattcacaagacccgtgacaccacccgcccgaaccatgccgaagcgcatggcattatcggcgaggtcgaaggtcacgactgcgtggtggtcgacgacatgatcgacaccgcgggcaccatctgcgaggccgtgcgcacactgaacaacgctggtgcgaagtccgtgacgctggttgccacgcatggcctgctgtccggcccggccgtggaacgcctgagaaattgcggtgccaaggaaatcgtgctcaccgacaccgtgcccgttccggaagagaagcgcttgccgaacatgaccgtgctgtccgtggctccgctgttggccgccggcatccgttccgtgttcgaatccggatccgtttccacgctgctcaacggtctgcccgaagacatgcgtccccgcaatatctacgcctgattcgcgcaatcttttcaacgtaacaaaaactcgcccccatccggtcggcgagttttttaatgtcagatcttcccaaaaacggggtgccgcatcctacgtcggtaggatgcggcaccccgcgtatcaagagagaaaagagaaatctggctagcgtccgataggcatcctcgctcccgttatttggcgaatgcttcgcggatttgcgcggcattgccgtaggaggcctgcgcaccataccctgtggcggcgtatgccgaaacatacgaggcaagctcggccgcttcggaaagcgccatgcccgaggcaagaccggctagcaccgtgcccatgaaggagtcgccgcagccggtggtgtccaccgcgttcacacgcacgggggcaatgcgctggatcggcgttgccgaagtggaatccaataccacggaaccatcgccgccgagcgtcacgatcgcctgttcgaaaccgaatccacgcattgcttccagcgcatgattccaatcgaaaccgtcccaatcgtcgttttccggctcgtcaatgccgagcagctgcaccatctcatgctcgttgacgagcagaatatcggatgcttccaccagttcggccggcagcgacggggtgaacggcgaatcgttgagcagcactttcacgcccgcttcatggcacatgcgcgcggcggccgtcaccgtttcgatcgggctttccaagcacaggccaagtacggaagaccgtgccagcgcatcgcgcacggattccacataatccacggtgacctgcgcgttggatcccggcgagtacacgatggtgttttcgccggttgcgtccacggtaatcacggttgtgccggatggtccgagcacgcggcgaacatgcgtggtgttcacgcccgcctcgcccagagcgccgagtaggaagtcggcgttggaatcggagccgaccgcgccgaacatctgcacggttgcgccgatgcgcgctgcggcggccgcctggttgccggattttccgcccggcagcagctgcagcggaccgccggtgatggtctcccccggccctggcagacgctgtgcggtgacggtgtagtccgcgttcatcgagccgattacggacactgtgccgtggatgcggtccaatgcggagagaacttcagtcgcgctcatctttaccttccttacatcaaaagaagatttatgaaaatggagatttgcgaaatagtgttgttcagtaatcgcaattatcgcaaatccccatttttattatattgaggatgtaatgtgcgattactttgccgattcctcggtttccagcgcatggttgccttcgtagatcttcttcttgaagacgaagaacacgatcaggccaagcagtgcggtaccggcggcgaccagcagcaggttggcatagttggcggcagtgccggttgcgccggtgatggagccgcctgcgagggcgttggagccgagcaggctgccgatgatggcgatgccgatggacggggaaacgttcatggccagatcgttcatgccgacgccacggccggattcgtccttttcaatggtgcccagcacggtggagaccaccggggagtacatgaggccgcagcctgcgtagaacacacatgcgcacagggtcagcaccacgaaaccggagttcacgcagaatgccgcaccggtccaaccgaggaacatgagggtgcctgcggtcacgatgccggccttgattccgatcttgcggatgatcatgccggagcaggtgcccaccacggcggcgaccacgaaggcccacacaatgtgcagggagacctgggtggtggtcatgccgtagatgttggtgccgatggcgttgaagatcgggctcagtgcgtagttcacgaagtagaacacgagaatcaggcagatggcgcgcagccagcgggtgttcttgaagaacgccggggtgatgaacgggttggaggccttgttgatgtagaaggcgaatgccacgaacagcagcagggagaccacgagcatccaccatgccatgtacgagaagaacagggtgaggaatgcggtggcgaagccgaagatcacgaagccgaatgcgtcaaccttctggccgttgccgctcttggacggcagggtcttgagcaggatcggcaggaacaggatggtgacggacgggatcaggaacaggaactgccatgcgatggagctgagcatgccggctgcgaacacgccgatggatgcggaaagctggtatgcggcggtgaacagaccgaagaagatgaccttcaaatcgttacgcaggtacttggtggccaccaccaggaaggcggaacctgccacctgttcgcctgcggtctgcagcacgcgtgcgatgatcacggtccacaggtttgcggcaaagaagtagtttgccacgaaaccgaagatggagccgacgaacagcgtcacgagaccgacggtcacaagcttacgcagggagacgaaatcgcccagggaaccgtagatgaagcacacgatgccgagcacgatgctcggaaatgcggtgatcagggacgcctggttcggtgcgccgacgtcggcgccgacctgctggaacaccaggttgaagccctgcaggcacagggtgccgagcacgaaggtgatcagcagcgggatcagggcgcggatggccatcttgttgctggtcaccggatcatcgaacggatcggcggatgcggtgccggtcacggcggttgtgttgttagacataataaaaatccttgattctctcgaattgcgcgatatgcgatacgcgattgcttggccggttacgcttattcagccttggctgcgaggccggagatgcgggtcatgaattcgttcaggaagcgcggcacgtcgacgccgacggcaaccttcatggtcttggccgggtcattcaggcgggtttcgtcgccgatggtgcgtccgcgggtcgggccttccacgtcgaccttcatattgatgtcgagggtggtgacgagggtcgggtccactgccacgccaacggcgagcggatcgtgcaggccgcagccgcccagatgcggggacgtggtttcgtaagccttgatgtagaagtcggtcatgtcggccaggaacttgccggccttggtgccgaggtcgcgccactgctgggtttccttgtaggtgagcagggtctgcagggttacgtcgagaccgatcatggtggtcggcgccccggaacggaacaggtagtcggcggcttccggatcctgcgaaatgttggcttccatgcaggcgttgcagttgccgggtacggtcagtgcgccgcccataagcacgatttggccgatttcatccttgatttccggtgctttcttcagtgcggcttcgatgttggtcatcgggccggtcggcacgtagacgagatccttgccataggtcttcactgcgtcgatgatgaagtcgaccgcagattcggtttcgacggaacggctggaatcggggatttccacgtcgccgatgccgttgtcgccgtggatgaacgcggagattggcagtacttcgaagtgatcggtggtgctggagtgcggcaaaccctgatacaccttgacttccgggtggccgagcaggtcggtcacggccagtgcgttgcgcacaccctgctcgacgagcacgttgccgtaggtgccggtgatgccgatcagctcgacttccgggcttcccagagcatacgaaatggcaagcgcgtcatcaacgccggtatcaagatcaagaatcatctttttcatgtgtgtgcctttcctctttgacggcctgacgacggtccgccaccatacgggtgcgtcgtcagttatacatcgagcgcattctcgattgtgttgtgttgacaagatttatgataaagcgttttatcaagaacgcaaattcttcacctatacacggcgtgttgcctgtattcccaacgattacagcatattggagatgcttacgtcaccacataccgagattgatctgcaccacccgttttgcaccagtctgcagcatctaaaaatggcggtttacgcgcaggccgcctgcaccagtttcggcgtaagcacttcaacctgcggatcggaaagccacggacgggcatcccctgattccgtaccggacttggcacgaaccgcaacatcaatccgcttacgcaacataccccaacaagcggcggccaaatcagtcacgctctgctcaacggtggtcatacgccaaccaagaccgaatcgtttgagaatattgtcgtaaccaatcacctgcatatcctcagtaacatgcaacccacgctccgccatacgctgacggaagccaagcgccatcacatcgttgcagcagaacacggccgtcgccccgccatcgatgatctgattcgcggcacgatagccgctatcgaaacggtaatcaccctcaacacacagcgaagaatcaaaatgcttccccgactgctcgatggcatccacaaaaccacgacgacgctccgcggcactcgactccgcaatatcgccggtgacaatgccaatacgagtatgaccaccttccaacagatactgggcagccaaacgaccaccaagatagttgtcaaaaccgacggcatcgcaccagccgcactgcgtcaaacggtcgatcagcaccaccgggcacgacacaagcgccacatcctcacacagctgctcaacagcactcccaacacacgactcacgcgccgggatcaacatcaccccatccaccccacgggcaggaagacgctgtaacaactcatgctccgcagcacgcgaatcatcggaattggccacaatcagcgaatacccctgcgcggcgcactcatcctccacacacttggcaagcgccgcgaaaaacaagttctcaatatcaggcacgatcagcgcaaccagctgggactgcttggtcaccaagctacgcgcgctctgattcggcacataattcagcttcttcgccgcgtcggcaatggccttacgcttctcctcagacacgcgagccggccgattattcaacaccagcgaaaccgtcgtcacagacacccccgcagcagcggccacatccttcaacgtcgcacgatacgccattcaaaccccttaaaacgtttctccttccagcataaatgccacgcactcctgacgcgcccagcacccccatccacaaacaaattcctttcatagcaaaataatccacattatttccagtggtaaatcgtttctcagaaatgtttttgtatactcgcaacgttttgcttaatacgaaagccacagagaagagaggaaccccaatgcaaccaacagcacagaaaaacaatgcgaaacagcgcaagaccatcgccatcgtcgccgtgatagcagtggttgccatcgcgctcgcagccgttgccatcatcgcagtcgccaataagcgcgaaatgacgcaagccgccagcgacacctgcacgttgaacgcgaaggcgctcgccacgcatcagcaaaacttcgaagaggctcagaaagaagccgaagatgcggcaaaactcaccgtggacgacgtggccgacggcaccacgctggaaaccctgaaggatgcgatcacgctggccgaagccgtggaaaacgcgccaacatgccccgcgaacggcaatgccagcgacttcaccaaggcgacagacgatattcgcacgtacgccgacaacctgcgcaacatcaccaacgaactcgacgcggccgccaagtcggtgatcgccagccaggaactcaaactcgagtccgccaagtaagccgtccgagccagacgagccgacagggcgccgcccccagctccgccacccctgcgttcaacggggccaagttgcgttttcaaacaactttgacctcgttaaagatgactttcgcaacgttttcacaacccgataaccgcccataccgcaaatcgatacccccttccgcaaaaacccgaaagagcttattaacggggtcaaagttacgttttggacgacttcacccccgcacaagcgctttcgcaccgtatctggcttatatatggcagattcgacagtccgaccggaggcatttcctgacgaagtcagctacttgcaacacgttatttcccaatcgccacttgccgaacccaattaccaagctgcgtcgcatccaccatgacgcaccgtcacaaacgttcccgtccgacgcgctttactggccttgggcgcggtagcgggcttcggtggcggctttggcgggctcccaccaggcgcggttggcagcataccaagcgatggtcgcttgcaaaccggcttcgaaatcggtgcgcacaggcttccatccaagttcggtacgcagcttgctggagtcaatcgcgtaacgccgatcatgcccggggcggtcacgcacccagtcgaacgcatcttcggcacatcccataagccgcaggatcatacgcatcacggcaatgttgctcatttcaccatccgcgccgatcaggtatgtttcgccgatccgcccgcgtgtaagaatcttccacaccgcagaagagtggtcttccgtatggatccagtcgcgcacgttctcgcctgtgccatatagtttcggacgcacgccctccatgatggaagtgatctggcgtggaatgaatttttccacatgctggtacgacccgtaattgttggaacagttggaaatcgtggcgcgaagcccgtacgtgcgaacccaggcacgcaccagctggtcggatgccgcttttgacgcgctgtacggacttgacggcttatatggcgtgctttcggtgaatttgcatggatcgtcgagcgcaaggtcgccgtacacttcgtcggtgctgatgtgatggaatcgcacgtcatgcttgcgcgccgcctcaagcaggtggaacgtaccctccacattcgttgtgatgaagggttcaggattggcgatggagttgtcgttatgcgattcggccgcgaaatgcacgatcgcgtcatgcccgggcacgatacgttccagtagtgcagcatcgcaaatgtcaccttgcacgagttcgacttgcgattgcggaagaccggcgatattctgcggatttccggcatacgtcagcttgtcgagcacggttatgcgcacgtcaggatggttgtgtgccacgtagcgcacgaaattggctccgataaacccacatccgccggtcacaatgatgttgcgcggcttgaaaatctcactactcaccatttcagggtaccggcagggttgcatcatggagcgctcgtgggcgatgtctcgaatcactaattcacgtaacccgcgcaagccgaaaagttcaatggttgcacggcttcccccgtggcggatgcgatatctatgacagattcagcaggtttttcgcactccaaaccttgatttggtgtatgaacggcacctcagttacccttgatttggtgtatgagagcgcctttcgcaacccttgatttggtgtaaagaccgcataatcattggcttttcaagcagagacccattgaactcaaacgagcaccctaaatttaggtcctggcagaagagaacttctggattacatggcaagattcgggctctaggccaagtatgagtcaggtcccgcttccgcctccagtgaagccgactcgcttgcagcgtgacatcttcaaaagcgacgcttaccgaatctcagttgtcagactgcgtcacatcgccatggcgaactgtcataagcgttcccgtccgacgcacttcacaaattcgtcttcctgaggcttggaacccttatagtcagcaaacaacacttcaaaatccggaacagcaatggtcttcatacgagcacaagttggaacggcatgttcagcagcaatatgtccagaagtcggaatagtgcgttcatggtctgtcatggcaaccacgttacatctcacgtcaacggtctaactgcgccaagccacgcaccgaatccgccgcccgccttctcgtcgccccatacaagccacgctttcggcgcattatcagctggtggcatccaacacttgcgcgcgcatatagtcgtccaccttgaacaccaaatccgtctgtcgactgtcgctcgcagcaaattgagtaaaaagatccacatatcgagcctctcccccagtctgcaaatcaaccaattcctgcgctacgacccttcagatttcgcatacattttgttgccctttcccacttacgttgtaggcagataccccacgtagcacagttaaccttccagctacctttcagacatctacgagatacccgttcgtccacagctgaacactaaaatgtatccggtttaattgtacagagcccctaattataaggggctatcttgttgaaggatgcgacgatgcctattttttcgcctgaccgtcatgcttgtgcaccttcatacgtaaaacttactaagcagccgattgcgggtggaacatatcgccctcttgcgaatgacgaagacagcaacgcttgcgccccatccgccctttcaggtcaccatagttcaaaactgtatacgcagaaatcagcaattcacgccatctccgataacacaagcatctttatttcaggcgctggcaccctgccctgtttaccggagatggcttccagtggatccgtcagtaaagccgaaatagacaataacgaacaaatcgcttcttctgagctccagccccatcaacccgctgagcagcctttgaatcaggtcgtctcggtttgcaaacgagccgcacatactacggcaaaaacgctttccaccgcagggcacacggctgtaaaagcaaccaaagttaccggtcacgccatccacaccgctgccacagcagtaaaaaacgcatggcatacttttattaatttcaaagccgttcaactcatcatcaaattcttcaaaaaggcgtatggcctctggaagaaacgtcatcgcttctcattctcgttctacgccattgttctcgtattagtcaccgcttttgaggtcgtttttcttcagtggggcatgtacagcgagccggaatatcctgaaggctcggaaattgacgatacgaccagagttttgcaaagtgttattgggcgcacgacaaaattcgttagccagatctggattgaccatcaataccaagcattactgaatttcatagttttgggtgttatttaccttactctggtgctgattctcaatcgtttctgggttgcttcagccatctttggcacagttatgacagtatttgctgtcgccaatcacatcaagatcgagtcccgcaacgaacctgttattcccgccgatttgaacttcatcacaggaggcaatgcgggagaactcacttcctttattccaaattccagtcaggctctagttgacggtgcggtagctggcgttatttgctttgtggccatctgcatcgtcatgcaattccttgatggcagaaatgcagtcatcccctgccactggctacacccgtttgccagcgttaaaaattttgccggcacgattacgcgcattttggcagccgctctcagtactgcactcgtattttccttcgtgtggggactcggagcagacgattcctgggctacaaaatttgcccacaatctttccgaccgcccccagccttggaatccaattgctgacgctaccagcaatggtcccgccatcaatttcctccagcttgcacataccaagatcatggataagcccgaagattattccgaagaaaccatgaccaagattacaaagaaatactccaaggaggctgattccatcaatcagtccagaacaaccaatctgactgataacaccgtaatcatggtgctttcggaaaccttctcggatcccacacgagtaccgggcgtaagtttcgccgaagatccgatgccaaatattcgacagatcaagcgcgaaacaacatccggtcttatgctttcccccggctatggtggcggtactgccaacatcgagtatcaagctctcacgggtctttccatggcgaattacagcgataccctatctatcgcctatcagcaattagttccgggacaaaagtgggatcagtccctcaatcagctatggaatgaaaagaatggcgaggactcttctgtagcctttcacgcatacaaccgtggaatgtatttccgcgatatcaactataagaagttcggattctctaaattctacgccacggacggaacacccaagctcacagatcttcatcctatagattcggcttggtattcttccgatgaatcgttctatagccaggtgttgaaacaggtgcagtcctctgactccaacaagttctatcaggttgtgactatacagaatcacatgccttatgaggaggatttatacacagataatcagttcaaagaacttgatacttccgaaaatcttcaggagaatgaacgactcaatattgagacttacactaagggtcttaattacacagatcaatcaacgttagatttccttaatcagctcaatgacatcaatcgtcctatcactgttattttctacggggaccacttacccggcatctatagcactgcctactccgattcagacaatattcttggtcttcacgaaaccgattacttcatttggtccaataatgcgtcttctgctgctggaaccaaacttgatgacgcgtcctccgcatacacctcatccaactatttctccactcaacttgcttcacatctcaacgcaaaggtgagcccttatctggcattcctgacggaaatgcatcaagccatatctgctatgtctgttccttcagcagcgggaggcagctctgaagaaccggtatatctcaacgctgctggggctcgtatgagtaagaaggatctttccgaagaggctaaaacactactccatgattacaaactcattcaatacgatatgagtgccggtaagaattaccttaaagacactaatttcgtagagcttcagtagattcgtgttcctcatcaccgccagtttctacaatagtgctagtttgtcgagaataacgaaagccggtaactatgaaaattgcagttgcaggaactggatatgtaggtctttctgtcgctttgctgcttgctcagcataatgaggttcatgctttggacattgttccggagaaagttgagcttctaaacaacggtaagagtccgattgtggatgctgtgattactgattttctggagaagaacacctccggcgagcgtcctctggacttccatgcaaccgttgacccagaagaagcatattccgatgctgatttcgcagtgattgcaacgcctacgaactatgacgagaaaaagaattattttgatacttccagcgtcgaagctgcgatttccgcagtacgaaagtatgcgccggaagcgtggatcattattaaatctacgattcctgtcggatacacgcagcagctacgcgaccgtttgaacgatgatcatattctgttttctccggaattccttcgtgaaggtcacgctctgtttgacaacttgcaccccagccgtattgttgtcggtgctccgcaggatgacgcacgttccgtagaggccgcacgtacttttgtggatcttctggctcagggagcagcccccgaagaacgctctcgagtcaatcatgatggcagtacaggcattccagaactggtggtgggcactaccgaggccgaagccatcaaactgtttgccaacacgtatcttgcgttgcgtgtggcttatttcaatgagcttgacacttatgctgaaagccgcggactgagcactcgcgaaatcattgacggcgtttgccttgatccgcgcatcggcgacggttacaacaatccaagcttcggatatggcggctactgcctgccaaaggacaccaagcagctactcgccaattacgatcaggttccacagaatctaatcgaggcgattgtggatgctaaccgcacccgcaaggaattcgttgcttctgaagtgatggatcgcatcaaagatgtgaaagatccgattgtcggtatctaccgcctgaccatgaaatccggttctgacaacttccgccagtccgcgattcaggatgttatgaagcagttcaaggcaaacggcatcctcgtactgatttacgagccgacgctagatgccactgacttcttcggcagcgaagtaacgcacgattttaattcgttcacggaacggtctaccgtcatcgttgccaatcgctggaatgatgaccttaacaaggtatctggcaaggttttcactcgcgatttgttccgtagagactgacaattcttttaaagccctaatgaatttctagggcacaactaggaggggcgtctggtgcttgtatgaaccgcaccccgattgttggactgaggaaattcagattcgatgatcggaggtgcggttcatactcagcataacggctcctcggtaatcttctctcatgcgatagtgagacactattgttccactactccatctcctaccgtatcccctttccttcatatgcgacaagataaatgcggttttgaaaggacaaatgtcaaaaatgctgcatccgcaggcagattaaagcaattcggcaaaaacaccaatccaccaaatgatgtgacggcataagccaacacacccatccgaatctacaccctacttaaaataagggggtaaacactttgatgaactagctaaaggagcacatcatgagagaaaagaagaagcctaagaagcggatattatgcgcgataatatcatgttctttgttggcaagcataggtttcgcgcaaccggcgagcgcagctgacaccgcagtagacacgcccgcagtccaagacgacatcgagacaatgtcttattcagatggcacgtcgaccggtacttcagagcttaccggagtgtcactgggaacaggaacaaccgtatacgcgaaacaattcatcaaccaagtggacgtctacaactcggcactgaatgaagtcgtgaaatggcgtcgagacgcgctcaacgacaaacaagtaactttcggcgtctacaactggcagaccaagcaaaccgattactattcagtatcggattacctgaagaaacttggaatctccgaaaacgaatatctaacgccaaaatggtctaatgcgttggaacgaatcgcaattcaacgagcgattgaggcatattctgcagaggatgcgcatactcgacctaatggagagagctgcttccgagccagctataacaaaatccaatcagaggcagaaatactcgcatggggtcctgccaacatatccggcgcaattgatttatgggccgaagaaaagaaagactacgtccaaaacacaggagctgaagtcgggcattatcttactttgatcaatccaaactatgagtattatggtttcgctgcaggagatggacagtattacagaacaactttttctggagaggcaggaactcgcagcagtgccgctgaatactcggattcaactccgacgaacatgcgaggcctagggcaattcgaagtcaacgtggatgacgatgatttacgagaaggggctacttggaacctgtcatcgatgaagtctggatccacgcaaaccgcaaaagtaacgctgaagcacaggtccggaagatatgagttcaggggcacatggggatcttccaatgcgaatgtgattagcgccaaccaaagtggcgtatataccgcggggaaggtaggaactgcgaaagcaaccgtttcttctgggtctttcgctttttccacggatgtcacggtcatgcctctcactttgaaatatgacggcaatggagcgacctctggctatgtagcttcacagacaggatcccacaatgatgagatcacagtggcgaagaatggtttcagccgatcaggctacactttctcgagctggaacaccaaagctgatggtaccggcacttcatatgcacctggatccaaaataacccttcccgctggcgataccatcttgtacgcacaatgggttgagaatccaaaactgacgagacttgccggacagacacgctatgacactatggcaaccatcgttcaacacgaacagacaaaacaaggacaaaccgtcatcatcgcttctggagagaattatcctgatgcactctccgcgtcaggcttagccggaggattagctgcaacgattatgctcgtcggatctaactctctgcccagccaaactgctaaccgtcttgcctcacttaagccgaatcgaatcatcattatcggcggtccaagcgcaatttccaaaaatgtagaaaacgcactccatcaatacagctccacagtcaccagatattacggagaagatcgttatgaaacctctcttgcagtattcaaggcggggcagaagctgggagtagaatggaattccacagcgctaatggcaaccggagataactacgcggatgcgctctccgcgtcttccttggcttacgcgcagaagatgccgattttcctgtgcagttcagcttcaggattctcttcatcccaactggatgccatcaacaaaaccatcaaacagggtcttgtaatcggaggcaccagcgccataccaaattggattgtcaacagccagctgcagcagcagcaaggcatatcaacaaaaagaattgccggcgcaactaggtatgagaccagcattgaaatcgccaaaagcgcagagcggtatgggttgaccgctgaaggtagcgtcttcgcaaccggcgccaacttccctgatgctctggctgccggaccgcttgccggaaagaaaaacggattcctgttgctagcggatccttttggaactacagctcagtttgttcaaaaatacaagaatcaagttaaaaccgcttacgtagttggcggagaacaagctgtttcttccaccacggctaaccagatagcagatagtctcggtctgcgtcatccgtaagtttcgtagataagagaatggaatggcgggatgccagcctaggctggcatcccgccattccatttagtgagcaaacaccaccattgacttatcagatacggcttgttcctaagcagtcaatatgaagcgccttgtcattaagaagtcctgcgaaattagtagttcctggatttcgaaccgagaagtagcatgagttctcatcactcgtaaaagcaagctgctcaaacttcctcagatttgacgtatccggaatcttgcgcatggtggcgataatcttaaaatctccatcattgaatatgctcagaggcaacgcaaagtgaatcttgttatgcccggcattgctgaatttaaaagcgacaccacagtcatagggcacaccgccgcgcttgacatccaagaccgacataggaatgtagaattctccgccgtcactatcacgaagatcatattcgacatcaaattcgaacgtctcggcacaggatgaaatctgcggggaaacaggcagaattcggaaagtgggcaccttctcactcaagcctagtgaatattcatcttccggattttcttttcgctctttatgctcagacttgagattttcgagagtataacgatcggcaacatcgttcttgtcaccactggcgataatctcgccgtccttgatcaggatggccttgttgcagtacttcttgacggaatccatggaatgggtgacaagaataacggtcttcgttggatctttcttgatttcggcgaagaagttgtcgcacttacgctggaatgcttcgtcgccgacggctagaacttcatcgagaactaggatatcgccttgagccttgatagcaacggagaaggcgaggcgcacctgcatgcccgaagaataattcttgagcttctgatccatgaaatcttcaagctcggcgaactcaacgatgtcgtcatacatcgcgtcgatttcagcacgagtgaagcctagtagagcaccgttcagatacacgttctcgcggccggtcaactccggattgaatccaacaccaagctcgatgaatggcaccagcttgcctttaaccgttacggaaccatgttccggagtatagatctgagaaataatcttcaacagcgtggacttgccggaaccgttacgcccgacgataccgaagaaatcaccttgacgaacttcgaagttgatgtcacgcagaacatgctgctcggtatagcctttgatgcctttcgtccaattcagaaaggccatcttcaagccagtagcctgttctgtaggcagacggaacattttggcgacatggtcgaccctgagcactacagggcgctcgtcaacgtttccctcttcagtcattgcaacctcagtcatgatttagagcacctccgcgaacttggaactgtacttacggaacacgtgaacgcccagccacagaatgaaaactgacaacgcatacggcagcaagcaaagcaacttgttatcaaccatgctccacacagtcggcacatactccggagaaagcagattatgacgaatatccataatcacctgagtggaaggattaagcatcaaaatattggcggcccagccgtaacccttatccgcaatcatggaaattgggtagatgataggcgttgcatagaacatggcctgcaatatgacttcccaaatatgagccacgtcacggaaatacacgaacagcgaagcaagcagcaaagctacgccaagaccaaggcaatacaactgaataatgctgagcggcacaagcaatactcgccacgtgtaatgcgcatgggcgaagaaaccgaagcagatcaccacgagcaggttgatgccgagagaaatcatagaacccatagtggtggaagccacaataatgtagttcgggaaatgaaccttacgcagcaaatcaccgcggccaacaatggattgcatacccatgctagtggattcggagaagaagctccacaagcaggtaccgcacaacaacgaaatcgggaacgtcggggtgccgtcggagaacttcaagaacttcacgaacaccacatacatcacagcgaacaacataagcggcttcaacacggaccacaccatgccgaggaacgatccttggtaacgcaactggaaatcggttttcaccagttccttgaataccactatcgcgtagtggtacctctttttgaggctgtcaaaaaagttcttcacaagcgtcctatcctactagtgcgaagtatttgagcacaaaaacgtatagcgtgcccttcttcagcagtactttcatatattctattgtggaaaggacgtttgtttcagtaaggcggaatatctcacatggctctcacaggagaacatcagcatccggatatcaaaatcttcgtgtcggcacacaagcctgctgttttccctgaaggaaacagcatcctccctgtacaggttggagtggcccatgccgcaaggcggttcaacagcacgctgcatgacgatgagggtgagaatatttccgataaaaatccccgttactgcgaactgaccgcgcaatactgggcttggaaaaacgaggatgccgactactacggtttctgccactaccgacgctacttcgatttcaccgataccccgcatcaggaaaacgactatggcgaaatcatcgattcctatatcgacagtcaaaccattgaaaagtatggcatcaacgatggcgatatctccaaagcggtagatggatgggacgttatcaccacgccgcttaatgacacccgtcgtattggtgggtttacgaatctcaagcagcattgggatgcggataggcatcttcgcctcaaggatttgcgtcacatgtacgacattctgtgcgcacgtcatcctgattacaaagcggatgctgatgcggtgctgaatggccatactgcagctttctgcaacatgtttatcatgaagaaggatattttcttcgagtacaacgaatggttgttccccttgctggatgagtttgccgagcatactgatttcagcaagatggatgtgcagactactcgcaccgtggggcatctttctgaacggttgcttaatatttttcttgcacataagcagcgcactggagccaattggaaaatcaagcgactgcagtgcgtgcattttctgcatccggaaccgttcgccaagcttgaaccgttgcaggagaatcctgaaaccattgtgcctgtggtttttgcagcggacgataattacgttccaatgctcactaccacgatatattcgatgctgaagaacgcttccgaagatcgtttttacgatgtgatcgtgctggaacgaaacatttctgacgagaacaagcagattattacgaaattccttgcgcaattctcgaatgccgccgtacgtttctatgatgtgagccgatatcttgcaggattcaatctcaccaccagcaatgcgcatatcagtgtggaaacgtattatcgtttcatcattcaggaagcgttgcctttctactcaaagctgctgtacttggattgcgatcttgtagtgaatggtgatgttgccgaactgttcgatacggaaatgggcgataatgctatcgccgcagtgccggatatcgacttcatcggcaatctcaatatgaaggatggtattcgcgccgagtatgtgcgcaagcagttgcatatgcgtgacgcctatggatatttccaggctggcgtgctagttatgaatttggatcgcacgcgtaagattcatacggttcatgaatggctgcagattgcctcgaagccgggatatatctacaacgatcaggacattcttaataccgagtgcgaaggtcttgttacctacctcgactattcgtggaatgtgatgcataactgtgctggacgtgtggcgggagtattcgatttcgcacctgcagacgtgtataaggcatacatggaatcgcgcaaggcgccaaaggtcgtacattatgccggtttcgacaagccttggaagaatccttggtgcgatttcgctccactgtattggcagtacgcgcaggaaactccgttcgttgcgcaaatgtacgccgccatgtcgggagtgcagaagccggaacctccggaacatcatgatcgggccattgctgaagacagtccaatccgtaaatatgtggatgttttagcccccaccggatccaagcagcgcgaactcatgaaagtcgtagcgcgcaaggtgcgaggcaagaagtaaaacaagtagcgctaccggtcatccgcgtatgtgttggggctgtccgttcctttaaggagcgggcagccccaacgcatatctctgaatgccctcacgaagttgcttagtttgtcagagccaaaccaagactcttagaaagccggccggcagtgttccagctaaccgcattagctcctcccaaaatgtacgcttcagacacagattccgcataagaagacacatagcttcccacattggatacggttgcatcgctgttgttcaccagcaacatacagcttgcatcacgaccagccaaaggacctccagataaggcatctggatagttttgccctgtagtgaaaacaacattgttcatagtcaatgcgccctgtccgatagcccagcgagcgaaaagaatactcgtattataccgagtctgcccagcaatacgaattggtttaatacctaccgtctgctcgatttgagccgagacaaattcaggaactgcctgagcccctccaacgattacgatttgagtaaagttcccatcctttaaagcattctgctgatctgctgtaagaccagtctccgcatcagataagaacaccggtgccttctgagcatacgcataggatgtcacagatagtgcatcagcaaatccgttttgattatttcctccagtaacaacaaccgcggtttctccccatccagcggacagactcttccccgcttcataaatttgcaatgccgtatctattcgtgtggcaccctgaattcgttcaactccgtcaacgcattgctttaaagaagactccacatcagaggaaaccgctttttctccaccgacaataacgacggaagaaggcttcaagcgctttatttcattacgtacgttggcactcaacacctgtgggttcgtcagaagcacaggagcattttctatgccggcaaatccggaaacagccaaagcatcgggataattctcacccgaagtgacaataaccgtcgaagtctcctctggaaaagcagtgtcgacaacatccgtcatcgtgtcgtaccgattatttccaaacaaacgaatcatttgcccatgcgtatcgtccggagtgggatcaggattcggtaaaggcacttccggagaagcgttattcccgttgtaaaccgggatagtttgcccggacggacactgagacaataccgaccgcattgcttctttctcagcagtgtctaccgaaagaccgtagtgttcttttattccgatttgacgactcacatacgagcagtcatagctcttctgagaaggaagccagttcgctgcatctttatccgattttgacgcattcgccgctccttttacggccagcaaaacataaggatcattggcataggcaacccgctgattctttgtccaagcatcagcgccactttcatacgcctcccctacggcaacgacatgatcaatctgaaccttattagatgtactctgccctctttgaaaatagattgtttctccggtgtacgggtcatgcagtgttccagtattaacatgcttttccgacgtgaacgtgacattttccatatctctctgcaaaatatagtcacgagtagtcgcgctacctccaagctcatcattgtggagccaggttccgaataaatcctctctttccgaggaacggtaatcatctgactgcgctttgaccattaatcgttcaagagcaaccgacgcattttccccctcatcagccgcagctgggagcgctgcaatcagtaaaccgaataaaacaaaaatacaaaccataataggaatgtctcttcgtcccaagcgtctcatagaaccccctcaatctcagtcggcgacccgaatctccacattcaattcaacacctttcaaaggtataatcgctctaggcacaccgtttgaggagagaaatatgaaatcgattcataacaaagttcgaagtgtgattgccgctatcgtatgtgtattttgcactctagcgcttatccccacacataatgcatatgccagcgtcaactcattcacccgaatcgcgggcaatactcgctatgaaacgatgtctcagatcgttgaacaggcatttcctacatcgtctgagtatgcggtgcttgcggcaggaagcaacttcccagatgcacttgccgcttcttctctcgctggagcctataacgcacctataatattgacggattcctatagcctgtcaagcgaagcttccttcgagatgcaacgtctcggagttcgcaaagtctttatcattggtggacaaagcgctatttctgccgatgtggagcagtcaatccgtcagattcagtcctccatggaaattgaacgaatcgccggcagcacccgttatgacacagctctgcagatttacaacgctttgacctcctcaaatacgagaagccaagcttccaaagtagcaatcattgccacaggaaacagcttcgccgacgctctttccatatcaccttatgcatatcagacctcttcgccattcttcctcagctctccttctggtcttgacccagattcccttcagattctggaatccggcgcattcaattccgtcattatcgccggaggaacggcagccgtcccacaacatgttcagacgaatctggaagcactgggaatcaacgtaactcgcttatccggaggcactcgctatgaaacgagtaaatcaataggcgagttcgtgctcaataacctaaattctgcaccgcaagatgtggtattcgccacaggatccaacttcccagatgcccttgcaggcagcgcactatcaggatcgaaaaagactgccatgctgcttgtgcaagacagcaattctccgactattgattttgcagcgcaaaatatttcctccgcgcagaacgtctacgttctaggaggaaaaaatgcagttaactcgtccacgcttaataccattgcgcgagcatatggtttgggggatcaggaaagcgagccacaaccgccagcgccccaacctacccctcagccaaacccacaagtaggcactcatgatgctggagaattctgcaagaaagcagatgtcggcaaagttgaatatgcgaaaaacggcagactgatcgtttgcgaatatcgaaataacaataaaacaccacattggcactatgtatagcgcaatgaggcattagatgggttgggtgccgcaaggctggactttgtggcacccaatccatctaaactaatcaaagatattgatcaagctcatcatcccgaacaagctgatcaaaatcagctgtcaaggcatggcggctcttcatctcttcaagaattgccgcaagcacgatgttgttcacgccactttcagtattctggtggcacagggcttcctctccttgcgtgcccggaacataattaagcaattgatcgcctgttgcagccacaacaggcactcccgctttgacttgcatcacttttagccacaaatcatccgcagtgagacacaatttttttatatcttccgcattaaaagtttcagacggcataaggtgtggtgggtacaaggttccggcaccatttgtagcaaatactctcatcgaaggctttcctacaagatctggatgataatggggagcttcgtaaatccactgctcgtacggagtgcatgaaccttgttcatcgaacatgatgagatgggttctcacggctacgattgctttcggatgccgttcatgcatctccatcagatcaccgatcattgtattcctgtacaataaatcgtcatctgttgtaattacataatcatctttgaactcttgcaaagcccaataatatttcttatgcggtttgagatcattgttcacccaacgcacttcaacatcatgccagagaacgtctttcaacgattcgggaagatcatcttccctatttggaaaatcgctttcacatagccaaagaataattttgtccggcaatcttttttgagcaagcaacgtacgaatagcaaagtgaacagtgttaattcgtgccggatacgaagtcatggaaactatgattcgaggatgccgccggaatacacgagctagatgcgttccagcacggcgaagcttgttcttcttctcaccaacccatgtcaagtctaccattatgactgctcctcaagttcttaacaatgctctacagcaatgatacttatatacgctgcttttcagagtcaacggatacactgttaacagttgcgttagtagtttgcccaatcgagggagagttatgccgaagatctcaatcatcattcctgcatacaatgtcggcaaatacatagaggaatgcttggagtcagcacgaaatcagaccctcaaggatatcgaaatcgttgtcgtcaatgatggaagcaccgataataccggcgatgtcattgcccaggaagcttcaaaagatagccgtattcaagtggtgaccaaccaccccaatatgggcacacaccgcacccgtatggcgggagccgaagccgctaccggagagtattctttcttcctcgatggtgatgatgcgctcaagccagacatgtgcaagcaacttgttcaggagttatcattgcatcctgcagatgttcttcatttcggcatcacagtagtcggggcaaacgaacttctggattccgagcgcgaagccttcgaagccaataacaacgcgtctacgcaggatgccgtaggcgaggacataattcgcgatatcttcgacgaatctcgaggatataaagtggactggcgagtaacccagcgtctgtacaaaacgtctgtccttaagcaggcttttgcagcaatgaccaaggagcgtctcggccgttcacaagacggatatgaatgcttcgttgtttctgcctttgcaaagacatatcactcatgcaagcattgccgtggatatatttactactacggtcgcggtatcagcggaaccagcaccattagcgctgagaagtacgcgcagtattgtcatcatttcaaggccgattttgacgcagcatacgatttcgccgacactcagcactcagaaatgcttcgcgcttgcgctcagggattccaacggaaagcaacagaaatcctcgctaacgactggaaaatccgaattccggaaaacgagaagctttcagcggcacaaagcatgtctgacgtatttggaccggcaattgcaggtcgagaaatatatcgttttgtgcgggatgacgcgtatgaaaaactgtctgaaaaaacagcacttctgcctaatgacagactgaataactggtttggtattgccaattcgtttgaggttctcccatcccttgaagatactgatagccttcgtttccatgaaatgaaacgtatcgcaacatcccacatgcttgatttagtaactcaaagtgagcaaaccgaacaaatcgaacgatacaacaaccagcgcgttcgcctgttcgtcaccacgcataagaatgtgaatcgatttgagagcgatatcatgcagcctgtgcaggttggcctgcacgaaggcagctatcgtttcccctgggcgttccacgatgacgaaggcgagaatatctccgaccgtaatccgcgctattgcgagctgactacccaatactgggcttggaagaatgtggatgccgattattacggtttctgccactatcgccgctattttgatttctctgacactctccacaaagagaacccatatggcgaaatcatggatgattacatcgatgccaaagctgcgaaagagtatggacttgacgatacaaacattgagcgagtagttcgccaatacgacgtcatcaccactccattcggtgatctcacgaagattatcgacaagcatggtactcctcgcgcattgtgggaagccgctcccctgctgcacgatgatgatatgctccgctgttatcggattctatgcaagatgtatccggattacaaagaggatgccgattctttcttcacgggcaacaaggcatgcttctgcaatatgttcattatgaagaaggagatcttcttcgactattgctcttggatgttcccgattcttgaggagttcgataagaacaccagctatagtgcctacagcaaggaagcgttgcgtactccgggacacctttccgaacgcctgctgaacatctatttgatgcatcataagcgcatcggttccaattggaagttcaaggagcttcagtgtgttcactttaccaatccggaacccgctgaagagctgaagcctcttgatatgtttaacaagccgatcgttccagtcgtgtttgccgcggatgataattatgttccacagctcaccaccacggtttattcggccatgaagaatgctgatccgacatatttctatgatgttgtggttctacaacgaaacatcgcttgggataagcaggaacgactgcgtgacttcttcaagcagttcccgaacatgtcattgcgattcaccaatgtggagcgtgagctgtctggatacgatctttccacgaataatgctcatatcagcatcgaaacctactatcgattcctgatccagaagctattgccgttctacgacaaggtgctgtatttggattcggatatcgtcatcaatggcgatatttccaagttgtacaacaccgacttgcaaggcaagctgctcggtgcgattcgagatatcgacttccttgccaacctcaacgtcaagcatggcaagcgcatggggtatgccaagaatgtgctgaagatgaagaatccttacgattacttccaagctggcgttctcgtgctcaacaccaaggccatgcgcgagcgctacaccatcaagcagtggcttacgtatgcgtctaaccctgcgttcatctataacgaccaagatgtgcttaacgcacactgtgagggagaagtactgtatttgccgtgggagtggaatgtggttcacgattgcggcggacgtgtcggcaatctgtttgtgcaggctccgaacgacatttatgacgcctacatgaagtcacgcaacaatccgaagatcatccattacgctggttttcaaaaaccatggaccgatccagattgcgatttcgcctccatctattggaaatacgcacgtgaaaccccgttctatgagcgtctgctcaagcgcgtggtgaaggcgaacgaaccgaaaatccctgaagaggcgcttcgtccaaagcacgaacgcgccgttggagaggataaccctattcgcaagattgtcgatccactcatgccaataggttcccgccgtcgtgccatggcgaaggccatcggtcgcgcggttcgaggaagggaataatcgcattgaaacagaccacaaaaagttttagaattaccgaacataactttgcttatctcgtccccattcttctgggtacgttgtttggcatgtgttcttttattggccagcatgagggcaaaatcgacactcgaaatgcgctgttttatgtgaacactctcttttatattgccctgttcacattactgtttttcgctgcgacaaaaatagttccgcgcataaatcaccataacgaatcactgaataaaccgttcggagcgttccgcaaactcacattggactggtctcctcgatccattatcacattatggtgtctcgtgacggcattctggattccgtattttgtagcttatttcccgggcgtctactggtacgacacttcttggcaactgatggaatattatgacccttcagtgccgttcaccgatcatcatcccttcatgatgacgtatttgtatgtcggattcgcacatattggcaaagcattgttcaataacgctacttatggattgtacctgctagtgctcgtgcagtcgttactgtccacattggccatcgcttgtacagtctgttatacaggcaaatacaacataccttggaaatgccgtttctttattgctgtatttcttacctttttccccatcatccccatgatgtcgatgtctcttgcgaaagatactttcaatacgccatttttcgtattcttctctatcgcattctgtgaactttggagaacacaggggacaattttaaaatccgtttcatttgatgttttctttatcgcagacgcattggccgtatccttaacaaaaaaaacaggcatgtatatcattgtcctggctctgcttcttttggcatgcttcgttgtcaaacattggtcctataaaatagctactattgttttaggtggtgttccttatttagttgttggtataatcgtgccaacttttatcttgccagcattgcacattgcaccaggagaaagtaacgagattcttgctgtgcccatgcaacaagtcgccaatgtggtgcataaccataaggatgatttgagtgtagccgaaatcgacgaaatccaacaaatttaccatatggatattggtcaactccaagatgcttactgctggtataaagctgatccgataaaaggacaggaattatcttctaaagatgaacatgccttaatcacgacgtggacgaaacaactggttaagcatcccggcgacatgatagcaggatggggcgggctctccgtcgcatggttctcattcaatgtcgcatcaggagaagaacaagacctcagcatgatgcgtccaatcaataattccaaacatcattatcaaaacatcgaacaatacatgccttggacagataatactaaagccggtaatgcgattggacaattctacgcagacacattatcagcgacgcctatactcaatatcatatggcaaaaagccttttgggctacaatacttccttttgccatcatgtttctcatactgagatccaagaagaacaaacttaatctgttgatgcttaatctgccaatgttcatcacaatgcttgttctatttgctggaccgatttccacgcacacggaggcaacacgctatgtgttgcctatgctgtatatcattccactgtttctatcacttacgctgaagcatttgcctgaagaatcctaaatcgtctctccggacgtgagtcctacgctgactcacttcgatagtagggctcgtttcacctttgagatgcaccacttgccgacatatacggcaatgccagtaagcagatagaccgcaatggccttaatgaatgggtggtattgcccaaacgtcaggatgcgctcgaaaggcccaccaagcgtaaggttcaccagcagtaggtggaacatatatacaccgagcgagacgctggacactttgcgaattatcgacttcattctgtcagatccacgctgaagggatggctccagcgctttgcagagcatgaacagtgataccgcggatatcacacataacggagaggaaatgccgacaagataattctggtattccatccccatcgaattctggaagaaaccgttccaccataaaccgccgaggaacatcaacgtcacagatccgaggaaagttgcggcccatgcaggcgcattccaatgcaacggcaagccgtagttttctaaataatatcccagcaggaaatacagcagggcactggaagcaaatagcggccagctcaacaatgggctgaaatatttctcgttaattccaatggcttttgctgcaggaatcaggattgaacagaacaacgtcagcgcaatggcatattccaacaaacgacggtcatggacgatttttgaaagcaatggagtcaataagtacaaataaatgatggaatacaggaaccaataaatatcgatgatggagttggtgaggaatctcttgcaaaaatcgacaggaccgaaaccatcggcgattgattgcgctccataaaacaggccggggagcaaaccgaacaataaatagcaagcgatgctgcccagaatcaacgcacgtcccactcgtacgaatcgtttttgaaaaaacactttcgtagaatatttcttccggtaatccaaaagattcattccgctgaccatgaagaaaataggcacggcgaaaataaacatcgcctgcatgagctcttggaatgcccatagaaaagtatgttgcagagagaacacacctaaagacgtatgcagacataccacggcaaagcaggaaacaatgttcagcacgtccacaaatacatagtgagtaccgtgacagctgctttcccgcctgtcgacagagccttgccacatatctgtttgtctcgccgtcactgatcgtcctttccttctccaacttgcacgcccttagcatatcaacgctaaagtatctccgacagaagcggaaactcatccgcaggcgtccgctctcatatctaatctggaaaacacagcatctttatctacgaatcagaagtccgagacatgaaaaacaagtttggaaaccgctatactcgcgccatagcaacgttccactttcataaatttgttcagatgtttagaagaactttctcattgacactgtcattcattctgttttcctgcgtacgctcaggaaagcaagaaaacaccacaagaaaacggaaacaccgcccttcctttaccgagctgtgtaatggacagcatggttctgcaacagaacaaaaccaccaccttaagcggctcagctcagaaatcctcatcggggaaaacaatttccgttactttgcgagaaggaaacataaatacgccagttcttcaacaatcgataaagcaggaaaattttcaatcaagttgcctagaatcaaagggtcacttgcccaatacaccatggaatttgccatagctaccaccgtgatgaaaacacggtatatgatgtatgcgtgggcgaactttttatagccgctggccaatcgaacatggagatcaactataacgattatttcaaaagcgattcggcattcaagacgaacacttcgtcacgctacactcgtgataattaatgtgaatcgataaatccatttgcttcaagtatgcaacatcacctataatccattccccatgcagaccagtacaagagatatagtggagtacatgcctgagaattcgaacgtttccgttgcggtacttcttccttgctacaacgaagaagtcaccatcggcaaggtcgtgcgtgattttaaaaccgcgctgccgcaggcggacatctacgtgtacgacaacaactcctccgaccgcaccgccgagatcgcggcggcggaaggggccatcgtccgcaaggagccacgccaaggcaaaggcaacgtgatccgagccatgttcgaagacatcgacgccgatgtgtacgtcatggccgacggcgacgatacgtacccggctgacgcggcaccagccatggtcgacaagattcttgaaggctatgacatggtgattggagcccgcttgagctccacgtacttccaggagaacaagcgcccattccacaacttcggcaataggctcgtacgtggatccatcaatggactgttcggagctcacgtaaccgatatcatgactggctaccgagcgttctccttcacttttgtaaagacctacccagtgctgtcccgtggttttgaggtcgaaaccgaaatgactattcattcgctgaacaacaatctccgtctttatgagatgccgattcagtaccgtgatcgccctgaaggttccgtcagcaaacttgataccgtcggagacggcatcaaggtaatgagcaccatcttccgtatgatccgtgagtacaaaccactacctttctttggtgggcttggtctggtcattggcgttattggtctgattctttgcggcagcgtaggcatcgacttcatgcacaccggcatggtcgcacgcttccccacactcatcggtgcggtaatgcttgtcattgcaggcttgctcttgattgtcacaggaattatcctcgacgtcatagccaaaaacgatcgcaaagccttcatcgttgaggccaatcgttttgcgttgatgaagcgtcggggaaagtgatctctcaatgtcattaagaaggcttgattccagcagaatatgcgtaaccaagccttcgttttattctgctacttcacccacttttgggcctttgttccgttggaagtatacaactgcacgttagtgccgttcgctctggaaccacaattcacatccaaaaccgcattttctgcgagcgctgactggagcgtatacgagccatcggaattcttgactgctatccacttttgagcgtatgttccattggaatcgtactgttgcacgttggttccgttggcagatacgccgccattcacatccaacactttgccagagttcacactggttaacgtcacatacccgttggagtcatgcgttactttccacttctgcgcattggtaccattacctgcccaaatctgcacgtttccataatttgaacgggaagcgccgcttacatccatcttcatagacgtattaagcttcgatccgaacgtgtaggttccatccggcagatcttgcctatgcttggttgcggtttcgttcaaacgttcgcgcaacgttaacggcgcctttgcaaccagccattgctgagcaacagtgccattcggcgaataaagctgcagctgagcctgctgcacagcattaccacctggaatatcgacagccttattagcattcaccgacactagcgcaaccttgccactaccgtaatttcgcaccgtccactgctgagcaacagtattgttactcgtatattgctgcaacgccgctccattagcagtggatccgccagccacatccagcaccttgccggaattagcattgataatcttataagttccattgccaattgattcaaatcgatatttctgggcgttcgtattattacttgaataaagctgaactcgtgccccgttcgccgttgacgcactcgtcacatccgtgacaagttttttattcgcaaccgaagtgataatcatcgatactccagtagctatgttgacatcgcttgacgaaacaacaaacagctgtgaagcagtgccgttgggcgtatacagccgaatcgcagcaccattcgcagtatttccaccgctcaaatccagaacccaattaccgagagcggactgcaaataatatcccgctccggaatcacgaataaaccatcgttgagcttgagaattatttcgagaatactgttgcactatagcgttattctcagcaacaccattacgcacgtccaaagccttgccggaattcacattgacgatctcgtagctcccatcagactgcctagtaaaagtgaactgctgagccttggaaccgttaccggaatacaactgaatggcggtggaatctgcagcacttccaccaggaatatcaacactagacgcaactttggaacgaacattgatgtaataattgccattcggaatggtaactgccgtcattttgcgtacatcaatggccgcttgtaaatcattgctactcccgccattcacaaactccttattcccgaacgcattcatgtccacgttgccgctgatgccgtccaccttgccggtgctggtgtattgccatccgcgactgttggtcgggaatgagtcgaatcccatgcgagcgccgtactgcgccacccacgtggttttggcgtaaatgtcggcatgtttcagcggcccttgcaggtagctggtgtacgagtagacgccaagattcttgtatccggcggactgcagcgcgctgtaccaattgttgacgatattgttgtacacgttcgggtcggtgggcggcttgtgcccttcccacgtccacttttccaggtcgtaatacacggggtacgccagatcactcggattcacgccaaactgcttgagtttagagaccacgtcggcaccttcttctttggcgagcgccggcgtgtccgcgtaggaataccagtaaatgccgaacgggatgccaagtctcttgcattcgctgatgttacgttgcgctttcttgtcggcattgttgccttcgccgtagccgaggcggatgatcgcgccttccacgccgtcggctttcgctttggcccaatcgatgtcgccttgccatccggaaacgtcgatcacgcctttggcttgctgtacgaacaggttgttctggtagtcaaagaaagctttcgtattgttgtaggtgccccagtgcgcgccgtattcattgctttcgaatttggagagctgtacgttcgcgtcggctacagcatttttgacatcttccgcacttaccggaatgaaggattcgccgttggttttggcgagcggatccggctgctgatctttcatgccgaccaatgttggatcggtcacgatttcgccggtttcgatgttcttgacctcaccttcgggggtgacagccaggtcttccgaaaccacggtggcatcgtcggaaatctcgtcactgacgttatccggaagtttcgcattcggattgtagggcatgctatcttgcgattgctggtcgcccgtctgatcatccgactgatcgtcagactgcataacaacgccattatctgcagtaacggaaccgctttgcgcaacagcatcctcaatcgcaatatcctgcaatgcgtaagccggtgcaaccgcaacggaagcagtcaacgcaaccgcagacagcgcagtcacgatcttcacaacatgatgtggcgaaaccattcgtcagcctctcttgaatacagtcatcaaccccaaatattcggcgcaaacgccctaatcgtcaactctaactgcaacccacaaccccgtccctccccaactccaaaatcatcccaatccccacatctcacgcattacacactgataagaatcgactagctcgttaggggcaccgatatggcatcatccattcccacatctcctttccagcattctcgctgaccttcccatcacgcttcgtagagggaccatttccaggaggggagtacatggatcgtgccagtggaatcgggaagttcaatggtttctccctcgttaagcgtgagaatcaggccggaatcaacgttggtacgttgcataaccgcttgcagagagccgatttctcgcgccctggttttctcatttcccatattggcacacacttgaataagcccatacggttccgtagcaagagcatcgccgataagaaagtcaactttctcctgtttggacgtcggcatagtgtacgaagtgattgtttccgtacgcctaccggaagttcgtctctgcagttcgcagaaaatcgcagtttccagtcgttttccaatatcttgctggttggcgcgtgacaccgcgtaaaccataccctgatcgacggcatacattttcggcaccgcagtactacccggcttgagcatggtggaatgctcctcaagctgatacaccagaaatgcctgcttgaacagctcgagtaacgtattcgccttatcccaatagattttccagccgaccgctcgcaacgtttccacaagaccattggtagacagctcgcaggccgtattgcgcagcaaaaacagcgctatctgcgtggcgagagtaatgttttcacgaccaagacgctcggcaacgtcacgcgcaaccacgtcccgcacgtaaccttggagcgtttcaatacgatcagcttcaaccatacgttgcactgcagggaagccgccaatagttaggtaatcgttgtaggcagcttcaaaccgggtgacctctcgcggcgaaaacacggcatcggcaagagtgctgcccgctgtaggcgtttcgattccccgaaagtcgcagaattcacggaaagacagtggcgccatggcatgcggatgcgatcttcctcggaaattcgttgcgatttcttcgctggacagtttcgaagacgatccagtaatgactagcgtcacagcttcatgttcggctatgcgctggcagaatccctgccaattggcgcattcttgcacttcgtcaaggaagaggtagcagccatggtcacgagagtcgggatattgccgccagtattccgtaacaatatcgttgagcacggtgtcttgcattggttgcagacgatcgtcagcgaagttgaaatagaaaatatcattacgcgagacgccgttttgtaacaaatcatgaattttctggaaaagatagaacgttttgccgcaacgtcggatgccagtgatgatgtgcacagcattgaacactgccggctgcggcagctcgcgtatgatttcgatgcggcgtgacggcgcaggaatgtcaaactgcatggactcacgaaccagcatggcatacgattcacatggattatccggcaccataagttcttcctttcgccgtccgttgcgaaacacccaacaatcccagcataacacttctcaaaaattttaagaagtttccaccaacacttctcaaaatttttaagaagttaccacagacgaataaaactccagagaatacctgaatgcattaacgactacaacacgagtatgggaaatcggggaaggacgggtatcgtacgctgtatattggcatttcaggtggactctcggaacgtgattcaattgccctgaatcgggagctgtcaccggggaatacagaatagtaggcagattctggaggggttatggcacggcacggcaagaagccaagcgaggaaagtacctcgtcacacacaccgagaacacttgccggaagcgcaacgacctgcacttctgccgacagcactgacgccgctgccagcggtatcgctgttaacagctcgaccgtcagcagcgcatttgccagcgatgccgatggcaataccgggaatacgcttgtcggcaacgcttccaacgaagtcgaagcaaccgaagtcgaaaccaacgcaaccagtaccaacgcaaccagtaccaacgcaaccggagagcgcacaatcagcagcagcaacacggctgaaaccagcaaccggcaatcacacgaatccagcgaatcccgccagccgcaagacctattcgacgcggtcatagcgcaaggcatcagcgacggcgacgcttggacggaccagcgcgtaaagcacatctaccgccagatcatcatcgccgtagtcgtcgtagtcgttgttctgggcgcggtcttcggattcacaggcgtgcgcgcatcgcagcaaatgcgcgacctggccgcactcaacgactgcaaggaagccgtcacggccatgaacacctcctattccaaggcgttccagctgaaggcgaagatctccgaagcgttcaccagcttcgacgggtcctacgatctcgacaagcttgccgaactgcaccagacggaagttaccgcaccgaaaacgctgagctgcgccgccgacacttccgctaccatcagcaaagccaacgccgcaaaagccgagtacgacaagcaggccaagcagttcaagcaggctttgcagaagagcgacgaatccgcggccaccgatggcggtgacggaaccgacaatagcgctgacggaacggccggcgacgacggaacggacgaagccacagacacggagggcgatgctggagttgccggcgacgcgggcgccacggacggcaccgtcgaccaatccggcgcagccgacgcgaccgacgcaacgctagacgatcaattcctccagtaaatcaaccaatcgcaacgctgccaaccaaccagccgatcaagccggccaatcaagccaaccaggcctgtcaaccaagccggtcattagcctcaccatctttacgtttctcccaactcttccataccccttttccgcatacccaacgtttcttttgattttagaatcaaaagaaaagcaaaagagagtcacatggcagacaaaagaagaaacgttgaaattccgccattttcaagactttacggctataaaatgcagtaacaagtcaaaagaaaagcgcaagactagggaaagaccaaacgaacggaaaggcggctctcatgagctggacagcggcaaatgggcaagagatcaccgatgagatgatcgatcgttggcgtaaatcctacgaacaaggcgaatttcctgaagacgaacgaacagtgggtggcgtgattatgggacgaccaccgctctcgaccgataaaagtccggcccatgggacgccatcataaagagatgacagaaatgggcagagcctgacggatgaccatatttgtgcgcatcgcagcaagattgactaggctttaatgtgattgctccgttaaacaaacgctgcaagcgttgcattgcggacgcagaaggggagccatcttgaagaagaaacgactggcacgcgtgattattgccgcggtagtgaccgcggcaattctggtggcgatcattgttggttgtggaccgaaatggggcgacggttcagcaaacgtcaacggcagtaattccaatagcagcaacagcgcatcagataatgtctccagcaacgacaacgccgcgcaatccaacaacaattatgcgacccgcatcaccgcgaaactcccctcctactatttggagaacatggttttccaacgtgggaaaacgctggtagtcaaaggaacggccaccacttcacaacgcggaaaagttgttgacccaacgcaactgattacaacgatttcccaaggaaagaaatcagcatcagcacaagctaaaatttccaaaaatggcgatttcacctgcaccttacctaaacaaaaagcaagtcttaaaccatattcattaacgattttatacaacgaaaccactttgttgactctgaaaaacgtgtatgttggcgacgtatttattgctgccggacagtcgaatatggaattgaattattcgcaatattatgagggttcaggcaactcctacaatttcggcggaggtctgataacgaccgacgatctgccgaagcagctttccgacaacaacgtacacttcgttgcgagcgccaattcctcaaaaggtacggattttccgttacgcgacgtgaatgagcaggctggcatctggcttgaggcgaccgccgataattcgcagcatttcagttatctggcgcaacagtttgccatgcagcttcgtgccgcgcatccgaacgtgccgatcggcattattcaaaccgcatggggtggcacgccgattcgacgtcacgtgcaaggcggtgatatttatgcgaaccatattgcgcctttggaagggtttcatgtggcgggcgtgctgtggtatcagggatgcaatgattccacgaacgaggcaaccgcgctggcgtacgagtcgcagatgacgctgctgatcaaccaatatcgtgaagtgttcgatcaggatgatctgccgttcctgtatgtgcaattggcacgctggcctggctaccagtacacgcaaaacgtgcgattcgcgcagttgaacacgttgagcaatgccggattacgcaatgcttccaacgttgcaatgacggtgtcactggatacggacaagggcacttcaacgttgatacatccgcttggcaaagatattctcggcgcgcgcatggcagcgcaatatctggcgatgtcggaaggcaagaccattcccaacgggccgcttatcgcgcatgcgaagcatgcttccgatggcacgatcgtattgtcgttccagaacggcaccgcaaccggtttgcaggcggaaaagcccaattattcgaagactgcgagcgcgaccgtacccgattatgatgcgaatccggacgcgactcctttgaatggtatttccaacgttgcaacgccgacttccacgccattgcaaggttttgaaattgccgacgattccggaaagtgggtttcggcaacggcaacgattaagggtgatcagattgtgctgagtgccgccgatggaagctcgaattgcaacgcggtaactcaagtgcgttactggtggagtggaaatccggttatttccagtctgctgtataacgatctcggattgcctgcaagtccgtttattgctgttgttgagtaatacggcagattgataatcgggcattatccggctgcgacgactaatcgataaagcggactgtaattaggttagaatcaggcctgtttcatcgaacttaagtcgaaagcaatgtcgacggtcaaaatcgacgatcaatcgacgtagtgcggggcgctggacgctatgcggggcgttatggagccgctattgccgttgccgtcggtactaccgtctgcatcgaaatcttgcgatttacgaagcgagccggcagccagcgaacgtatggatcgagcggaacggccaatctgcgcctgtttttcctgagcatccgactgtattgcgggaatcgtgcccgtcacagggcgaatgcggccggtcgcagtgggaatgaagcttggcggcaacacctgcgtggtaacggcacccggcgatgacacatggtagtgggccatcgaagccagggaatcgcgggtatcgagttcacgctgcatatctagctcatcgtcgaactcagccatcgctgccctccctctcttcaagcaatctctgccggtaatctctccactggcaacggtcatcgttccgagcgtaacgcaaggtagcataccgttacgaacgaaatcagcgatatgcgcaactcccccactgtttcgcaacttttccgttgcacgtgccgcagcgagccacgccagcgagctattgaaaacccgccgttttggcataaaaaaaggcttccgaaatcatccggaagccctactggcggagaatacgagattcgaactcgtgaggctgttacaccaacacgctttccaagcgtgcgccatagaccactaggcgaattctccaattatgcaacgtctcacagtgtctatccgcgaaacgcaacttgattagaatacaacagtttcttccaaaccccaaatcggcgtgtcgcagcgtcccagatcgcccactcactggaggaatccgtacacgtgaggacttccccgcgcaccgaattctccaccctctgggacaattcacctgccaacgcacctctcagcgtcccagatcgcccactcactggaggaatcagcccgctgccaagactctcacagtccgaattcctccagtggctggaacaatcagtacgcccataggccttctacagtccgaaaacctccacccactggaggaaaacacccgcgcaccggcctccaaacgtcctgaaacctccatccactggaggaattgatacgttggtatacttcccagcatccggattctcccacccactggaggaatctgcccgcatatacacccccgaattgtccagattcttccagcgagtggagggatccggacacgagctcacgtaccgtgagcacagcagctatcgtttggacgcgaaggcacgcaggtcggcgagcatggcagtgaacatcgggcggaccggaccgaacttatcaagcagcgatcccgaaaccggagcactagccgctcccagcaacaccacgcctgcagcaagcacagacgcgccgaatcccagttgcgaagcgttcggaatcatatagccgtaaccgatcgtcacaaactgcagcagcacatacgcaagcaaatgccaacggaatttcacactccgcaacacggtcagacgaaccagcggcgagaacgcacgatgcgacacccaagcgaacactagcaaagcggccatggcaatcagcagcagaaccactgcaatcaccattgcgtagtcgcggaagtatccccattactcactgcggtaacggcggatccgccacggtcgagcgcaaacacgaaacagacgaatccgactgctaggcaaagcacatgcagcggattgatatgcgcctcttcggtaggagtgacctgatgaatcgttttaaggccgcacaccagcgaaacaaacaggaacggcagcagaatcacgaaaatccaacgccacggcatgaacgtaccgacaagaccgcccacagtcggtccgagtgccggcgccacggccaccaccatgcctccaacgcccatcagcatgccgattttgcttttcgaagactgttcaagaatgatattgaacatcaacggaagcgcgattcccgtgcccgctccctgtagtattcgcgcggtcatcagcataggaaaattcaacgtgcaagctgccatcaggcagccggtgatgcagagcacgattgcggtaaggaagatggtacgcaacttcagtttgcgcttgaaatagcttgagagcggcgtgacaagcgctaccgtaagcagatagccggtcgtcagccattgaacagtggacgtgtcgacgtggaattccgccattaatccagggaaaagcacgttggtgagggtttccgtaaggatgccaatgaaggccatgattccagttgacagaatggcaagaataagattgatggagatgttctcgtcatcttgcgttgccgtgttattgtttcgcgcaatggactgtgacatggatttgcggccgttcccggccttccctttcttggcccggctttgctgagccaccattccgttatgccgggcagtttgctggaatggcgattatttgcccagaaatacaaaaagatccttgggagcggagcgctctaccaaggatcttcatattattaagttgaatgttgtggattgggagcctcccgcgcgccgcgggaaacaagaaccaaaagacaaaaaaaggggttcccggagcgtcacgctcgacgggaacccccaacgaaagaatgcggcggcgtgctactctcccacaccctctcgagtgcagtaccatcgccgtgccaggccttagcttccgggttcggaaagggaccgggcgtctcacctgggccatgaccaccgcaaaaccaatataacgcggctcaacgcttcgcgcacgcagaacgccgcgccaatatcggagctgaccacggcatcgacgccgtcggtcgccaccccatcaagcgcacggctgaccgcacgatgatagccggcgaaatccatcacctcaccggcctcgatatactcatacttcacgcccgcggaggtcaattcctgttccaacgtgaggtagtagcgcaccgtcgggaacgtggtctttcccaaatcgaacgacccctcctcgacttcgccgcggaccgccagatcgaagaactgatcgcgcggaccgccaatcatcaccacatggcgcgcgccattgcgaatcagcatctgcgcaatcagtcgcccaccctgctcgtggtcagatccgatcgacgaaataccatttccaagcacgcgatcgaatgcgacgatcgggcggtggatggacgtccaataatcgccgggatgcgaggtgtgagcgcacatgacgatgccgtccatcatgtgcctgcgcagcatatcgacgtattggatttcgccgtccgtctcgtcggtggtggagcacagcatggtgcgcagcccctgcgcggcgagcgcatgctgcaggtgcgcggtaaacgttgcaaagaacgggtgacggatggtgggcacgatgacgccgaccagattcgtgcgatcgtggtacaggttgcgggcaagctcgttcggcacgtaattgagggcctgcatggccttacgcacgcggtcgcgcatgtcgttggatacatacccgttgccgttcaccaccagcgagacggtgctcagagacaccccggccttcttcgccacatcgcgcatgccgaccatgatcgcaccttccccgttatcactgttccatcgttgtattctcacgtgcttgccgcgcgctttccgtgcgcttctcgcgagatattacattcatttacattctctcgaacctgttcgacagtccggcgtgtatatcgcttaacggggttacccctttacttgattttcaatattgattttcgtatgctgcccacgacacggaaaacggcagcacagcacaacaaaagaaacggcgcaaagcttgcgatatccacactcactttgcgccgtcttcttgtattgatgatgacctacattgcgatcagtcggtcggcacgtcgccggactgggtgtggtcgaagaccggcttgttgtctttgtcgaaggtgtagacgccgatgttcgcggagctcggatcattgttcttattgaacggtccgataccggtctggccctggtactggatatccttgccatccttcagcagcggcttggcctggtcgaatgcaatcaccagcgtcgcatccgggctggcggccttgatggcggttgcgctcagattcctttcatgttactcagcgaccgtccgcgtaacgtgaaaattacgccggattggcgagcagcgcaatgccgaaaccggtggccacgcaaatgagaggcaccgcgacggttgctattccatagcccagagccagcgtaaaacgacgctggcgaatcaatgaaaccacttcgttgagcgccgtggagaatgttgagaaaccaccgagaaatccgacaacgaacatcatgaccgtgtccatatccaccgattgcgaatagtaggacatcatggcgatgcccgcgcatagcgaggcgacgccgttgatgacgagcgtggatagcgggaagttgcggttcgttctccgattctcgcgattccagcctcgttgaattgacacgtcgagcacgtaacgggccatggcgcccagaccgccgaacagacagatcatccacatcatcagcgcacctccccggtagccgggtcggcgataagcgaaatctccgcagtgatcggtttgggctcgaagctgggcggaagcgggttagccggctgctggatcggctgcgactgctgctggggctgctggattggttgcgactgctgaatcggctcgggcagctgccccaagtctgaagtatcctgctcgcgcagcaacggctgcgatggctgtgccagctgaggaacggccagcggaggaatctgcggaacgcggcccgtctgcatagtctggctggcggtcggcggcacggttggtgtttcgactcgcggaacctgtcccgtctgtgcaatctgctgggccgcctgcgcggcctgctgcgccgcctgcgcggcttccattgcggcctgcgcggcagaacgcgccacgtcggccactttcacatggcgtacgccctgcgtgtccgattcggcagaatcggacacggaaacagctgaaaacgcaccccgaacccgctttcgagtacttcgtgacagcagtgcctgcatcagaaccacgccggcggcggcagtgagcaaaccgcctgcaaaatttcccgcaagatagccaagcgcactggcgatatgccgctcgtgcagaccttccatcgtttccagcatcacgccggacatcgtcgaaagcccaccgagcaagccaagcccaacaccacggctgacaacctgccgcacccggcgacgcagccacgaagcggtcgccatgaattcggtcagcatcgcgaacaggaagcaggcgaccatattcgacacaaacgtgcccacaacgaacggcgtcccgctgaccgacggcagaagcatatccaacgcatgccgacagccgactccaacaaatccaccgacgaacaccacaacatacatcagtccgtcggcgagcggattgaaccgcgcctgcatacgtttcatcgatgccaggggaatcgtaggcggatccatggtgttagcggagggcgtggttgcaccagcatgcgtcacctcaacagtgtcgattgcctgcgtgatgggatgcgagtcctcacccgcagtcaccacgtctcccggcgattgttcttgcgattccattgcgctccccctgtactggccttccgcggacagcgttgttccgcccataggccgtgcaacaacgagctgggccgcggttgccgccttcctaacgcatatgagtttacacggagcgccaacgtatgcaccctggatgtccgattccgcagattcggacatccagagtccagccgaattcagccaggctcagtcaagccgggcatcacacagccgccgcatcgcaggtcgtacctcgcgctcctcctcgccactgaacagcaccaccagatagtcaccggcacgcagccgtgtatcaccgcgcggcacgatctcgctttcgccgcgacgcaggccgatgatcagacacccagacggccaacgcacgtcacgcacccgcttgccgtccgcaatcgcccccatttccaatggcagttccataatgccgctgcccacatggcttgcgattgccatctgcatgccttgcgcacgcacgtaccgctccagcaactccccatagatcggtttggtgcgcagcagatcggacaccaacagcgcgatgaaagcgacggcagcgaccggcagcatgtgcgtcaacgttccggacatctccacagccaacagaatcgacgtgatcggcgttttcacggacgcggcgagcgtgcccgtcatcacgcacaccgcaaacaccgccactgcgtcggatggcagatcaccgattcgatgcaacacttcaccgcagatgccgccggccaacgaaccgaccgcaagaatcggcatgaaaataccgccaggcgcacctgagccgaaactcgtggatgtgaacagcatcttcgccacgaacagcagacacagcattcccaagccgacgcgcgcatgttcggcggtatcaatcagattcgagccgccgccgagcacgtcgggcaaccagatgccgacaggcaacgcgatcgcaatcgcaatcatcgggcggctccatgccggcagtttgccgtacagcgtctggaagccaagcaacgagcggttcatcagcgaaccaaccaaaccggccaccaatcccaacggaatcagccacacatactcttccaacgacagctgaccgatatcaccgaaatccaaaaccggacgcagaccgaaacagtatttcgagacgaaatcggcggtcagcgatgcggcagtggcgcccatcagaatcgcaggggaaaaactccgatgcaccccttccaaagcgaacatcatgccggacagcggcgcgctgaacgcggcggacaagcctgccgcggcaccggcggtgaccagataatgctcctgcatgtcctcacggcggtggccgcgcaaacggtgggacacacactgcgctcccgacgcaccaatctgaatggacggcccctcacggccgagcgacagaccaaacaacgcgcccaacagtccaccgacgaaacggactggcagaatcgtctgccaacgcatcttcaagccgcatatcaccacgccgttggtctgcgggatgccgctgccaccggccatcggctccttgccgaccatccacgcgatcgccagcgcggccgccaccgcggcaaccgcccacggcgcaatcagccacggggtctcgcgaatccgcgcatatatccagcgggacgcatccgtgccgtattcgatgccgagacggtatacgacgaccagcaatcctgaaaccagaccaatgactatgccggccgccgccatcttccacttcaagtggtcgaatcgcggaatcagccggcggatatcatgtgccgcgtcgttgccagtcaagccgggaaactcgttgccgacggtcagtcgaccagcgaattgatctggatgatatggtcgcgctgcgggccggtgccgatcacggagatacggcagccggacagttcctcaagacgcttgacgtaatcctgacaggtcttcggcagatcattgaagtcgtggatttgggaaatatcctcgtcccaacccggcatggattcgtagatcggcttcgctgccgcgaattcggactgatcagtaggcatatcgtcgcggcgttcgccgttgacatcataggccacgcacaatgggatttccttcaggccggtaagcacgtcgagcttggtgagcacgatgtcggtcaggccgttgacctgagccgcataacgattgacgaccgcatcgaaccagccacaacgacgcggacggccggtggtcacgccgtactcgtggccctgggctcgcagccattcgccttcctcgccgaacagctcggtcgggaacggtccttcgcccacgcgggtcacgtacgctttggaaacgccgatcacgcgggtgatcttggtcgggccgacaccggtaccggtgcatgcgccgccggcagtcgggttggaggacgtgacaaacggatatgtgccgtgatccacgtcgagcatagtggcctggccgccttcgaacagcacggtcttgccttcgtcaagtgccttattgagcaccagcgaggtgttggccacgtacggcttcaaacgttcgccgagcttgagcagctcatccgtggtttcgttcacatcaatcggacgacgattgtacagcttcaccagcatctggttcttctgatgcaggcttgcctcaaccttgtcgtgcaaatgctcagcattgaacaggtcgtgcacgcggatgcccacgcgattaatcttgtcggcatacgcaggtccgatgccgcgaccggtggtaccgatcttgtgcttacccaggaaacgttccgtcaccttatcaagcacacgatgatacggcgcaataatgtgcgcaccctcactcaccagcagtcgggagcagtccacaccgcggctttccaagccgtcgatctcttcgaaaagcacttcaggatcaacaacaacaccgttgccgataaccggagtcgcggtcgggctgatgatgccggagggcagcaggtgcagcgcatacgattcgtcgccgaccaccacggtatggcccgcattgttgccgccgttgaagcgggcaacatagtcgaccttcgtgccgatcaggtcggtcgccttacccttgccttcgtctccccactgggcaccgatcaaaacaattccaggcatgttgttgcacctccgcgcgtatgcgatttcgcctcaaagccttaccaaggccttacaaagactatcctgcgccctctaccggatatctgccggatatgcaccgatcggccgttgaaactagtcagttccatcgttttcgtctcatacaacgcgacacacccaccgtgccgccacacgccgcatgcattacgcggcgcgtgcggcatcacactacttcaacgccttgcccgcgctgccaagctgcctgcaagcctccaccacgcgtgcggccatggcgctttccgcttcgcgcccccacgaacgcgggtcgtacatcttcttgttgcccacctcgccatcgattttgagcaccgaatcatagttggagaacatgtgaccggccaccgcacggctgaatgcgtactgcgtatcggtgtcgatgttcatcttcaccacgccgtagctcacggcctgcgcgatctcctccggcgcggagccggaaccaccgtggaacaccagggcgaacggcttaccgggagcgacatccagcgagtgcgcggggtcgggcatttcgccggccttaatcgcgagcgcgaccgtggtctggatttcgtcgagcagttcggggcgcagtttcaccacgcccggtttgtatgcgccgtgcacgttgccgaaggtgaaggcggccatgtagcgtccgcgctcgccaaggccgagtcgttgcgcgacggcgatgccttgcgcgggcgtggaatacagtttgtcgttgatttcggcgctgtgcccgtcttcttcgccgccgaccgcgccgatttcgatttccagcacggtgtgcgcggcttgggatttgtcgagcagttcttctgcgatgtcgaggttttcacccagcggcactgtggaaccgtcccacatgtgtgactggaaggtcggttcctgaccgtgcttcacctgttcggcttcatggtcgagcagggggcgcacccattcgtccagatactgtttggcgcagtggtcggtgtgcagggcgatggtgatgttggggtatttcgccgcgacttcgtgcgcgaaggctgcgaaggcaagcgagccggtgacgcggtcgttgacgcgttgcccggagaagtaggcggcgccgcctacggagacctggatgatgccatcggattccgcctcggcgaaaccttggagtgcggcgttcagggtctgtgtgctggtcacattgatcgcgggataggcgtaaccgccgcggcgtgcggcgtccagcatttgcgcataacgttccggcgttgcaatagtcatgcctccattatcgcccgaccctatcccacttatcatgtgacaacattcgccatctttcctttccgttttcccgaccgtccgctccatatccaggtcgcccgccccactagggccatatgccgagcgttttcgtctcatatcccgacatttgcgggaccgaccattaaacagggcgaaaccattgcgatcgttccatcggaagtcatagaatatccaccggatcgcgcgacgaagagcccaaccgggtattcccgcacgggcatgccgccgcacgtagatgttgcgaccaatacccgcgaggagacttgatgcaccaggttttcgccatcttccttcgagacgtgaaacgcattctgaagaacccagtggcgctcgtcgtcacgctgggtgtggccatcatcccatcactgtacgcatggtgcaacatcctcgccaactgggacccgtacgcgaacacgggcaacatccaggtcgctgtggcgaacgaggacaagggcacaacctccacgctggtcggtcatctcgacgctggccagcaaaccgtcaaccagcttaagaagaaccatcagctcggctggcgtttcgttcccgagcagcaagccatcgaaggcgtggaatccggcaaatactatgcggcgatcgtactgccggaagacttcagctccagactaatcggcaccgtcactggtaaaggcgaccgaccgtcgatcacgtactacatcaacgaaaagctgaacgcgatcgcgccgaaaatcaccgatacgggtgcgaccacgatcgacgagcagatcaacaccactttcgtttccagcgtggccgacgccgtggcgaaggaagtgaaggaggcagcgggagaaaccaccggcagcatgaaaagcgcgcaaagcgacgtcatcaacgatctgaccgacaccatcaaccagctcgaaaccgtccaacagcagctgcgcggcacgcgttccacgctcgacaaggccctcaccaccatcgattcggccaaacagtccaacatcgcgctcgcctcgggaatcaccaactcgcttgacaccgtcggcaaggcgtccgacttgctgagcgagacgcgcacacaaaccgaacgattctcgaacacgctggtcggagcgctcgacaacggcagcacgcaactgtccggtctgcaggtcaacgtgagcaatgccaccggcaccgtgctcagcggactgaacaccacgcaggacgcgctcgaccaagtgtccagcaccatgcatcacgtcaacaccaccaccggcaatgtgctcgacggcgtggagaaggcgttgcaggccagccagctggatccgaacagccaaacgtataaggatctttccgcgcaactcgccgaagcccgcaaacagctgacgttccagcagcagcgcatcgacgccttcgatcaggacaccacggctgcgatcaacgcggggaagaacaccgcgaacgggttcaacgacgatgtcaccacgctggcgaaaaacggcacggcgtcgatggcgagcgcacgcacgaccatcaccggcacggtcatgccgaatctcaacaccgggctcgatacactcagcctggccaatgggtcgctgtccggcacgcttaccacgctgcaaagcacactggaacagggcaacgggctgctcgaccagttgtcgcgcaccgtgacccaaacgaacaccaccattgctggcacgcagacgcagctcgccaatctcgccaaacagctcaacaccacgcgcaccgatgtggccgcgttgagcagttcggcgatgttccagcagctttcccaagcgctcggacttgacgcgagcgaggtcggctcgttcgtgggcgagccggtgcatttggacgaacaggtcctctacccggtcaaaaactatggttccgcggtcacgccgttctacacgaatcttgcgctatgggtcggcggattcgtgctcgtcgcgatctacaagcttgaagtggaccgcgatgagaagatccgcatgtacacgccacgccaaggctatatgggccgttggctgctgttcgtcacggtcggattcctgcaggcgatcatcgccacgatcggcgatctcgcgctgggcatccaatgcgagcatccgttcctgttcatcctcgccggcattttcgcctcgttcgtctacgtgaacatcatttacgcgctcgccgtggcgttccggcatatcggcaaggccgtcgccgtgattctggtgatcatccagattccgggcgcggcaggcctctaccccatcgagatgatgccggaattcttccgccgtctgaaaccgttcctaccgttcacctacggcatcaacgcgatgcgcgggccgatcggcggcatgtatgccaaccattattggatcgacatgctctcgctgttctggtatctgcctgtggcgctgttcatcggcttggtcgtccgcaagctggcgttgaacctcaaccgcctgttcgacaaccgtctggcggacactgatctgatgatcaccgaacataacgaaggcacggtggaaccgttgcggctcaccgagaccgcgcagcagatcgccgaggagttccccgaactcgcccgcagacgggcgattcatttcttccgcctgtacccgcgcctggtgcgctggggattcctcgcgctggcggtactgccgttcgtgtttctgctgttgctattcatcacgcgcatgaagctcgccatgctgctcggttggatcatttcgatcatcgccatcgacacgtatctcatcgtggtggagtatctgcgcgaacggtatgcgaattatctgggcgaggaagcgatgagtgcggaagagttccgcagcgcgatcctgcacgagaacctgctattccggccgggcatgcattacaagccgatgcatgccgtacgcacgaggctgtatgaggctgcgcatggtggttcggccggacatgcgcctgaacatgcggctgagtatgaggctggaaacacggacggaaatgctggcaggagtctgcgtgaggaggggaacgaacagtgaaaataatctggggcatcttcaagcgggacatgtgccacgccacccgcaacgtgatcgccgtgatcgtctcgatgggcctggtggtggtaccggcgctgtacgcctggttcaacatcgcggccagctggaacccctacggcaacaccaaggcattgaaggtcgccgtggccaataacgacaagggttacaagtcggatctcataccggtgcgcgtcaacgtgggcgaaaccatcatcagcacactgcacgccaacgaccagctggactggcaattcgtgaaaagcgacaaggcaatcgacggggtgaaatccggcgaatactatgcggcgatcgtaattccgaaaggtttcagcgccgacatgatgacgctgttctcccccgacatcaaacacgcgcagctcaagtactatctgaacgagaaaatcaacccgatcgccccgcatatcaccgatcagggcgcgacaaccgtggtcaacacaatcgacaaaaccttcgccaaaacgattgcgcaagtcggactcgacctggcctcaagcatcctacactattcgcaaagcccgcaaatggccgaatacatgcgcaacctcaacggcaatctcaccaccatggcggatacgctgagcggcgcatcgcagcaggtaacgtcgtattcgcagctgctcggctcggcgaacgacatcgtggattccacgggcaaactgctcgcctcggcgaccaaggcgggcaaacaggcccagaacgcgttgaagcaaggcaaatcaggtgccacgtcgttcacttcggcaggtgcgaacgtcacctcctcagtgaacaccgcgctcgaccaggtgtcaggcgcgttcgaccaagtagctgccaaggtgaacaaggcgttcgacgcgatcggcaaggactcagacaccgcagccagccagttgacaacgttgagcgaacaagtctccagcagcgaatcgctgtacgacacgtacatcacaagcctcaaccacatgcacgaatcggtggaacaactaccggacagtgattccgcgaaacaggcgctgctggaagccatcgaccgggagatcacgctgctggaagccgccaaaggcgattcgcagaagctcgcgcagcagctgaaagacgcttccacgcaggtcacgcaggataccgcagccgcggaacgctcccgcaaggagatcctgaaccgcatcacctccgcgaagcagtcgatcagcaatgtgcgcgacgattacgccacgaacgtcaagccgaaaatcgacgcgctcgcctccacagtcagcacgctgatctcccaaaccgacaacatgatcacccagctgagcggcaccgccgacgatctggacgatgtgacgggcgatgtggggacgaatgtgacatccatccgttccacgctcggcgcgatcgcgaagaaactcgactcgtcggcagcgacggtgaaggagctgatcacgaagctggagacgggcgggaacgccggtgacggcaacagcgatggtggagacggtgacaacgacgccagttcgtccgattcgggtgaatcggacgaactacgtgcactggccaccgccaacgcgtccacactgtccacgctgatttccgcgcccgtcgcactgcagcgcgtctcagtgtacccgatcgcgaactacggttcggccatggcgccgttctatacgatcctgtcaatctgggtgggtgcgatcatcctgtgcgccatgctgaaagtgacaatttcggaccgcgagaaggcgcatgtgctgggcttgggcgacacgctgccgcgcgtcgccggcccgtccggcccggggaacgcctcacgttggggactgcgcctcgaccacgagtatttcggacggtacgcgatcttcgcactgctcgcgttgctgcagggcacactggtttgcctgggtgacatgtatttccttggcgtgcaggcgaatcatgcgctgcagttccttgccgtggggtggcttgccgcgctcgtgttctcgaatatcgtgtatacgctgaccgtgtcgttcggcgatatcggcaaggccgtggccgtggtgctgctggtgatgcaggtcgccggttcgggcggtacgttccctatcgagacgctgccgaagttcttccaaatgctctacccgttcctaccgttcccgcacgccatcgatgccatgcacgccgcgatggccggatcgtacggcaatgagtacctgcttgacatggtgtatctcgccttgttcctgattccttcgctgctgctgggattggtgttgcgcaagccggtgatccggttgaacaactgggtgagccgcaatctggaatccaccaaggtgatgtgacgaggtggatttgaacgggctggtttaagccggtttagatcggtttcggctggcacacatggacgcgtcattggcgacgcatcaccatcaccgccaacggcaacacacaccaaataccagccgacaaaaacctaagctagcgtggatgcgtaagggcattgtcctgcccggtcacttcccttacgtaccgctgcgccatcccggcgctcctctgcgccgccactaccccacatgtcgcctcctcacacaccaacaagcgtccgattctgcagaatcggacaatcagcggcgtcgcgcaaaccacacgttgatcagcgagccgaccaccaccagcgcgacaccgatccagaatggcatgcccaacgtcacgcccaataggagcgtgctggaagcagtggagaacagcggcgtcgcatacgaaccgatcgcaagcgtttccatactgccatgtagcatgccatacccccagcacgcgtagccgccggcaatcgacgcggcacatgcgagcagcgaaatatagccgccgatgccaggcgctacagctggcaaaccgtcgcccgaaacgaaatggataatccacagcacaacagcaacgcaacagaagaaaatcgtcgtaccatcgtaaccatcggacatcgatggcgtcacggtcgcgtaaatcgcccaaataaaggcgcctgcgaacgcgagcgcgtacggcaatggattgctggcgatattggcaaccgcttcctgcacgtcaaggttttcaccgccgaccgccattgccacgccgacggtggctacgattgcacccggcagcgcttcggagaccgagccgcgtttgtgcgacacggcggcggtcatcagtaccagcagcgtcggccacaaataattgacgaggctgacttccacagattgcgcgttcgttgtggccagaccgatcgacagcgagatcgacgcctcgtatgcgatgaacatgagtccgcctgcgacgaggtacttgcgtggcgcttggttaatcggtttcggccgtcgcacgatgagcaggagcatgccgccgacagtgtagatgagcgccgagccgagcgtggcgccgaacgattcggaaacgagtcgcacgaggccggccatgaagccccacaggacgattgcgaacaggccgatgagtgtcgccgcgtgtgatatggcatgaccaaataggggggtattggggcgttcgcctgcggattcggcgggaagtttctgatccgtattcacggattccagcctacctgccgcccaccccgcatgtccgattctgcagaaacggacactatttgttggtttaccgccgcctggcctccttaaccaatggcacgatgatgaccacgacgccacacagcacaccgccgatcggccacgggacccagaacaccttcatccacgcgtcaacatcactgcccgccattccaagaaaaagcataagcaacgcgacaacagtcgctaacaacatgatcacgccacaaattgcaccggtaagtctactgtaaaatctgtccgactcgctcatcgtcgggtgcggcacggaacgtccctcgcgcacgctttcctcttcggcttcacgattgtatttgtccacattcaccttgtcatgcgtcatcccggacataatgaaacagaacgccgccgcggccacgcaagccagcagaacgctgtccggccaccccgcgtctccgtcggcaacaagctcgtcacaaaacactcgcacgcacacgcccgccaaaatcagcacggcaccaatcgcaacaccaatcgccaatacgaccgacgcacgtgacttgtcctcatccgtgtaaaaatcctgcacatacgggtggcgacggcggaaatcgccatgcatgattccggccggtatcagcaaagcgagaccgacaatcgcgccaaccaacgtgcataccgtgaccagcacgtcgttcaccggcgacggccccaagacagacccctccggcgaaaacaacatgccaaccgcgacgccgaggatgattgcggccacaccaatcgcaataagccacgcaaaacgcctcatatgactgtcgtagccaaccacatcctgcacgatatgtcggggcacgctttgcggaatgtccgtcccatctcgcgtgtccgattctggagaaacggacaattgaacaccggttttggcaccttgtgcgtccgattcaccagaatcggacattcctgcgacctgcgatgccgcaaacccgattacccccggaaccgcgccaacagcagcgtcggccaccccaaccgacgcggccacaccatccgtatcagcagccaagtccacgcgtcccgcacccccacagcccgccgacgcgcgcacgtcgcccatgaccaaatcatccaacgtcacgccgaacatgtcgcaaagcatcagcagcttatccatttcggggtatgccttctcggactcccatttcgaaattgcctgccgggaaacgcccagcagcattgccagctgttcctgcgtcatgttgcgcgaaccgcgcagatactgcagattctctttgaaactcatgtccgccctttcgtcgagtttccatatcgcctcgacttgcgattattggcgattgccaagcaacagcttgtcataagcgtcgcgttccacgccaccatctttcggttgcattgcgattcgcaaccaaattttgcgacgcaaccgacagttgcgcggcgcgaagttgacttcacgggtcttttacggcaatagaaaaacccttggaattccaacgattccaagggtttcgaatggagcggatgacgggagtcgaacccgcctctaaagcttgggaagctttcgttctaccgatgaactacatccgcaagattgtgccttttgggcacgaaacttcagtttagcacgcaacggatgcgtatgcggacacagaccgacatgcgatatcaattttccgcaatatcacggaaactcagccgcgcgaccgctgcgaatagtcacgagaatatctgccagccgagccgcccgaatcatgtccggacccatactgcgttccaaattgcggaccaccggcaccagccatcgcagaacgtccgccttgccgaatatccgccgccgcaacgccgctcgtggcataaccgccagccaaatagccggactgcacgccctgcgccttcatctcctgactcatctgcatcaaccgggcaatacgatcctcagtcgccggatgcgtggaaaacaggcgagaaaaaccttccgcagaaaacggattcgcaatcatcatcgcagcaaccgactgcgtaccagcagtcttctgcatcggcatcgtctcagcgccgttcgaaatcttattcaatgcggacgcgagcgcctccggatcttccgtaagcatggaaccatcttcgtcagcatcatattctcgcgtacgtgaaatcgccatctgaataagcgaagcggcgattggcgcaagaatcgtgctcaacagcacacccagtaatccaagaccattagaggatgagtcattgcgatcatcgcgcgaattgccaccaccgaaatacatgagcgaatatccgagatacgaaatgaccgtcgccattgcggacgcgatcgcagaagtcaggatatcgtgattgtacacgtgcataagctcgtgcccgagcacgccgcgaatctcgcgttcgttcaacatccgcagaataccctgcgtgcagcaaaccgccgcatgacgttcattgcgtcctgttgcgaacgcattgggactcatggttggggcgatataaatacgcggcatcggcttgcccgccttcgccgacagttcgcgcacgattttgtacagtaccggcgcttcctgctcgctgacttcctgcgcgcgcatggatgcgatcgcgagtttgtcggaaaaccagtaggatgcgaacgttgagccaagtccgatgagaatgtagataccaagcgtgcgctggctgccaccggtcgcccaccaaatgagcatgatgacgccccacatcaacgcgaataacagcgttgtcttcaagccattgcaatggccatgcacctgcaatttgccgttcatggtcactagcgtagaaacggagtctgagtttttgctggatatgcgctggagactgggttgcggaaaagactaggttgcggaagttcgcatgctcagcttctccccagatgtccgattccagagaaacggacatccaatgcatgccaagaggcctttgggtgaccgaatcgggagaatcggacaagtagcaagtccttcgtccacattacatgtccaattcaccagaaacagacatacagaacatgtttcggacactccagatgtccgattcaccagacacagacaagcacaggataaaaaatgcgtcttgggtgaccgattctccagaatcggacatccaagacgcatgaaagaaacctgggacctatcagatcagatcccaaacacccaccttaagcgtgagccagggcgcgcatctgctccggatcgatgaccttcttgtgctcacggccttccttcgcaccctcggcacgttcgaacgcatcgatcttcttccagccagcgaagtcgatcggcttgacaccgcgcgattccagcagccggtcgatggactccggatcacgatcggcagccacacgaccgccttcagcagccttcgacaaatcctccagcatattggtcacgatcagcagtgcgtcggacttggtggagccgatcaggccaaccggaccacgcttcgcccaaccggtcgcatacagacgctcgcgcacttcatccgtggcttcagcggccgtagtgatacgaccgtcaccgttcgcgttcgccaagtgcgcatgacgctcgtcgtacgcaatgcccggcgcggtggccggtttgtagccgatcgcatggtacacagcctgcaccggatactcttcgaattcgccggtacggctcatcttgccgtccgccgatgtctcggtcttttccacacggatgccaacgaccttgccgtcctcacccaacacttcgaccggagcggaattgaagtgcacgtaatatttgcggtcagccggattaccctcataatccacgtcaccgtcatcttccatgtcttccgccatctcacgaatcgtgaacagctcttcgaccatctgacgagtcagcttgtctttgccggcctcttcaatcgtgtcttcatccaaatcgaaatcgtcttcgttgatgatcagctgcactcccggcagcttctccatctcacgcaattcctgcacggagaacttggcctgcgccacaccgcgacggatgaacaagtgaagcacacgcgccttgttggacttgatgccctcatatacgttgtccggaatgtcggtgcgctccttcagatcatcggcattgcgcatgagctcgcgagccacgtccatggccacgttgccgccgccgatcacggcgacttcctcagcttcaagcggccattcgcgagcgccggtcggataaccgtcgtaccattccacgaacttggctgcgccgtatacgccgtccagatcggcgcccggcagtccgagcggcttgtcttcgactgcaccggtggcgaacagcacggcatcgtaacgttcgagcagttcgtcgagcgtcacgtccttgccgaattccacgtcgcagtacaggtggatgtccggattgtcgagcgtcttttcgagtgccgacgcaatgaatttgatggacggatgatcgggggccacgccgtagcgcaccaggccgaacggcaccggcagcttttcgaacaggtcgattcgggcggcagtgccgaggccgagctcctcgccgagcttcttcaactggcgcaggaaaatgtcagaggagtagacgcctgcagggccggcgccgattacagcaatacgaagttcatgagtttcagtcacgcgctctagcctaatgcattccctgcatttgcaacaggggcgctcatgtactttcttacgacttcttcgccttgtgcgcactggcgttggtgtttgcgctgaatccagatgaatccaacgtgtggctgcattaatcgtacgcgatgagcgcggcagatgcacgtacaatcgcaagtagtcgcagaatcgcgggatgtaggaatccgaaatatcggaattcgtccatcccgcaatcgcaagcaagtacttattaagtaccaggcaatcgtaagaaggtggcaatgcgcattcacatcacatataccggcggcactatcggcatgattgactcgccgaacggcctgattccgggcgccgacactcgcggatggctgttccgtctgctggaggacgcgcacatggacgcgagcctgttcacgttcaccgaacttgatcctcttatcgactcgtcgaatgcgactcccgacaattggcagacgatggtcgacgatttgcgtgcgcaccgcgatgatgccgacgcgttcgtggtgttgcatggcaccgatacgatgagctattcgagcgccgcgcttgcgtatgcgttgactgattttggcaagccggtgattttcacgggttcacagcatccgcttggcaagatcgagtcggacgccactgcgaatgtcacgggcgcgctgaatgccgcgatgagcggacgattccacggtgtgggactgttttttggacatcacctgtttgcgggcaatcgtgtgagcaagtcgtcgagctgggcatttgaaggtttttcggcgccttccgtcggcccgctggcacgcactggcacgccatggcattggtatgcgggcgattccgctgcggttggctgcggttggacgtcgcctcagccttactctcgccatgatgttgcggtgatcgatatggcacccggcatttccgcggcacggttggaagcgatgcttacgccgcggccggaagcggttttgttgcgtgcgtacggcgtcggcaatgtgccaagcgacgagcctggactgactgacgtgattgccgacgtgctgcatgatggcgttcccgttgtgattgcatcgcagtgccagcaggcggaagtactgctcggccattacgagacgggtgatgcgatcgcacgcgccggcgcaattggatctggcgatatgacgctggaagccacgtatgcgaaaatcatgttcctgctgtctcaaggcgtgaccggagccgacttcggcaagtggatgcacacatcgatcgctggagaaatctccccgagctcgctgtaaacaatcccaaaacttccgaatctgccttatacatgccttatgtatggcagattccgaagttcgtccggagctatctgcgttatgtatggcagagctgttttgagaaaccggacttagagggtgtattctcgccccctaagtcaggttttctcatatggacctgccagatataagcgaaatacttgctgacagacctccaaatctgccatatataggcgagatacggggtttcgaggcgcaatcaggctgattcgccacggtcgaaaagcacggtgagcgcccacagaatgctgacaacatcaatcgcttcctgcatgaacgcgccgacaaccacgggaatcagattgaacgcggccgcgatcatgccgataatcgcaaggccgaggccgatcagcaccgcctgcaacatcacctttttcgtgcggcgcgcgatggcgatggcccgcggaacggacgcaatgtcgtcattcatgatgaccacttgcgcagattcggaagccgcggtggacgtgccgtcggtcatggccatgccgatatcggcaaccgcaagtacgggggcgtcgttgacgccgtcaccgaccatcatggtgatttgacgattcttggattcgccggttacgcgttgcttgatgcgattccacaacgacagcttctggtgcttggattcagtggcgctcttgacggcggcaaccttgtcttcagggaacagttcggactgcacgtcgtcgataccgacttcgtttgcgatgatgcgggcggacgcagccttgtcgccggtaagcatggacagttccttgacacccaactcgtgcaggcgagccaaagaacgcttcgcattctcgcgaggtacgtcacgaagtacgatgcgggcggcaagacggccgtcaatcgccacgtatgcagccatttcgtcaggagcgagcggggcaaacagcgagtttgcggtttcaggcttgcgagcggcggattgggttgcgacggacgcggaagtagagggcgcggctgcaggctgcgcatcgttaggcaccccgttcctcactcccatagtgtccgattctggagaatcggacaagtaaacacacgttttagccctctggatgtccgtttctggtgaatcggacatccgcagcgcattctgagtctcccgtttgtccgattcggcagaatcggacacgtaatacgtcgcatccggcatatgcagcaccggcatgaatccggattcgtcagccgtcacgtatgcgaaccgccccacgcgcacctgatgcccgttcacttcgccggatatacccttgccggactcctctacaatgttcttcaccaccggatagtcgcgcccgtgccccggcaaatcgcgctcgacgcacagcctctgccccgccgcataccgcgcatacaaatcatccatagccttgcgtccggccgccgcgatgcctttcgacagaatgtgcaccgaatagccttccaccacgctggccatcatgagaatatggtcctcattgaacggcgaactcgtctcaaacggcttctctacacgtacgacctgcggctgcttgacggtgagcgtgccggttttgtcgaagaaaatatgcgatacgcgacctagattttccagcacatcctgcgctttgatcaggattcccgctttggcaagtcgcccggttccagccacatatgcgaccggcgcggcaatcaacagcggacatggcgtagcaagcaccaatacttgcgcaaatcgcagcggcaatccggaaatcgcccatgcaatcccagcaatcgcaagcgaaagcacggtaaacggcactgcaagcatatccgcggtcttcacgacagcggggcgcgactcttgcgccgacgagaccagctccaggatcttctggtattgcgaatcgtgcgcaagttgcgtggcgcgcatggtcaatgttgtggagccattgaccgcaccggacatcacgcgagcgcccgcatatacttcgcggggaacgggctcgccgttgatgttgcttaggtccaacgtggccacgcccgacagcagctcaccgtcgaccggcaccgtttcgccgggcaacaccaggatcacgtcgccgagctgtacctgatcaacggggaccgtttcgaaacgctctccagccgcatcatacgtctgcgcggcaccttttgtgtccgtttctggagattcagacgcaaaagcacgcttttcaccgtcttggttgtccgtttctccagaatcggacactctgacagtacgaaatccgtcggcggtcacgtcggccgtatgctcgctgcccgacgcgtgcacatgcccccgcatgccgggcagcacgaccacgtgcgcggttcgcggtgccgcgtcgatcagcgcggtcaggttgctttcggcctttgactgcgcgaattcctcgatcgcctcgccggacgagatcatcagcaccacggcccatgcggcccaatattcctgcactgcgaccgtcgacgcaatcgcgacgaccgccagcagatcgacgccaacatgcccgtgccgcagatcgtcgatcatgccgcgtaccgtcaccacaatcgtgtacgcaaccaacgcgatcacaatccactgcccaacgcccggattgaacgcactcaacccgtcaacgccgacttgcgaaatccacgaatcccacgcagcctcgccccacggcttccactcccccagcaatgccaacggaatcgcggacagaatggtaatcggcagtaacggaacctgtttgcacagtcgccagcaaatatcgatgattctacgcatgagaatctccttacgctcgtatcggacgccttgttaacccatcggcgcctcgcccgcgcgagccatcgatacacggcgtaaaaagatattttcagcatagcaaatatttgcgatttttgtgccgcaatacagcaataagggctgtgcgattgctcacacagcccttattgcattcttcttttggcttgctttttgttgattttcgcggttttcgttgtacttgcgatttcgtggtgccagccgcgtcttcgccgtcagcctatcgggtggcttccgtccgttcgcatgtcgcgaaacgttttagccagcccaacagtcttgacttgcgcaccgcaacaacttgcgtccgtcaattcacgcaccgcatcaacatctcgctttaccacaggccgaacgggtcgaacaggccgccaccgtcaccgtagccgttgccgtcgctctgtccatttccgttgccattgccgtcattaccgtaaccgttgccattgccgttctggctctggccatcattgccgttgttccgctggttctggctgttggcggagttcgtttgggattcctcctggtcgagtgtcacgtcaagctccatggtgttgccgtcgcgcacgaccgtcaatgtcaccttgtcgttcatggcggaggcgcgcacgtagccgagcagcgaatagttgttgttcaccgccttgccgttgaacgccacgatggagtcgccggccttcactccggccttggccgccgggctgttgtcgaccacggactgcacctgcgtgcaaccgcgggtcacgccgtccgcctcaaccgtggagctcttgatggtgacgccgagcgccacatgctgcacggtgccgttgtcgatgatctcgttagccacacgctttaccaggttcgacggaatggcgaagccgatgccgatggatccggcggtgccggaagacgttgtggtggatgcgatggatgagttgatgccaatcacctggccggccgcattgaaggtcggaccgccggaattacctgggttgacggccgcgtcaatctgcacggcgttggtgacgatgtcgttgttgttgtcatcggacacggtcaccgggcggttgagcgcggaaacgatgccgacggttgcggtgtcatcgtagccgagcggattgccgatggccatcacggattcacccacggcaagattgtcggaatcggcaaattccgcggctttcagattgctcggcggattgtcgagtttgattacggccagatcggtggtggtgtcggtgccgacgatttgcgctgagtagatggtgccgttggcgagcgtcacttgaatctgcttcgcgccggaaatcacatggttgttggtgacaatgtagcctttgtcgctgatgattgcaccggagcctttggcgctgccgtcgctggttgccacgtcaatggacaccacagaatcggacacttctttcgccaccgcgctccagtccgcggcctcgccggatttggctttcgccgaaccggatccggacgtgttggacttcacgctggtcagtgagctggaggtgggtacggtcacccatccattggtgattgccgcgtagccgacgccgaggcacaatgccgcggagacgagggccgccaccacgccggtcatcacatgcccggtcacgccggaagcggacttcggcttggttgctgcgccattctgctgcggggcaccgaacggattaccgttattcggattcccaaacgggttgccgttattgggagtattcggcgctgctggcggcacgttggctccgccttgcgcagcgggcttcatgaatggattgccgttattcgattgcgcgttctgctgatcgttctgctgatttccacccacatacggatttccgaagaaaggattgcgaggccgctgcggctgctgtccggaagcctgcccgtacgcgccatattgcggctgcgggggtatgttcggcgcaccattcgcagtatcgttcgcggctgcggtgccatcagccggctgcgtcggcacgggaccgtacgcaccatattccggtgccggacggtactgctgggccggcgcatcctgcgtggaaccgccaaccacggtacgttcgcccgccgcggaagcataatccggcgtattgcccgccgcagccgcggattccgccgaagcgccatcgttcgcaacaggcatggcggccgtcggctgatcctcaataccgccctgcacgtcaatcggttcggtagccgactctgcagcatacggctcacctgcgtaagtttgcgtctgttccgcatcaaccgacggcatcggcacggtctgttgttcgtcattctgcggctgcacggcgttctggtcgttctcttcagccattttcgctccttattcgtctcgcggcatttcacaaatcagcaatcgtgccgctcgaactgctatctatgagtaaagatactcgctctggaagtttcctgaatgtttgttgaaagtagcagccaaatacgttcaacatcaccattgaatctgaaaatcgcaccaaaatgcgatcggcaccttcatcgcactttccacatcttccttattttcatttcaccgatcgcattctttgcagcactttcaagaatcgctgctatcgcataaaatattccgcatgacaagccttaccgaatcatctaccggcacagcgcaagacacgcaaaacgcggcaaccgcagtgtccgaaaatctcatcgaacatccgcgtggagcggaaccaggcaagccgggccgccgcgacgccttctatttcgaacagaaaaaccgccttcccgacgcggcggacggtaaggggcgaggcggcgcacgatatggtcgcaccggcattattcacaccccccacggcgatattcacactccagcgttcgtgcccgtggccacgcaggccgcgatgaaagccgttctgcccgaaaccatgaaggacctcggcgcgcaatgcctgctgtccaacgcgtttcacctgtatgaacgccccggcgaacaagtgctcgacgaagccggcggccttgccaaattcatgaactggaacggtccgaccttcaccgattccggcggtttccaagtgctttcgctcggcgcaggcttcaagaaaaccctcgccatggacgtgaccggcatgaaatcagacgacgtgatcgccgaaggcaaggagcgtctcgcgttcgtggacgaggacggtgtaacgttcaaatcgccgctcaacggctcactgcaccgtttttccgccgaaatttcaatgggaatccagcataagatcggcgccgacatcatgttcgcgttcgacgagctgaccacactgatgaacacgcgcggctaccaggagcgttccgcggaacgcacctaccgttgggcgcagcgttgcgttgccgagcataagagacttaccgaagagcgcgtcggcaagccgtatcaggcgctgtatggcgtggtacagggcgcgaattatgaggatttgcgcaggcatgcggccgaacagatcgcttcgttggatttcgacggcgtcggtattggaggtgcgattgaaaagcgcattatcggcgacacttgcgcctggatttgcgatgcgatgccggaaagccgaccgcgccacgtgctcggcatcgccgcagtcgacgatattttcgcatgcgtcgagaatggtggagacacgttcgattgcgtcgcaccggcgcgttgcggccgaaatggcgcgattttcacgcgcggcggacgttacaacatcaagcgcgcgcaattcaagcatgattttggtccacttgaagagggctgcgattgctacacatgcacgcattattcgcgcgcttacgtggatcatgcgttgcgtgcccgcgaattcaacggtttcacattggcgacgatccacaacgagcatttcttcgtgaagctgctggacgatattcgcgcgtcgattgacggcggatatttcgacgaattccgcgacgaaaccctggcccgcttctacgccaacggttcccgcggatgatgcatttcacttgggccttccacccaaacgaatgctgagccatacttccgcattccaaggcgccgacgaacaaacccgtcggcgccttttcatgcatggcgagcccgcactcgccgtctcgttctcagacttgtcaccagatgtgtccgattctggagaaacggacaaccacaccacatgtttcatgccctacatgtccgattcgggcgaaacggacaaccacaatgcttatctcacgttctacttgtccgattctggagaaatggacaagtaagcaacctaaaaacactcgctggatgtccgaaacgccagaatcgggcacacagagcgtcgcgccgcttgaattttcctacggaaaatggcgggatcaaggatggctccgtcgtacggaagcccacagggcttcctccctcctcgcgtcgcgccgcttgaattttcctacggaaaatggcggcgcgacacgccgatttgaggttgcgcaggttttggtgtagattagtcgattgtctgcgagcgtggcggaatggtagacgcgctgtcttcaggtggcagtgagtgtatgctcgtgggggttcaactccccccgctcgcaccatggtgaaaggtcggagccgaaaggttccggccttttcgtttcccaagcggcagtagagctcagcggctcccgacaactccagtgactggaacaatcagaactcgtgttcgtttcggtaatggtttccccatgtcttcatcgcatcgatgatcgggcgcaggctttcgccgacttcagtcagcgagtattcgccgtggtcgtgaacgcggtcggcgcttggaccgaagagactctgccggcaatcccgaacactgccaagcatctggccgacgtgctcgccggcaccgacgtgcgcaccaataagtgtccgtttctggtgaatcggacaactaaggtatgggttttgcgttctggatgtccgattctccagaatcggacagtttatggctatggcgagcggtcagcgcacgaggaagaccatgatgatgatcatggcgaagccggtcaggtcggtgaaggtgaacgtttcgccggcccatgccactgcggtgatggtggccatgaccggttcgctggtgccgagcatggtggcacgcaccgcgccgacgcgcatcacgcctgccatgtagagccagaacgcgaggaacgtgccgcatacgatggtgtagagcagcagaagcacgcctcgcgcgtccagtgcgggaatgttcgcccacggttgcgcgaacgggcataatatgagtccggacatgaggaatgtgatgccgttgatggtcatgttgccccatttgagcatgagcacgaccggcaggatggacatggccgcggtgctcaccgcgtcaaccagtccccatgcgagcccctgccatggcaacgacagcgaggcgaagttgccgccggtggcgatgaggaacgtgcctgcgaacgccaggagcacgccgaccaattcacgcttgaggggcagtcgtttgccgcgcaggcatacccaggcgagcacgaagatcaggttgagcgtctgcaatacggtggcggttccggagttcgtccagtcgatggtcatcaggtaggagacctgcaccagaagcacgcagagcagtgtcgtgaccagatatttcggatacgatttgacgtctttgaccgctccggcgagtttctgcggtgtggtgatggccgatccgaccaggaagatcaggctggcgaatagcgcgcgtacgcaggaaagccagatcggatccagctggtagtcgcgcatcagcagtttggccacggtgctgttcataccccacatggcaccgcccagcaatgtcgtgccagtgccgatgagcaggcttttcggcgtctgttccagcacatgttccgtttttttcgtagtttttttcgcggttttttgcgattcggaagttttctgcgattgcgacgcctgtcccgacgtttgctttgccacggcctgtcctcgctctctccacggctttcacggcaaattcacggcgattgtaacgcacacggtacgcatattaaacgtcagttatgcaaaacagatttattccgccaagcttgcgttcggcgctgacaaaaaatcgaggattttgccgagatatgatccgagcacagcattcggcatggagaaaatttcgtgcaatgactggctgtatcgcactttttcgatggaaccgccgccttctcgcacacgttcgacgaagtcatcttgtggtccgttgagcacccacacgtcgcgtccggcttggaatagcaataccggagcttcgatagctccacacatgtcaggtttgagcacggctcgggaaagcgccatcgcctggtttgcccaatcgaacgtggccgcgttggtctggcacgtcacgtccgccaaacgttgcttgtggaaccagcggatgcgtgcctccgaggccccgcggtagtcgtcgagattgaggttgccgtcgaaatcggcatgcccgaacacacgcgatttgccgaagccaagcccgcagattacgccgaccacaatgcgtgcggcccacgtcggcatgccgaccaccggcgcgatcatcggcgcggacagcaccgccttgtcgaacagcgacgggtaacgttccagcgcggccgcgccgatgccgccgcccatggaatggcagtacaggtacattgggccaccatccgccgcctcacgccccacagtctgtgcaaacgtggcgaaatcggccacatatcgccgccaatcgtcaatccataccaaacttggattgctcatatcgtgcgcggaatggccatgcccgcgatgctcgaacacgcacaccgaatagccggccaacagaaagtaccacaccatttcgctgtatttgcgtccgaattcggtgaatccgtgcgaaatgacgatcgtgccacgaaatacgcccgaagcgccttcctcgcgcaacacgtcgaatgtgcgcgcgtcgtagcggtagtaatgcaaccggccggggcgctccaacttgggcaacgccttgccttcccaatcgacggtggccggttccatccaaccttccgtcatgcaagcctgcagcgcaggcagcaccgtagcgtccatttcggcgtcatagcgcgcctcgtcgatgagcgtgatagtcatggttccatcttaggcgaacggcgccaagacgaaactaagcacaggcctacgcgctgtataacgatgcgtcagtgcatcaacggcgtaccggaacaaccgaatcgtcacccccgcgcgccatcctcgcatactatggaggtatgaagttcgtttcactgctgatggtggtaacgctgtctctcaccggcacaccaacgtatgcgtacgcggcggcaactcccgttgacaacaacggtgatatctccgctgcccaagattccaactgcccaacatggctgcaatggctgtgcggaaaaggaaaatgatcgcatgatgtccacgcgggaaaagcatcccaagattcaccgcatcgcgctggtcgacaatgatccgcgagcgctggattcgctcagtgccgtcattgccagcaaagtgccgaccgcgtatgtggtgtggacggcgacttcaggctgtgaggcgatagaacgttgccaggatgcgaacggccatgtcagtttgttgattctcgatatgtcgatggagggattgcaaggccccgccacgtgttgtcggttgcgtttgatgggccagcgcatgccgattctcggtgcaaccagtttttccatcaatagttatcgggacaagctggttgaggctggtgcgcaagggttggttggtaaggagaatgccgaccagttggcgcagattattatgcgtatgtgcaatggcgaggtgatggagggatttgagccgcctgcgttggccaatctgcgtatcagcagggaggctgagaccactcccgcgcttaccgttcgtgaggagcagattatttccttgtgcgcggagggcatgcttgaccgggacatcgccgagcgtttggggatttccgaagccaccatccgcaaacatatgcaaagtattttaagaaaactcaactgcaagacctcgcgtcaggcagtggcactgtgggtgaggtccaatgcgctctaaacccgcaactcagtacattgcgtggcgcaaccgtatgcgcacgcagcatccgaacctgtggcatccaatccgtttcgccattatgctgatcgtgcttgcatggaccatatacggcgtttgctacgagcctcctaccgacatatttggcgtgatatgggttgcgatgctggttacggcgctcgtaccgtctccgctgtttctgaaaagtacatcggtggcgattctcgtgattgcctccataggcgatctgtttactccctacgcgcatttgggaaattctcttcccgcgcagctttacgcctatggcatgctcgcatacagcactaatgccattatcgtggcaacgttactcatatattacgttgttaacattctgctgattgacccccctgacccaaataccaaccccgtcgccatggtcagcatgtatgccatggtgctactgcttggtcggacgttgagttggagcgaaaaaacaacgcagaaaagcttcgaagcggcgcagaacaagaatcgtctgcaggaattggaaagccgcgcacgcattgccgatgccattcacgatgcggtgacgggcgatttgtcagcggcgtcgtttgtggcgcaacggcatatcggtggcaactctagcggccctggcgtcgctgctgaccctgccaacgcaaccacaactacggcaaccacaacagccgatgccgaagactggcgtcaaatcaacgaatatattctttccgcattgacgaacgtgcatcgcgtcatcgacgaattgaatatggacgccaccactctccccggcgacgccgacggcgaagcgttggccaatctgctgcgagcaacactggatgacggcgatcgtcgcttgcgcaagcttggcttcaatatcacgtccatccggcactgcgcgggcggcaagccgagcgcatcgcaagcaatcgccgaacttgccaataatctgctgcgcgagatctatgcgaatatcgcacgccatgccgctccgggaagcaaggtcgatctttcggtgatgctccggccgaatgccatcgaaatcacgcaaatcaatcccatgaaagaggacatggctggagctgacgagcgcgatgacgaactaccgggcggccacgggctcgcctcgttcaagaagcagctcgaatcgtatcagggcacgctcaccacgtctgcgcaggacggcagttggacgttgtttgcgtacattccggtgaccgtcatcgacgattcgcccggtttgcttgaacaagtgcaggtttgaccatagctgcggatcagggttaggacgagcccgatccaccgattccgtctttttcaagcccagatttttttggggggggtacacaaatgtggtcccccctcgcttgcgaagtcgtttcgcctgttttatgttggcattcgagaagggaacgcgttcgcccacgacgttcggatgcttggcagtccgggaatcgcaggggaacgcgttttgtcttcctacggcgctttgcagcactttcgtttgcgatgttgccgttaccgttactgcactgtcgtcacggtgccgtcaccccaacgcttccgcaaggaaatcgcgctgcaggatcagcagattttcggcaaccgtctcgtcgttggtcatgtgcgtgatgccggtcagcggcaggaacgtgtgcttacgtccggttgccatcagcgcctggctcaggcgcaggctgtgcgcgatcgtcacattgtcgtcggcgaacccgtggatgagcatgagcgggcgatcaagctgcggcgcgtcggcgatgatgctgttgcgttcgtacacggccgagtcaaggccgagatagcgttcggtgtaatgcgtgtcgtacagcgtccagtcggtcggaggcgcgcccgcgcaggccgcggcgaacgtttccggcgcctccaacacggcgagcgcggagaggaatccgccgtacgaccagccgatcatggcgacgcggctgagatcgggttgcggaacgttggctgccgcattctcgccagccagcgcttccaacgcttccggcagcgcgcgcacggcgtcgatctggtcttcgagcgttacggatttcatggtttcgtagatggcgcggtcccattgcgggccgcgtccggtggtgccgcgtccgtcggtggtgaccacgatgtagccttggtcggcccaccattgcgcgtcccaatagaaggattgactttcgatgacctgttggaagccggggcctccgtagggtttcatgagtaccggcaggatggcttcgtgcgcgtattcactatcggatgagggcagcacgatcgccgtgtacagctcacgttcgccgagtcgggtgaagtgcacgttcggcgtgaatccgggggtttcggcatggttttcgattggtgcgaccaccattgacgccacgtccgtaccattttcgtcggttgtggcgatgttcatgcaatgctgcatttgcacggttgcgtcgtccatgccccgtccggtcaccacgcagccgttgccggcgcgagacatgctccactggccgggcgcgtaggtgaggggttcccatgtgccgtcatagcggatcgacaccacgtcgaagctgcgggcgtcatggtcggcggcattcgactgccagaggaacggcaggtcgctttcaggcaggatttcaggggtgcgctgcaccacgcacagcacgtcgtcgtcggtcacgtcgagcacttcgcgcacctgcagtccggccggagtgaagggcgtaccatcaacggtgagtcggttcgtatcgacgtccatgtcgttcatcgcgcagatcaagcgtccatccggagtgaatgcaggggtgccgtggatgaggtcgagccagtagtcgttgccgtgttcctcaagcacgcgcgtggtgccggggcgttcgccttccgcgtattcgggaatggcgatggagaaggtttcgacctcgtcgccattgtcgtcggtgaagccgttttccgcgtcatgcatggtggcgatcggctcgcctacatggatggcgagcacctgatcgtgctgctggaggcggtcttgcacaaggatgatcggatcgtggccttcacgccagcttacggcggccagatattcgtaggattcatggtcccactgcacttcgttggcgattgccccgtagcagcagttgtcgctgtcgtagccgagttccagcagggtcagccgcacgtcggcattggcggtcaacgcttgcggatagcggttggcttgcgccggattggttggattcgcggggtccgacagatgccagatcggttcgggggattcgtcgtaggtttcgaagagcacgtatttggagtcgggtgaccaccagaagccgtcgtagcggtccatttcttcgcctgcggcgaattccgccaatccgattttccattcgccgttctgcggtgccgaggcgaccaccgaaatcgcgtcgccggtttcttcatcgttagcgagatccacgtccaccagatacgtgccggtggtgtacatgatgtgccgtccgtcgggactgatgcgcgggttcagcaccggtttgagttcatcttcctctatcgtgatggctcgcgtcgcgcccgccgtaaggtcggtgaggaaaagctgcccgttgatggtgaaggtcacgcggttgccggcaccgtcgacgcaatacgagacgatgccggatccgccttcgcgcgcacgttcgcgtcgcgccttctcttccgccggaacgtcttccgcgtcggcgtcggcaagcaatacgcgcggatcggcgagcggaatctcaccgatgttgccgtcttcgtcgatcacgctcatccacagcgaggtgacggtgtcttccggaccgtcggaacgcaggaacagcgcgcgggagccgtctgcaatcacgcgcgccgaacgcggagcgccgcaggaaaatcgcaaggtacgtgcttttttacgggggaactgtcgaatcgcatctgtcatgctcccaacctatcaccatcccaattccaccttccgtgaattcgtgcatcgtggaaatcgggggcgaaggtagtcatattcgcggataaataccccctaaatgatgctggtgatggatttatgcatgaaatttttgcaattaaaggacttacgaattggcgctcggcgctctaccgcgtaggatgggtgaggatagaaagggacaagcatgagtgttctcgaccgatttgagaaaagcgtggaaggcgccgtcaacggggttttcgccaagttcgggtccaaggacctgcagcccgtcgacctttccagcgctctggaacgtgagattgacaaagaggccatgcccgtcacgcgagaccgtaccgtggcgccgaatgagtaccgtttcaagctgagcacgccggatttcaacaacatcgtcgaatggggcgcggaagcgttggccaatgagctggccgacaacctcacccagtacgcgaaggaccagcattacgcgttcgtcggtccggtcgtggtgatcttcgaagaggaccttgacctcaccaagagcaatttcaagctgacgagcgaatccgtgcaaggcaataccgtgcccgtcaccaccgacgcgcagaccgaagactgcccgatgctggaaatcggcgaacaccagtatctgctcacggaaagcaagaccatcatcggccgcggatccgactgcgatatcgtgatcgacgatccgggcatctcccgccgccacatgcagatcgacatcaccgacaacggcaacaccgtcatcgcacgcgatctgggctccaccaacggcatgtatgtcgaaggccatcatgtcgaggcggccacgttgctcgacggcaacacgatcaccatcggccgcacccgaatcctgtattgggcctcttcgcaggatcaggagtaaccaaccccaacctcgggagttgcctctatgctcactgaacttactttcgcgatcctcaagtacggcttcctcgtactgctctggatcttcgtggcctgtacggtgcgttcgctgtacagggatgtggaaacgctcagcccgcgcaagtcgcgggctcatcgccgtaaggagcgtcgcgcgcgcaaggccgtcgaagcgcccgcgcccgtggccgtcccggcaccagtcgtcagcgccacatcaagcgccaaacccaccttgctggtcatcatcgatggcccccttgccggcagttccgtccctttgtccggcaacaccatcacgcttggccgttccgcttcgaacaccgtggttctggacgacgaattcgtctcgtcccaccatgcgcgcgtctatacggatcccgccaccggcaagtgggccatcgaagacctgggttccaccaacggcactgtggtcaaccagcagcgtctgaacgctccgatgattctcggatcgcgcgttcccgtacgcattggcgcaaccacctttgaattgaggtgacccgtttgccgacttctcccgcttcacaaccgctgttcatgtattccaccgtcgtttccgatgtgggtaccgtacgttccaacaaccaggattccgcgttcgccggcgagcatctgatcgccatctgcgatggcatgggaggccatgcaggaggcgacaccgcctccaccatcgccatccgttcattggcgcatatcgagcaagacaacgtgcagggcgatgtccagattatcgcccacatgatggaaacctcggttatggccgcgcatgacgcgatcgttggcaaagcgaagcgcgaacgtcgtctcgcgggcatgggcaccaccgtcacgtcggtcgcattggtggccggatattgggttttggcgcatatcggcgattcccgcgcatatctgctgcatgacggccgtctgatccgcatgacgtccgaccacagctacgtgcagcatctgatcgacaccggccgcatcagcgaggccgaggcgcgcaaccatccgcagcgcaacgtcgtgatgcgcgttctgggtgatttcgatatcgattcgagtccggacatcgccatacgcaaggcacatccggccgaccgctggctgctctgctccgacggtttgtgcggcgtgcttgaggattccacattgcaggaggtgctgtccgcctgctccgatcaggaggagtgcgcgcaacagctggtttcgatggcgcttcgtgccggcagcaccgacaacgtcaccgcggtcatcgccgacgcgacgctcgcccttgacgcggacgcgttcgatctgccgcatcagacgccattggttggcggcgcggccagcgcaagccttgagccaatcgccgacatcatcaacgagccggtcgcatccgctcccgcactgcgcgagggcaagaagtcgccggccgcccgtgccgcagcactgcgcaacggcaagaatcccaacgaggacgacaatcctccggaacagcgcgtggcgcaaccgtccacggtacgcgaggagaacggcgaccgcaccaatcccgacaccggtgaaatccccgtcgtacagaaggacgacggccgcatttccgccgatccgaacgatccggaagtcgccaaagccatccgcaacgagcatatcgagcagcgcaaaacgaagcgcacgcgcacccgacgcaaccgtgtgatcgccatcatcgtcaccatcgtggtactgctgggactggcgggcggcgcgttcgcaacctaccgttggagccaaaccaagtactacatcggcgacgacaacggcgaagtggcgattttccaaggcgtgccgacaagcctgttcggcttccagctgtcgcacgccgtcaccgacacccatatgaagacgagcgaactgccgccaagctggcaggaacagcttgcgcagggcatttccttcgacacgtacggcgaggcgaaaacgcatacgcgactgatcaaaaagcagctgaagcaacagcaggacgaagccgcgcagaaggaacaagacaaggcaaacggcgaatccgacaacaaatcctctggtacgacttccgacaagtcgtcgggcaaatcagacaaatcggacgacgcttcggcaaacaagtcaggcggtgaccagtcatgatggcaacccgtctgaagcaattcggcctgctgctgttcagcatgctgatttgcggcgtcgcgttcttccagatgttcgaacgcaccaccggcggttttccgcagaattatttgtggatgctcgcttttgtcggcgcattgttcctgacttcctggggattgccgctgcgtttccagccgtatgccaaccaggcgatcatgtgttgtgtgatggtgctgactggcaccggcatcatgatgatcgcccgcatcgaccaggattcgaacacgtccgtcgcgttcaaacagttgctttggctgtcgatagcgctggttttggcgaatctgctggtgatcttcatgaaggattaccgtgtgctgaggcggttctcgtacgtcagcatggtgatcggtttggtgttgctgctgtcaccgatgcttccggtgatcggttccgaacagtatggcgcgcgcatttgggtgaagattcccggtttgggatcgttccagccaagcgagttcgcgaagctgttcctcgcgtttttcttcgcctcctacctgtatgaccaccgcgaccagctggcggtcggtggcaagaaggtgctgggcctgcagctgccgcgcatcaaggatcttgggcctatcatcgtggtgtggatcgtgtcgatgggcgtgctggtcgtgcagcatgatttgggcacgtcgttgatgttcttcgccatgttcgtgtccatgttgtacgtggccacggggcgcaccagttggattgtgattggtttcatcgcgttcgccgtgggcgcgttcgccgcggccaatattttcagccatgtcggcgcgcgcgtcgacgcctggctgcacccgttcgactcggcgcagtacaacaaggagtacggcggatcctaccagctcgtcacgggtattttcggcctggcatcaggcggcttgatgggcaccggccttgggcaaggtcacccgtcgctcactccgatcgccaactccgactacatctacgcggcacttggcgaagagctgggcctcaccggtctgatggccattctgatgctctatctgctcatcatcgccgccgggatgatcactgcgatgaaaatcaaggatgggttcggcaagcttctcgcatcgggcctcgtgttcaccatggccttccaggtgttcaccgtggtgggaggcatcacgttagtcatcccacttacgggtttgactcttccgtacatggccgccggcggatcctcactcatagcgaattacatgttggcagcactcctagtggtgatttccaactcggcgaacaaacccgaatccgatatcgatagcgacacgttccaatatgaggcgatgcaggcgctgcgcgcccgcaagcagagccgcgcccgcagaagcgtggcctccgcgcaatcgcaggcctccacgcaggcctccacacaggcctccgcgcaggccactgaaatcatctccacggagacgccggtttcaggcacgccagtcgtaccacccgctcccccatcgggcactccgaacgtatcggacagcatgtcagaggggagccaagcatgaataagtcactccgccaactcttcaccatcgtggtggcgctgttcgtcatcctgggcatgtccaccaccatcatcacggcgattcgcgcgaaccagctcaacaacgacccgcgcaacacccgcgccctctaccacgagtatggcgctccgcgcggtgcgatcctcgcttcggacggctccgtcatcgccaaatccgacccttcgaacgacgcgttctcctaccagcgttcctataccgccggcgaactgtacgcgccggtcaccggcttcttctcgatcagccaacgcggctggaacggtatcgaagcgtcgcgtagctcgctgctgtcgggccaatccgaccagctggtatggcagcggttcaaatcgctgttcaccggccaggaaaacaagggcgcgaccatcgaaacgtccattgatccgaaaatccagcaggccgcctacaacggtcttgccaacaatgacggcgcggccgtggccatcgaagtgaaaaccggtcgtattctcgccatggcaagcacgccaagctacgacccgaaccagctggcgagccacgacacgtccgaagcgaacggcaattattccacgctttcgcaagacgagtcgaatccgatgctcaaccgtgccacctcgcagctgtatcctccgggatccacgttcaaaacggtggtggcggcggccgcgctggaaactggcgaataccagaccgacaccgagattccggccggatcgagctacacgcttccgggcacggtcacacagttgacgaacgcggtgtcgcaggccgacggttcggacggcaagatcacgttggaagacgcgatggcgtattcgtcgaacaccgcgttcgcccagctgggcgtggctttaggcgatgacaaggtgtcgtccatggccaagaagcttggtttcgacagtccgatcacggttgacggatccgattccacgggcacgccgtggatgagcgtggcgtcgaagttcccgaccgacacgaccgacgacaagctcgctttggcgtccatcggccaaggagacaccgtggtgactccgctgcagaacgcgctggtggcggccaccgtggcgaacgggggcaaggtcatgcagccgacgctggtggatcgcgtgcgttcctccgacctgtctgttatttcgcagaccaagccgcaggtgatgagccgcgcgttcagttcgggcaccgccaacaagctcacgcagatgatggaggcggtggtcaccaaggagaacccgaatctggccatcgacggcgtgcaggtgaatgcgaaaaccggcaccgcgcagatcggtgacggcaatacgtccatcgacggctgggtggtcggcttcgccccggcggacgatccgaagatcgctgttgccgtggtggtgcacaatgtggatttgtatggctcgttcgcggcgggtccgattatgaaggcgatgatgcaggaggcgctggcagagtgcaactgattgaaggacagctcatccaccgacgctacaggttggatgcccgtctggcccagggtggcatgggcgaagtatggaaaggctatgatatccagttgggtcgtcccgtggccattaaggcgttgcgcggcgacttgggcgtcacgcaggaggccaagctgcttcgcctgcgtgcggaagcgcataattccgccaatcttgcacacccgaatatcgctgcgttgttcgaatattacgaacatgacggcatcggcttcctcgttatggagtacgtgcccagcaagtcgctggccgacctgttccacgagcagaacggcccgatggagccgacccgtctgctgccgattctcatccagaccgcgcgtggcctgttcgtcgcgcattcgcatggcgtgatccaccgcgacgtgaagcctgcgaacatcatggtgtccgattccggcgaggtgaaaatcaccgatttcggcgtctcctactccaccaatcaggagcagatcacgcaggacggcatggtggtgggcaccgcacagtacatttccccggagcaggcgcagggccagcatgccacgcctcaatccgatatctattcgcttggcatcgtcgcctacgagggcctgtgcgggcatcgtccgttcacgggtgccacgccagtcgacatcgccgcagcacatgtcaacaatccggttccgccgctgccagactccgtcgacgtgcagctgcgtgaattcgtcatgtcgatgctgtccaaagacccgcttgaccgtccgaaggacgcgttgacggtgtcgcgcacgttgtcccgcatcgaacgccgtctgctcgaccagcagacacaattggctgacacgatggtggtgcctacaggcggaagacttccgcgacgcgtggtcagcagacctcatatctccttgagcactgatgggaaggaacagggatgaacatcaacatgcctacctctttggctggtggacgttaccagctcggccaactggtcggccgtggcggcatggccgaagtgcacgtggcgctcgatacgcgccttgggcgtaccgtcgcggtcaagatcatgcgcgccgacttcgccaacgacaagatcttccttgagcgtttccgtcgcgaagcccattccgtggcgcagatgaacaatccgaatatcgtgaacatctacgattcgggcgaagaggtcgtcgccacggaaaccggccagaccgaacatctgccgtatctggtgatggaatatgtcaagggccagaccttgcgcgacattctcaaagtgaatggcgctctgagccagcgcgacgccgaacaggtgatgatgggcgtgctcaacgcgcttgagtattcgcatcgcatgggcatcatccaccgcgacatcaagcccggcaacatcatgatttccgagcagggcgtggtcaaggtcatggacttcggcatcgcccgcgcgctcgacgattccgccgccacgatgacgcagtcgcagggtgtggtcggcaccgcgcaatacctgtctcccgagcaggcgcgcggcgaaagcgtcgacatgcgttccgacctgtattccgcaggctgcgtgctgtatgaaatgcttaccggaaggccgccgtttaccggcgattccgcggttgcgatcgcctaccagcatgtttcggaggtcgccactcccccaagttcggtcgttcccggcttgccgaagatgtgggattcgatttgcgcgaaagcgatggcgaaggatcgtcagaaccgttacgccacggcttccgagttcaagaacgatttgctgacgttcatgaacggcggcgtgccgatggcggccgcgttcaatccgttgaccgatctgaccaatatgaaggcacgcaagcaggccgaaatggacgcgaacaccgtggccatgactcctgccggtgaaaccgccgcgacgcaggcgttcaatcccgttacgggccagttcgaggccgtgccgaacccacagaacggcgtatccacaaaaacccgcgcggaacagcgtgccgaggccgctaaggcgcgtaagaagaagcagatcatcatcggctccgtggtgggcggtctggtggcgctgctggtcattctgggtgtgttcttcatgctgaacaagagcgactccaccgccgacatggtggaagttcctgatttcaccgccacggcgaatatttccgaggcgcgtgtcgaagagcagctcgcggccaagggtctgaagctcgatgcccgagaggattccgattcgagcgagccgaagggcaccatcaccaagcagaatccgacgggcggcaagaaggtcgccaagggctccacggtttccgtatggttctccaccggccctcagtcagtcgccgttccggatgtgtcgaacaagagccaggatgacgcgaaatccattcttgaggccgccggcttcaaggtgggtaacgtgcgcacggtcgacaatgcctccatcgaaaaagacaaggtggtaagcacggatcctgccgccaattcgaagcagactaagggcacgatcatcacgctgtacatttcgtccggcatgaccaagattcccgataatctgatcggacagccgaaagacacggttatcgagcagctgaagcaggccggtctgacgcagatcaccatcgaaagcgaatattccgattccatcgcttccggcgccgtcacccgcgtcgagccgggtgttggaagcacggtcgaggccggtaccgcggtcacgatttgggtgtctaccggcaagcagcagatcagcgtgcccagcgtggtcggcatgggctatgcgaacgccaagagcctgttggaaagctacggtttccaggtcacggtttccggcccggaggatggcacggtcacaggcatgtcaccgatcgccggcacccagtccgacagcggagccacgatcacgttgaccacgaagtcgtccagcaccaataatggcggcaacaacggcggcaacggcaacaacggcggcaacaacggcggcaacggcaacaacggcggcaacaccgacggaggcaacaacactcccgaaggcaactgatcggtcgagataaccgccatcattcacaaggaaggcccagctgaaatgccagctgggccttcctcattacggtcttatgttcttttgcgattcgtgttttcttacgattttgtattttcttgcgattgagattgcgcgacttacgtttccacgcttgtaccatgcgttttcgcacttcccacgtcttcttgctgcgaccttaggccgcgaccttgggctgcaatcccttggaacgttccacggcgttctcctggccgcacaccttcagccagttcgcaagcagacggtagccgtcctgcgtcatcacggattcggggtggaactgcaccgcatacatcggcttgctgcaatgcttgatgccctgcacgatgtggtcgacctgcgtccacgcggtcaccaccagctcttccggcacggaatcgggctccacggccagcgaatggtagcgagtggcggtcatcggattggcgacgccttcgaagatctcatcgtcgatatgctccaccaagctggttttgccgtgcatgatggtcggcgcgtggcttacggtcgcgccgaacacttcggccagcgcctgcatgccgaggcacacgccgaacatgggcttggactgctccgcgcacaggcgaatcatgccttcgctggcaccggaatcggccggagcgcccgggccgggagaaataagcacgccgtcgtattcgtcgatcacatcggcttcgcccggatcgatcgcatcgttgcgcaccaccgtcaccgcggcacccaacgtcttcaaatagccgacaatcgtgtaaacgaacgaatcgtagttgtccacgaccaaaatgcgtgcggaatcggtcatcatgctcctatcaacgtcggaatgtcggcgttcgaatgcttcgaatacttacgttgcgcgaatatttgcgtttgcatagcagtgtacgtgcgcaacatgtcgtgacgcggcgcgcgtctcacgcagcaatcgtgataatcgcagatcgcagcaatcgcagcaatcgctttcacgtctgccagcaaaactgccagcagaccgccggaaggcacctgaatacagctttatatggccgtgtaattcgacatttcctgcaatgccggaatattcgtcgcagcccacgggaacagccattcaaagcacgatgcggccgccgcgaaaatcagcaacgccatgagcacaagtcgaatcggaagcacacccggctgcaatcgcatcaatccgccgtacaagctgaattccggcttttcgcggcgtcctgcgcgcacgtcggcgagatacggccaacgccatgccaccagcgcggaaaggaagatgatcgcatatgcggcgagcgcgccgagaatccacggtttgagtgagctgacggatgcgacgatcgacgatttttcgttgttgacgaatttgactttgccgttggagtcggtggaggcgagctcctgggggatgccgtcggacaccttcgcccagtatgagaattccgcgtagctgatccagcggtgtgttggcgtggagtatttcggttcgcatgtggtcatggtcagcatgcgtttggttggcgtcgcgccggggttttcggggttggcggcgaccacttcgatgtcggtcggcagcacgattttgtagctggtgtagtggtagacgtaccagtaatcctgcgtgcgcacgatgatcgggtcgccttcctgcagtttgtcgacgtcgccgagtggctgtccgtagccgttgcggtgccctgcgaaggcgaaattgccgacttggccaggcatttgcgaatccttgtagtggccgagtccatgcttgttgagttcggtgagagaggtgccttcaacgaggttgcgctgccattggctgccgaatcgcggaatgtagacctgggcgatgagctcgccttcctgtgcgctttgcggttgcgttggcgggtcgccttcctgcgcttgtgcaatggtgacgctgtcggattgtccggggtcggaccatgatacggattggcgtgtttcgatttggttgtgttcggcctgcacgcccgtccaccacatttgccatgcgatgtagagcgcgcagacggccgccgcggtcagcatgagttcggcgaggatgccaagtatcgtccagaccacgcttttgcgacgctgttttggtgccacgtgcttcatcggttacttcccctcttgcgattcctgcgtttcgtccgtttgctgcgatccgtctgtttcgttgttcatcgcctgcgcgtattgcagcggctgttgcaatgcgtcggtcgcgtcgaaatggagtttttctttttcgtcgacctgccatcccaagccgaacgtgctgacgtactgccggtatatggtcacttcctgcgaattgtcgagcgcctttttcattgtctcgaccgggccgatcgcggaaatggtgaatggcggcgaatactttttgccctgcaaaagcagcacgttgccggaacagcgcactgcggaattgaacagcacacgctggtccatgatcatcatggattccgcgccgcccgcccaaagcgcgttcaccacggcttcgacgtcttgctggtgcaccacgtaatcgttgatgttggaggtggagccgctggaatcgaccatgttttcccagagtggtgaatcgtcgagcgtcaccacgagtccggggccttccaccgcgggcagcatggtgccgttgccggcgctttcgctgtcttgctggtcggcgtcgtcctggctgttcagggttttgctcagatcgttcacgcgggagctgagcgcgtcgacttccgtctgcagggagttgacttttttcacgcgttgttccacgagttcggcggtgtcgttggtcaccacgacggaacggttcacgcgcaggttcgtggcgagcaggaatccggagaacatgagcacaaggaatgccgccactccggccgctttcgaccgtttcgcggtgtgcttgccggtgtgcttcgccatgcggaccttcctgattcccattaagcatttgctctgattatgaacagttttgcgctgtgagttcgccgctttcgagtctacccactattatgacttttagcctattaaaggagactatgctgatggctgacgaagagctgcacgaaaccaccgcggacgatcagaacgatctgcagtccacggacgacaccgctgccgttgaagagagcaacgaaaccgttcaggatgccgctgaggaaaccaccgtcgattccacttctgacgaatccgctgattccgacgacgatgacgatcacgacattccgatggatcgcgtcgaagcggtgctgaacgctaccgccgataaggactccctgagcccgcagatgcagcgcatgatgaaccgtcaggcggagaacacccgccgcgtggaggaaaccatcaagggcaccaagtccaatccacgctggttcgtgccgctgttctgcgcgctgatgatcatcggtctgatctgggcggtcgtctactacctgacttccgactacccgattccgaacatcggcgcgtggaatctggccatcgcattcgcgatcatcatgatcggattcatcatgaccatgtggtggcgctaaagcgtagtttcgcctttcctgcgatttgagggcgtctgtacaacgtgcggtcagacgcccttttcgcatgcccttttacgattatctcgcaatcttttcgtaggttttcttcgtaggtttcacgctctttcgcaaacgtacgcggtctttcgcgactgccttgccaatcccggttcgcctgtttcttttttcgattccggtttgtttttcagattttcgacgtgcgcagcagcacatgatcgcagccttgcatggtagtgccgaacagatagaccggaccaccgtcggcaagcttcaatttcttgcgtagctgcggtgcggtaagcgggaagttacgtaccgcgatattggcctgtttcgtgccattcagcagtcgttttatatcctttttattcatgccgccgatcgcttcaatcgcgaatcctctgccgggaaaatcggcaaccggcgttgccgacacgaaaaggtgactgcttggaccgacctgcgtcacaccgaatcgttcctccaccagatcgaagcaaccggccttcataatcgacgcattcggctcatacaagtagtttttcgcctccggcagcggtttgccgccaatgcgcaggccctgcgtatatgcggcggaatcatagtcgatccgctgattgtcgttcacgcagaacacgcgcggcgcggatggttcctcatgcatctgctgacccaataccagcaacagttccttgcattcgttgccggtggccacgatatgcacttcgcgtacggtcccgtcgaaatcggcgaccgccttgcgccaatccaacatcggcgaaagcttgaccagcgtgtactgcgatttggcgagcaacaggtcacgcaattcgaacacgttcggcgtgcaatcctcgatcgcgtaagtgcgcgatccatgctcgtcgcggcgggccggatcaaggtagatgaagtccaccggacccatctgcctgaggtattccacgccgtcgccgcacacgatgcgcgcctggtcgagtcccagtgcggccatattgtgttcggccagatcgcacagatgccgctgccgttccacataagtggcttggctgaatccgcgcgccagatacgagaagtccacgccgaacccgcccgtcagatccaccatcgcccttttcgccaccaatgtgtccgattctggcgaatcggacatccacgcgcccattttcatctcttgcgtgtccgattctggagaatcggacaactggaacgcactttttgccgtttgcatgaccgattcggcagaatcggacaactgtggctcacttttcgtggtttggttgtccgattctccagaatcggacactctggcgcgcacggttgcggccggcgcaagcagtgtttgtgcgatttctgacttgtattgggctgtgaactgcgatgagcactgttccatggaaatgtgcggagggtatacgattccctcgcaggaggcccattgtggcagttttttgcgtgcgatctgccatccggcaatctggtcgagcgccaacggcaggtcgagcccttccacacgtttggccttcaacgccagttcgcgcacgtcctcgttgcgatgcatcgccacgaattcgcgcgtctcgtcattcatgattgtcattggtgacgtacctgatttcgttgtgttgattcgtcgtcattctggggattttctggtttcacacgatgtggataagtcgtggattattgtggacgaatgtggatagcatctatatcttgtaggcagttttatggctgtccacaatatataggatggtgtttttccccatttttccactgtgcacagtcgggttatccacattttccaccgttgaaaagccggggaatccaccgttttgtgaatatccttgtggataatgcaccgagttatccccgacttacccacagctcaaccctcacttatccacacacttatccacacttgtggataagtgtgtgtctgcgattccccaaatctgtttttctccttcctgccactaggagaacatgccaagaagggggtttgtgagaagtggattgctcatattgcatgcaacgacaatcgcaataatcacggccaacatgattacgccgtacatcagcgtgcgctgctgcaggcttttgccgcgcaacgcatgcagaccggaaaccaacagccaggcgaacactcctccgatgatgaatccgccgacatgcgcctgccatgcgatgttcggcgtgatgattggcatcaggaagttgatgagcatccagatcagcatggatcgaatgtcgatgccaatgcgctggtataccaccagaattgccgcgaacaggccgaatagcgcgccggaagcgccgtatgcggatgtcagccaaccgtcttgcgagaacagtgcccagaccatcatgccggcgcttccgccgagtcctgacagcacgtataacgcgagatatggcagatgccccatcatgcgttccaatacaggcccgacgcaccacaaggtcagcatgttgaaaagaatgtgccatagggaggccggctggtgcaggaacattgacgtaatgaaggtccatgggcggtgagtcgccagcgcgggcatgaatacgcctgagccgacgaatgcgttgcagccggtcggccagacgattttcaatagtgtttcgacaatccagaccgcgacgcatatcgccatgatcgtaacggtgatcacaggatcgccgttacgccaacggtatcgcatggaacgtgcagagaagaagtctttgaacgacggggaatcgggaaacagactgaaacgttgataagccatgtttcaaccctactggaacgtgcgaatccgcgaatctgcgaaatcattgcaaatgattgcattcttgtgaatccccggcgcgtaaatccacccaatcaacacattcaaggaattaatatagtgaacagagttggcttgaacgagcaggtcagccaatgttcgccgatatttgggaaaggatccgtcatggagaacaagtcttctaacggttggaagttcttcgcactgctcttcggagctttgcttgccggtgtcgtcggtctgtatgtgtacaagcagcagaatccggattacgatccgtgggaggagccatgggagaacagctcgtctcctgtcgatcttggcctgaccaaggatgccgaggatggcgaagccgaagtcgctcccgccaccccagaagctgcctgatttctctttctttcaagccctgcgccccacgcgcagggctttttgttttgccctggaaaacgaaaagggacgattccaaaacggaatcgtcccttcgtcatcacgccctatctaacgctacgagtcatacatcacgcgataattcacgtcacatatggcccgtgcgaagcgaaagtaatgacgagcgcagtatcacaaggcgtggaaggcacaagcgtacgaaaatacgtcaagccttccacaacgcagataacgctccgtcattacttgagcggaccggtcatccagatgcgctcgaggtaatcctccatcgagcggtcggagctgaagtagcccgagttcgccacgttgatgagggccttgcggttccattcgagcggccgggcgtagagggcctcgatttccgactggatggcggtgtaggcgccgaagtcggcgagggtcatgaaccagtccttggtgagccaatcgtggacaaggtcttcgtacacggtcttgtcgccgttggagaaggtgccgtccgcgaccatgtcgatggcggctttgagacgaggatcggcctcgtagtacttcttcggatcgtagccttcggcatagagggcatccacctcgtcgacggtcatgccgaagaggaagaagttctcagcgccgacgcgctcacggatttcgacgttggcaccgtcgagggtgccgacggtcatggcgccgttgagagcgaacttcatgttgccggtaccggaggcttccttgccggcctgggagatctgctcgtcgaggtcggttgccgggatgaggtgctgtgcgagacgcacgttgtagttccacgggaagtagacgttcagcttgcccttgacatccgggtcgttgttgatgacgcgggcgacgttgttgatcagctggatggtctgcttggcgaggtagtagcccggagcggccttggcgccgaacacgatggtgcgcggcatgacatcgtcggcggcgatcctgccggacttgatgtcggcgtagcgtgcgatcacggcgaggatcttcagtgcctgacgcttgtattcgtgcagacgcttgaccatggtgttgatcatggtgttcgggtcgatgtcgaagccgtattcgcgcttggcgtagttggagaagtcaaccttgttggcctgcttgacggcggcgaacttcttgacgaattcgtcatcggctgcgagcggttcgaggcccttgagcagttcgaggtcgctcacccacttgtcggtgccgaggccttcggtgatgaggtcggacagacgcgggttggcgagcttgacgaagcggcgaggggtcacgccgttggtcacgttggtgaacttgtccggatacacgtcggagaagttcttcagggtgacgtccttgagcagctgggagtgcagctcggcaacgccgttgacgtgggagccgccgtaggtggccaggtaggccatgcgcacagagtcgccggtgtagatggccatgtccttgatggtggcttcgtcgacgcccttggccttgagctcggctgcgaactggtcctggatcttctcgatgatttcgaggtgacgcggcaggagttcgccgatgagcttggacggccacacttccagggcttccggaagcagggtgtggcaggtgtagttgaaggtcttgttggtgacggtccaggcggtgtcccaatcgtagccgtactcgtccatgaggacgcgcatgagctccggaatgccgatgaccgggtgggtgtcgttgagctggaaggtgatcttgtccgcgaaggtggtcagatccggcttgtcctgacccgggtagaagacgcggatggcgtcgtggatggaggcggacacgaagaagtactgctgctcgagacgcagtgccttgccctgcggggtggaatcttccggatacaggatcttggagatgttctcagcttcaacctgcggcttgacggcgtcaaggtactcggacttgttgaaggtgagcaggtcgaactcgtcgtagctcttggcggtccacagacgcagggtgttcacacgaccggaggcatagcccggaaccatgtagtcgaccggcaccgcacgcacggaccaagccggcttccataccttcttgccatcttcctcaacgacttcgccgccgaaggaaaccttctggtcgcggttgtaatcgatgtgtccccacggctcttcattggtcagccagtagtccggggtttcgatctgcttgccgttttcatcgaacttctgctcgaagatgccgtacttgtactgaatgccataaccgaatgccggcacgcccagcgaggcgagcgaatcgatgaagcaggcggccagacggccgaggccaccgttgccgaggcccggctcgtgctcggcgtcgacgacgtcctgcacggagaagccgagttccttgaccgcggcgtcgaactgctcggtcagaccggcgttgagcagcgcgttgcgcagctgcttgcccatcaggaattctgcggacaggtagccgactgccttggtgttgccgttgaccatgtcggactgggtcttgaaccaggaatccatgaggtggcggcgcactgcggcggacgcggcgacgtacacgtcggccggcttggcctgctcgacggtgacgccctgggtgtacttcagctgctcgcggatctcgtctgcgaactgctccgcggtgaccgcggacttcggtgcggtaatttcagtcattaatcgactccctttgacggattactctccaggaacattatgccttaccccagcgtccttgcattagcggccgcatgaacactaagtaacatcatgcatacgttctcatacatagcatactacgtaatcataaaaagatgaaatttcaagcaattacaagcaagcattcgtttgcagaaataatgcaaaccggctgcaaaaacgttgcgagcaacatgcaaacgacatgcaacaacattgcgaacgctgtcaagaatcgcaagtattttccctctcttcacacccctattcagttgtgactacgttgtctgcaacaccccatcatagtcgctcgcaaacggcaaaataacacgtatggctgttattcgagaacaagatctgcataaggggcatgacgcatttgcacaatggctgcaaacgtctcatcgcatgatcgccgacaatattcccgcaaataccgacgcggcccgcgatttccgtctggaattctctccacgattgccacgccagctgtgggcgatggcggtgcgctactcgctgcatctgctggagaaaaaagcgcccggggcgggcgtggaagttcgtgtcgcgccgtggggtgccatcaagattctcgacggaccggcatccgatccgcataatctcacaccgccggacgtgatcgaactggaaccggacgtgtggatgagactcgccacgggcatcaccagctgggctgaggagaaggaggcaggacgcatcacggccgttggcgaacgcgacgatttgagtagcttgctgccgttggtgtgacaggctgcgagaagaccgtcacaggcgcaaaaacgcatagcaaaaccgcgatgtggatacacctggcaggcatatccgcatcgcggtttcacaaagtacctgatatgccgatcagtcctgcttcttcggcttcagtgcgctgggcatcggcatcgggatgggcttgtgtggcttcggcgcggcggacttggctgccgggaactctccgctcgtggccttcgccgccgcctctgcggcccactttgcatactcgtcgaggtcatcctcggcgtcggtttgcgcggactcctgagcatcttcagaaatctcatcttcagcgtccgcatcgtgagaatattttgcttcgatatcggcgaaaggatcaaaagaacccgaaccaggctcctgggcaccgagctccttggcgagctcatcataatcggtgtcggtggtcaggtacttgagctttcgggctattttctgctgtttggctttctgacgtccgcggcccatctgaccccctgaggattactgtgctatcaattcatcaaacaagagagtaccacttgctgtgccatatttcgttgtcggctcagacttttacgataaaatcgctgattttcttaagaaaaggacacgtatgacggacgaaacccaggagcagcagatcaccgctgtcggcaatgaaatgagcgcgagcttcctcgcagcgaagaagcgttccgacgcaacgctcgccgcaatcgaacagaatccgggcaagttcaccatgctgaccggcgaccgtccgaccggacgtctgcatctcggccattattttggttcgattcgtgagcgcgtcgccatgcagaatcgcggcgtgaattcgaatatcatcatcgccgattatcaggtgatcaccgatcgtgacacgaccgcgcacatcgaagacaatgtgctcaatttggtgcttgactacatggctgccggcatcgatccggaaaagaccatgattttcacgcattccgccgttcctgcggagaaccagctgatgctgccgttcctgtcattggtgactgaggccgagctgcatcgcaatcctacggtgaagtcggaaatggaagcttccggccatgcgctgaccggcctgctgctgacttatccggtgcatcaggcatgcgacattctgttctgcaaggccaatgtggtgccgatcggcaaggataacctgccgcatgtcgagatcacgcgcaccatcgcgcgtcgtttcaacgaacgctacgccaagaagcatccggtgttccccgagccggccgcgattctgtctgaagcgccggagattccaggcttggatggccgcaagatgagcaagtcgtacggcaattccatcatgttgggcgccacagcgcaggagaccgccaagctcatcaagaagagtccgaccgattccgagcgccgcatcacgttcgatccgatcgcacgtccgcaggtttccgcactgctgacgaccgccggtttggtcaccggtcgcgatccgaaggagatcgccgaggagatcggcgattccggtgcgggcgcgctgaaggcgtatgtgatcgaatcggtgaacagcttccttgagccgcatcgcgcccgtcgcgaggaactcgccaaggatatggattacgtgcgcgacgtgctcgccgaaggcaacaagaaggccaacgccatcgccaacgaaacgttggagcaggtgcgcgacgccatgggtatgcgctactaaagctccagaaacaccataatcacgctttaaacagcgtttcagcatcgacaaaggccggattgcgtattatacaatccggcctttgttgcgtttgagtggcatgtgccacattatgtttgattagattttcgcgcgcttttcgccggaagcgatttccgctgcgaccaaatcgtcatccaccttgcggtcatcgggatcatcaagataatgatcgaactcgtgcagcacttcagcatcgggagccggagtcagcagcgacaccaccacaatgaacagcagcgagatgatgaacgccggaagcagctcgtaaatagcgaagacaccaccaagcggcttgatgaaattatgccagatcagcacggtcgcagtaccggaaagcatgcccgcaatcgcaccgaatttattggtacgacgccaatacagcgagcagagcatcagcggaccgaacgaagcgcccaaaccggcccatgcatacgaaacaacctggaaaatcgacgaattctgatcgaacgcaaccacaatgccgaaaatgaacataaccagcaatgtgatgcgcgcaaccatcatcacctgacgatcggtggccttgcgatagagcaatccgcggaaaatattctcaccgaccgcggaagcgccgataatcaggtatgacgacgacgagctcatggacgcggcgaaaatgcccgacaccacgatgccgcacatgaagctcggcagcagcgcctgcgaaaccacgatgaaaatgttctccgcagcggactgcgtgacgaactgcgtcggcatcatcgcacggccaaccaaaccgatgcacacgccgcacgccagcgacaccacacaccatgtagtggcgatgatgcgagacttcttgatctcttcggaactgcggatcgacaggaatcgcacgagcacctgcggcatgccgaaatagccaagaccccacgcaagcatggaaatcatggtgatcacgccgtattcggtaggcgcgccgaacatggcctggccagccttgacaatctgctcgccggcatcgttcagaatcggcgtggccatttgcgtgccgtcaaggaagcctggaatgcctttgaggaaggcgacggtgttgtcgacgccgccgacggatgcgacggaaccgatgaacaccactgccagcgcgaagaacatgagcaagccttggatgaagtcggtcacgaccacggaaagatagcctccgatcacggtgtaggcgaacacgatggcagcgccgatcaccatggtcaggtggtagtcccagccgaacagggtcgagaaaagtttgccgaccgtcacgaagcagctaccgacatacacacagaaaaatacgaggatgatcagcgccgcgatggtggagacgatattgcgtttgtcatggaatcgtttggagaagaagtccggaatggtgatcgcgtcacctgccaccacggagtagcggcgcaaacggcgtgcgacgagcttccagttgaggtaggtgccgagagccaggccgagggccgtccacagcgggtcggcggcaccggtgaagtaggcgacgcccggcagtcccatgagcagccagccgctcatatcggaggcttcggcgctcaatgccgtcagccatggaccaacgcctcgaccacccgcgaaatactgacgagtggaggaattggaccgcttggagtagatgaagccgatggtgagcatggccacaaaatagatgaccatcgccagcagcacccaaaaatctttggtaaccatgaattctctcttcttagattgctagccgaatttctttcgaatctctttcttcaaatctctgtcgaaacgaatttctttcgaatctcttctgaaaaaaaaatatgcgattgtcccaatgtaccggtcgaacattgcgacaatcgcatttatctcatttacgcacccaaatgccgaaacggatcaaatatcgtatctccaagacttatcggtgataacgcgagccatggctaggccgatcggcagacagataatcaccatgaacgcgcggaaagcccagtcgagggcgttcaaggtgtcgaattggccgaggtggaacatggcttgatacatgtacaaaccgggaaccatgatcacgatggacggcacggtcaggcagatgcgcgggtagccgagatgcggggcgagccagctgcgatgaaccgcagaacgccatgcggaggcaagcaggcctgcgagcagtgcgccgatgaatgcgccggcttcggcgggaacgcccatgtcaacgatttccaaacgcaaggtgtcagtaatggcgccaatggtggcggcgacaaggcacatgcgctgcggcgagttgaacatggtggagaagccccagacgccgatgaatgcgaacacgaaacgcaacaggcaattgacaaccggattgagtcccaacggctcgaatccttccggattcaaatgcacgatcgaagcgaccatccagcctgcgagcgtcgccatcaaaataatgcacaacacgtacgcaacgcgctgaatacctgacggaaaatcaattttcgccatatcaagtccacccgtaatcagcgggaatccaggaatcacaaacagcatggcaccgatgtaagccgtatcatgctgcaatgcgacgggctcgaaaataccaatcaatcgcagggtgcccgtgcaggcgagtgccgcgacggccacgcatacgaacgtcacgaagaactggttgaggtggtgggcgaacaggcggcggcgcagccagtggccaagtcccgcgccgatgaacgcgccgatcatgtcgaagggaccgccaccaagcaggaacacgaaggatgcgcaggcgcaggccgaggcgaatcccgcgaacgccggcgaatacaggggtttgcgtcgttcgatcatgtcgagtcgttcgtgggcttggcgaacggtgatgccttgcgattggtccgcttcttttccgacgtggtcgaaatgttcggcgtattgaccttttggcggcttgtgattgcgatttttgcgcgcttttttcgtggtcgattcgcttgacgtaacgttggccgtaccggcagtttcacgcttggtttcacgttcggcttcacgttcaccgcgattatgctgctcgcttgccgcttcgatatcacgcaagtgcaacggctgcgcggtggtatcggtcacttcggcgcgttccgtcaccatttcaagcgcgtcgagcacgggatcgtcagatccctcctgattctgttcggctttctgacgttcgcgaagacgcttcgacaggtcagccgacacctgcgacgcatcacgcttgtcgagatgctgcataagtccttcggacacgtcggattggctgtggtacatcgatcctttgccgaggttcacgttgaaccagtcagcgaagtgttcgagcagccaaatgcgttccgtgttgacgccggtggttggcaggtcgacgacttcggtgatacggtctttgccgtcggtgcaggaggcttcgatgtcggtgaggttcacgtcggcgcgcacgtgcacgcccagcggataggcgatgcggtgcatcatttcgcgtacgcggaagcttccggtgcccgcgccgagatcgagcatgccgacgcgtacgatcacgctggcttttgctgcgattcccgcttcagcgaccggcttgtcccaatcccgttcgatatcttccatatcgagcggaatggagtgtgtatggaatttgctgacggccgaagcgcttttttccgcgctatcgaaattcgtctcatgttcatgttcgtattgtgcgctcacaagttcaggtctaacgtgtgggctggtcggaggattttcgaaatttccgtcgatttcaccttgtggacaccactggaccacgatgcggacattttcggtatttccgtaaccaaactgtcgatttgccgcgcatacaatggtcgtgcattaccgaccgaacttagggctgtgggctcgcaacagacggccaaaacaatcgcggaggtgccgcgaaggaccgacagaccgggcaacccgatggtttggagaaggaggtctgatgacaatagaaaacgaacagatcacgcctgccgacgcagctatcgtctcgtccggcaccggcaccaaaggccccgaggagcgtgatcttcccgcttccctcaaagaggaaatggatctgtgtttgcagattcttcgcgaggtgctcggcgaattcgatgaaaagctgctggccaagttcgatgaagtgcgcgaacacgcactgaacgctagcgccgaacgcttctccggtattctgacggatacgaatccgaatcaggatgacctgcagaaggtcgtcgacatcatcgataaaacggatgtgcatgaggcacaactgctggcccgcgccttcaccacctacttccatctggccaacctatgcgaggagaactaccgtgtctccgtgctgcacagccgtgaggccgccgtagatgacacccaagccgtcgacccagtgaacgaaatgacctgcgcctaccaccagctcattaacgaaatgggtccggccaaagccaaggaactgctcgaccagctcgagttccatccggtgttcaccgcgcatccgactgaagcccgccgcaaagccgtggaaggcaaaatccgtcgcatctcccagctgctcgcaacgcacaagctgcttggcggttcagacaagaaggaaaactcccgtcgactcttcaacgagattgacgcgctgttccgcacctctccgatcgcactgaagaagccgactccggttgaggaatctgaaaccattctcgatattttcgacaatacgttgttctataccattccacaggtgtaccgtcgtttcgacgattggatcctcggagataaggctggcctcgtgccgccggtatgcccggcgttcttccacccgggaagctggatcggctccgaccgtgacggcaacccgaatgtcaccgccaaggtgagccgtcaggtggcccgcaagttcagcgaccacgtgctgggcgcgttgcaaatcgagacccgccgcgttggcaagaacctgacgatggaagctgagaccactccgccgagtgccgagctcaagagcctgtggaaccatcagaaggaaatgagcgagcgcctgaccgacaaggccgcactgatctccaccaaggagctgcaccgtgccgtcatgctggtcatggccgatcgtctgaaggccaccatcgaccgcgatgctgatctcatgtaccactcctgcgaggattacatcgccgacctgaaggtcgtgcagcgctccctcgccgaagccaacgccaaacgttccgcctacggcccgctgcaggacctcatctggcaggcagagacctttggcttccatatggtcgagatggagttccgccagcactccgtcgtgcattcccgagcgctggaagatatccgcgaacatggtctgcacggtgagcgtggcgaactgcagccgatgacccacgaggtgctcgacaccttccgcgcccttggttccatccagaagcgcaacggcatcaaggccgcccgtcgttacatcatctccttcaccaagagcgcccaaaacatcagggacgtgtacgagctgaaccgtctggcgttctcccatcccaaggatgttccaaccatcgacgtgatcccgctgttcgaacagcttgaggatctgcagaactcggtagacgtactcgaggaaatgatcaagattccggaggttcaggctcgtctgaaggccaccggcggcaagatggaagtcatgctcggctactccgactcctcgaaggacgctggcccgacctccgcaaccctggccctgcattccgcacaggaacgcatcgccaagtgggcggaatcgcatgacatcgatctgaccctgttccatggccgcggtggtgccgtcggccgcggcggcggcccggctaaccgtgccgtactcgcacagccggtcggctccgtaaagtgccgcttcaagctcactgagcagggcgaggtcatcttcgcacgctacggcaacccggcactggccatccgccacgtcgagtccgttgcggctgcaacgctgctgcagtccgctccaagcgtggagaagcgcaatacggacatgaccgccaagtacgccgacatggccaacaagctcgaggaggccgcgcataaccgcttcctcgacctgctgaacaccgacggcttcgcaccgtggttctccaccgtcacgccgctgaccgaaatcggcctgctgccgatcggctcccgtccggccaaacgtggccttggagccaagtccctcgacgatctgcgtaccattccgtggatcttctcctgggcgcaggcacgcatcaatctggccgcatggtacggcctgggcaccgcgtgcgaacagttcggcgatttgaacaccttgcgtcaagcgtatgaggaatggcctctgttctccacgttcatcgacaacatcgaaatgtcgctggccaagactgacgagcgcatcgccaagatgtacctcgccctcggcgaccgtgaggacctcaacaagaaggtcctcgacgagatggagctcacccgcaagtgggtgctcgagatcgtaggcgacaagtggcctctgcagcaccgccacgtgctcggccaggccatccgcatccgctcgccgtacgtggatgcgctgtccgccacccaggtgctcgccctcggctcgctacgcaagcgcgtggacaaggaagagctcacgcacggacagaaggagaactacacctacctgatcctgtgcaccgtgtccggtgtcgcagcaggcctgcagaacaccggctgatcttcggctgaccgcctgacaaacgcgagcggggaggttccgtgccgataaacggcgcgggcctccccgttcacgtcgcgcggccctagcctggccggcgacagcgcacaaaacaggcacgcaggccgagcgacagactcccaatcatccgacgtaacccggcgcctgtccgcgtttacccacgccgcgacaccgacagccatcgtgggcttatacaactggttcggtcagacttatattctcggcagattgagcctagtcacatttctctatttcttcctcgtcctgcttataaccccaatgacaacccttttggttacggctttccttcatgacaaactgtcttggaagaagattgttcgcatcatagcgctgtcttactgtttgaccatattgggtgtatttctgaacgagttgtgttgttgacggaagacgccgcactcgaaggtttttgttcagcgcctaacatgcagcactagcatacttatcctcaatccactcatgattcagtaacaactgcatgactcctgaaacacagacacatagcgaagccctcgtttgtaacttccacgagagagaacctttgctattttcactagaaaatcacaccctagagtgcacccctactcattttccattagaatactcttaatatcttaatcattgtcgattgagattaaattttcacatggaggaaattatgaaatccagaagagtttttttattctccacaattatctcagtttgcctatgcacagttatgaccactccagcctttgctgtaaattggtggcaggttggatggattgtcgccaataacgtcatcgaccgggtagtcaatctcgatgggcaaagttcaaatgatcaatattccacctatatggtttcaccttccattgttttcaacaatggcaccaatgggggcgaattctatatgcgccctcaagtctccagccgtgtgaccagtttcgaaatgcacgcgcatagagctaaccccgtcgattttggagccaatatagttctagccttgtccacaacctcaggcaaaagggttatcaataaaacagtagggacaaaccagtatgtctcatacaccagatcaagcagcgatggcaccggaacatgggacgctcgtttcaccgaagatgacagcgggaaaaattggcagtgttattaccgccaatattacggcaatggaagaagtcttccaacgatcatcgacgtcccaaataccgatctaatcgactacctggctaacgatggcaccacgttccgatacaacgccaacccagatcaaccaagaacaacaaaagccccaacccttgacatcaaacaacttaacaatcaattttatgacgaaaaaagtggtatatcagtcgattatcttcgcgactacaatacaggagatgatattatttttgaagatatcatagataaaattcaattcaatcccaatgaaaacaatacatcactcttctttttattagacaacgaatatattgaatggaaatttaatggaaatatcaccaacaagtacaagaaagaagacagaattaaccttcattttaaagtaattaccgtgaagcaatataaagggattacatttgagagtatcgatttcttcaaagattcaagcaacggaataaataaacaaggaccatacccttgcatctccgactacctaaaataaggagaacagtgcagtacatatatctcacagcacttgccctgctaggattatgtatgcttatttttccaaggcaactctggaaaataagcaatttcctctggactcaaaaaggagatccgagcaatctatacacatccttaatgagaataagcggtgccgcctttcttgttttagctcttattcttttcatcttctgcagactgcagtaacacctacccgatcctgtgcaccgtgtccggtgtcgcagcaggcctgcagaacaccggctgattgtagccagtttctttacagggtccccgttcgcactgccgatcggggaccctttttcatacccatatctgccttatatatggcagaatcggagccttgtcatgagccttctcgcttatatatggcagaccatcatgcgaaaaacccacttcgggggtacatttttccggtttttcaccttcgggactgccatacataagcgagatatcgctctatttcccagcgaacggtcagaccaaaacgtatgatgttggctagcctgaacaatgaggggtggagtcaatggcagacgaactgtttgtagaccagaacgaggtcgaaggtacggcaagcggcgcatggagccgcatgctggcaggcaatcgcaggtttgcggaaggcaaaccggaacatccgaatcgtggcgccgaagcacgcgcagcacttgtagacacacacgcaccggaagcggccgtactgagctgctccgacgcgcgggtaagcccggatattattttcgattccggtcttggcgacctgttcacggttcgcacggccggtcaaatcatcgacgaagccgtgcttgcatccctggaatacgcggtgaccgtgctcggcgtacgtttgctggtggtgctcggccaccagaattgcggtgcgatcaagcaagcttccaaggattacgaggcgttactgcacaaactgaccgccgatgccgaggattcgctgatggccgccgacagcattgccgacatcgacgaacgcatctgcgcttcggattcgctcatgatgcgcaccgtcggtttctcaatctggcaggcgcacgagtcggaattggaatccagcgaggatttcgaacgcgtgcacatcgcgcgcaccatcgaactcttggtggaacaatccgaagcgatccagcaggcgctggcatccgacaaactcatgatcgtcggcgcaaggtaccagctggactccggcaaagtcgaggttcttagcttctgaaacggattacaattcggaaaacggagatttgcaaaacagagatccaaaaaagaacaatccgaagctaagcaatctaagaataattgagaaaatccaagaaaatcaggagatacagacactttgacataccgccccgatagagtggaaccatgtctctaggtttgaacattctcctgattttcgtttttctgttgctcggatcggtgttcgccggcaccgaactggcgttggtcagcctgcgtggatcgcagatcgaccagatggaacaggaggatgcccgcggaaagcgcgtcgcacagatcgcgcgagatccgaacacgtttttgtcgaccgtgcagatcggcgtgacgttgagcggtttcctttccgcatcgttcggcgaatcgtcgatttcgccttatattgtgccgatcgttgaaagttggggcgtgccgacgagtgtggccgctcccctgaccaccattgtgctgacgttgatcatttcgtactgttcgatcgtgatttcggagttggtgccgaagcgtatcgccatgcaacgcaacgagcagatcgcgcgtgccgtggtacctgcgattcatgtgtttgcgaaggtgtgcaagccgattatttggctgatcggcaagaacacgaacattatcgtgcgcttgcttggtttcgacccgaacgaaaccgacagcgaagtgtccgacgaagagctgcgcgtactcgtcaacaccaatacgaacttgagcaaggacgaacgcacgattctcgacgacgtgttcgacgcgtccgaaacgattgtggccgaagtgatgcgcccgcgtgccgacgtggtttttttggatggcgatatgccgattgagaaggcggccgcatatgtgagagaaatgccgtattcccgctatccggtgaccggcaaggatttcgacgatgtgcttggtttcgtgcatgtgcgcgatctgctcgatattcgcgatcccgaggcgaagacggttgccgacgtgacgcgcgagggcatttccctgccgggcacgtcgaagctgctgccaagccttgagctgctgcgcaaacgaggcattcacctggccgtggtgatcgacgaatacggcggcaccgacggcatcgtcacgttggaagacatgaccgaggaattggtcggcgacatccgcgacgaatatgatctgccggaagagaaaggcggcgaacgcacggaacgtaccacgttcgtcaatggcgtcgccacgatcgaaggcggcatgacgattgaggatttcgccgatttgaccggtattgagctggaagacggtccgtacgagacggttgccggctatttcctggcgcatactggaaagatgggcgaaatcggcgacgtgctaccttccgacgacggttatgacatgaccgtcacgcaagtggatggccgtcgtatcgaaacgttggaaatccgcaagcatactgttgacggcgatgctgcgaaagctacgaaataatcaaaaataaaacgaaaataaaatgaaaataaaacagacttgcgattatgtaaatgctgattttttatgcaatcaacatcagtaatcgcaagtctgctctgttattaaatccgctgagttattgcagattcagccgcgcagcatgggatggcattcgtcgttccaccatgcaagctgcgcgatattggcgcggatatgctcgcaggacgcatggaatttggcccgttcgctttcggtgagtgtgggattgaggacttcttcaacgccgttcgcaccgatgatgcacggcaggctggcgtaattgccgctttcgccttgttcgccggtaagcagcgtggagcaggcggtcgcatagtgttcatcgcagagcacagcctgcgtaaggcgtgccgcagtggctgcaatagcgtattccgtgcactctttgccggcgtacacgcggtatccgcctcgacgggcgtcctgctcggtttcgtccttgtcgagggcgaatcgttgcggatcgtcttgtgcgagttgatcaagcggcttgcctgcgatgttcacgttcgaccaataggcgaactgcgaattgccatgctcccccagcatatatgcgccgattgatttctgatccacgttgacgcgtttcgcgatggcgttgcgcagtcgtgcggaatccaacgcggttcccgttccgatgattttgcgcggatcgtagccggtgatgtgccagatttcggttgcgaccacatcgcaaggatttgagatggtgatgatcacaccgtggaagcctgcgttgaacagtcgggagatccaggtgcgtgcaatgtcggtggtgacgaacagttcgccgtcacgatctttggcgctggttttcacgtcgccggcagcgttgattaccacgtcgcagtcggctagctgctcgtattgcgtgccgtagttgccgatcacgcagttatgcggatagaaacccaacgtgtcacttaaatcctgacattcgctgactactttttgctcgttgatgtcgcacagcttcagttcttcggcaagtcctgcggaaagcacggcatttgcgacatgcgcgcccacgtgtccgatgccgataatgccgacttttctcaatacagccacaatcgacccctccctcacttattcgatctttctgcgtggactgtttgcacgcaaacgtttcagtcgtcacgattgtaggcttgcaaatcgcggatgttaagcgttctgtacatcttatgaacaaaaagctatacgaatcacctatacgtcgttatcaaacgtgcgtaagccgtggctagtcattgcaatccgcgcaatgtgacggcagtggcgtgatatcgcaagtatttcaacatcacaggcaacgcaacaacatcgccctacgcaagctcatcgcagcatggcagcgtgacggcgaacgcaacagcatcgcgagcatcacaacacaacatgacggttcagctcccgccgcaattgcctccattgcggcaaatatgcgctcatacgccgctgaaagtcctctccgtgcccgttttcccacaggtgcgtcatttcgtgcacaagcacgtattccaggaatctgggatccataagaccaagttgcaggttgagtcggatgcggccggttttcggcgtgcatgacccccatcgcgacgtcatgatgcgtaacgtgacatgcgtcggcttccgcccgataatcggcgaccatttcgcaagcagcaccggcagttgcgcattgatggcccgtacggcccgttccttcgccgcgtcgttccacacgaaaacgcgcggattattcaagctattgggatcgcctggattgtttcgatcgcccacgccgcccgaattttccaggccattcagattatccggaccatgcgaaccattcacacggtccaaaccattgaaatcgctttgacggatctgttcatccttggcttgcagcatggtgcgtcgcgcacgttcgatccatggtttgcgttccgtcacaaatcgtgcgattgccgcttgcgacatgcgagaaggtgcggagatgacgatttgcgcgttcggcggtttgatgcgcaggtacatgtttttgatggctttacgcacgatggtcaccgtcattccagcgatttgcgtggtttcttcggatagcgtgcgattacggttgcgcactcccctgctggctctcccactgttgttacgctggctacgatgattgttcggcatggctgcattatgtcacgacacgccgaagacacaccttgtattgactttctctgaaattcgcgtattatttcaattcgttgtgcttaacagtgcagcaggaacgggcccgtagctcaggtggttagagcgcatccctgataaggatgaggtcggaggttcaagtcctcccgggcccacggtgattaagagcggcgcggccgctttttttcaactatggggctatagcgcagctggtagcgcatctgctttgcaagcagagggtcgccggttcgaacccggctagctccacggggctatggcgcagctggtagcgcatctccatggcatggagagggtcaggggttcgaatccccttagctccacagatagggtttccggtgatttccggaaacccttttttcatacccaaatccgaaatccaaaccagcatcccaattcctccagtcactggagaaaaccggacgcagccaggcacctcacagtccaaaaacctccaccgagtggaggaatcctcccaccaacaagcctcccagcatcccaaaacctccagtcactggaaaaaactagacgcaaccaagcacctcacagtccagatccctccagtcactggaacatatgacccgctgaggcaccttccagagtccgtattattccagcgcatggaagaatcaccccgctgaaagaccattgcaaaaggccgtctcagacgggacttgcgtcaccgcttgaaacggccttggattattgattattacgatcgcttgcgatgactaccgcactgcgactgcaccggcaacagtgtcggaatcgttcggcacgttctgtgtattccgtgcattctgcttggcaagttcgtcgcggatttgctgcaacagcaggatcgtctgctcttcggtggagatttccggctctttggcagcttcctcctcggctttgctccgttcttccgcaagcttggttttggcgagcaacgcctcggtcacgtcacggaatttgttgatcggcacgagaatgcagaaatacacggcagccgcgataatcaggaaattcaatatcgcgccaagtaccgcgccgaacgaaaccgtcgcattattgaatgtgattgccagcagaccatccatattcggtttgccgaaaatcatggcgatgaacggattaatcacattgttggcaatagagttaaccactgtggtgacggcaccgcccatgacgacaccgaccgccatgtcgatcatgttgccgcgtgcaatgaatttcttaaatccttcaatcatgatgattctcccattatgtgagatcgtgagatgttattgcggacgtactctctcccacgctttccgcatttccatcctataggcaacacaaggcacggcaatcccgtaaaaagaagcaggttcagaaccagcactcgcaaaaagcgtctccaaatcctgaacaaggtcttgtgccgtccatattcgtgcacatagaatgagaccgtctattggtaacccaactatcccgaaggggaagaatatgctcactgacgagtacgtcaagcgcgtgtacgcgcaggtcgagaagcgcgacggcgaccagccggagttcctgcaggccgttcgcgaggttttcgaaagcctcgagccggtggttgcgaagcatccggaatatgagaaggcgggcgtgcttgagcgcatcgtcgagccggagcgcgtggtgaagttccgcgtcgcatggaccgacgatgagggcaaggtgcaggtcaaccgcggttaccgcatccagttcaactccgcgatcggcccgtacaagggcggtctgcgcttccacccgagcgtgaacgaaggcgtcatcaagttcctcggcttcgagcagatcctgaagaactccctgaccagcctgccgatgggcggcggcaagggcggatccgacttcgacccgaagggcaagtccgacgccgaagtcatgcgtttctgccaggccttcatgacggaactgtgccgtcacatcggccagttcaccgacgtcccggccggtgatatcaacgtgggcggccgcgagatcggctacctgttcggccagtacaagcgcatccgcgacgagtattccggcgtgctgaccggcaagggcctcgaattcggcggctccctggctcgtaccgaagccaccggttacggcctgtgctactacaccgccgaggcaatgcgcgtgctgcgcaacgattccttcgaaggcaagaccgtggtcatctccggctccggcaacgtggccatcttcgccaccgagaaggctcaggccctcggcgcgaaggttgtgaccgcctccgattccaacggctacatctacgatccgaacggcattcagctcgacgtggtcaaggacatcaagctgggccaccgcggccgcatcaaggaatacgccgagcgtgtgccgggctccgaatatcacgagggatgcaagggcgtgtggaccgttccgtgcgatatcgccctgccgtgcgccacccagaacgagatcgacgaggaatccgccaaggctctcgtcgccaacggctgcaccgtggtgtgcgaaggcgccaacatgccttccactccggaggcaatcgccgtctaccaggccaacaacgtgctctatggccccgccaaggccgcgaacgcgggtggcgtggcggtttccggccttgagatgagccagaactcctaccgcctttcctggacttttgaagaggttgacggcaagctcaagtccatcatggagaacatcgtcgccaactctctggaagccgccaaggaatacggccacgagggtgatctgatgctcggcgccaacgctgccggcttcgtgaaggtcgccaacgccatggtcgcccagggcgtgctctgatctagccgttttagccaatctagccaatacggctggctcatcgaaatacattgagggcctgtctggtttcattccagacaggccctcttttcgtatttcaacacgtacttcagcgcacccaatctaggtgcagttacatttgaaacaatcactcaaaatcacgatagttccggttataactgaaactatctctaaaaatcgcaatagtttcagctataaccgcaacttcctctcgcgcagctccgctatctcgcttatatatggcagatttgagagttcgtacggtgatatctcgcttatatatggcagccttggtaggaaaaatgacccaaaatatacccccgaactggctttttcgcaagttgacctgccatatataagcgagatggtacaggtcggaaggcaaaatctgccatatatagggcagatatgggcagattgcaggcaggggagagtcagatagggtttggcgtacggtaagagacagactggtctagaaaatacgaagacggtctgtgtcgtgatgggaatcacgacacagaccgtcttgttgcgtttgagtttgctatcgccgctactgacggcgcactgcgctatttcagcattgcatgcgacgctcgcggacgctatcgccgctcgctgccattaatagcgcactgcgctattaatcatctccaagcgtgacgtggatgccaccgacgagggtgctcaccacgttgtacagcagcgtgaaaatcaccacgagcacggtgatcagcaccacttccacaatggagaagatggtgacggcgctcagcacagtgcccaacgagaacacgttggtcaggtcgaatccgccagcgtccaagccagtggaagacacaatctgcgtaacttggtcgaacacgccgaccacgttcagcatgccccacagcaaagccaccgcgacaatctgaatgatgcctcccgcgatggaaagcatgaacgccaccttggcggccgaccatgcatcgatacgcgtcagagacaggctcatacggcgtgcacgcggagcgccgccgcgacgcttctcacggaccttcacaccgccggaagcggaggaggcaccctcgtgcgcctgaacctgatccgcaccaatcagcggctggctggaagcggaacgtgccacgcgcggtgcctgcccaacctccggcatttgctgtccttcgatgttctcgctcatcgttgctccttgcaagattgtgcccagttcttagctgaggctaccagttttcgcagacgattgcctgtcttgtcttcatgcctctacattctcgccatcgccgttgccagcgttggcttcagtagcggcttcagacgatgccgaagcaccctcgttcacggttgcgttcgtcccagattccgcggattccgttttttccgcagattcgccagattccgcggattcgtcatccttctcctcgttgcgtgcgatggagatgatctcgtcgttcttgtccggcttggcgaacgtcacaccttgggtggtgcggccggtgcgcttgacctcgtcgacgttggaacggatgaccttgccggacttcatgatggccatgatctggtcatcttcctcaacgatcaccgcgcccacgagggagccacggccttcggcgagctgcacggccttgacgccaaagccgttacggccttgcaaacggtattcgctgatggcggtgcgcttggcgaagccctcgttggtaaccacgaacagatccttgtcggaatcgccccagaccacgtccatggccagcagctcgtcgccttcgcggaacttcatgccctgcacgcctgcggtctgacggcccatcgggcgcagctgctcgtcgttggcctggaacttcaggctcatgcccagcttcgacacaagaatgatgtcatcctcggcgttgcacagtgcggcaccgatcagctcgtcggcgttctcgccgttctcgccggtcataaggcgcactgcgatcaggccgccctgacgcggggaatcgtattcggcgagcgcggtcttcttgaccttgccggaacgggtggcgagcaccagatacttggccacttcgtagttcggaatcgacagcacggtctggatcgtctcgtccggcccgaactgcagcaggttggccacatgctgtcccttggaatcgcgcgatccctccggcagctcgtacgccttcaggcggtacacgcgtcccttgttggtgaagaacagcagccagttgtgcgtgctggtgaggaagaagtggtccaccacgtcgtcctcgcgcagcttggcgcccttgatgcccttgccgccgcgatgctgcgcacggtattcgtcggccttggtgcgcttgatgaaaccggagtgtgtaacggttacgaccacgttttcttccgcgatcagatcttcgacgttcatttcgccggagtacggcaggatcttggttcgacgttcgtcgccatacttggacacgatttcgtcaagctcgtcgcccacgatcttacgttgacgctccggcttggcgagaatgtcgttgtagtcggcgatacgacgcatcagctcgttatgttcgtcgagaatcttctggcgttccaatgcggccagtcggcgcagctgcatggccagaatggcgtcggcctgcacttcgtccacgtccagcaggtccataaggcccgtacgcgcgacttccgcagattcggacgcacgaataagcgcgatgacctcgtcgatcatgtcaagagccttcaggtagccctgcagaatgtggtcgcgctcttccgcctcacgcttgaggtaggcggtacggcgtgcgatgacttccagctggtggcccacccaatggcggatgaacgcgtccagagacagcgtacgtggcactccatcgaccagtgccagcatgttggcaccgaaggtctgctgcagctgggaatgcttgtacaggttgttgagcacaaccttcggcacggcgtcgcgcttgagcacgagcacgagacgctgtccggtacggccggaggtttcgtcacgcatgtcggcgatgccctggatcttgccgtcacgcaccgcttcgcggatggaaacgaccagtcggtccgggttcacctgatacggcagttcggtgatcacgaggcacatacggcccttgatctcttcggtgttcacaaccgcgcgcatggtgatcaaaccacggccggtacggtaggcctgttcaatgcccttatgtccgagaatcgttgcaccagtagggaagtccggtcccttgatgatgcggatcaggttttcgagcagctcttcgcggcttgcgtccgggtggtcaagcgcccaatgcacgccttcggccacttcacgcatgttgtgcggaggaatgttggtggccatacccacggcgatgccagacgaaccattgcacaacaggttcgggaatcgtgccggaagcacggtcggctcctgcgtcttgccatcgtagttcggcaggaaatcgacggtgtctttgtcgatgtcgcgcaccatttccatggcgagcggagccatacggcattcggtgtaacgcattgctgcggccggatcgtcaccgggggagccgaagttgccttggccgtcgaccagcgtgtaacgcatcgaccacgactgtgccatacgcaccaacgtgtcgtagatcgcggaatcgctgtgcggatggtatttacccatgacctcgccgaccacgcgggcgcacttggagtaaccacggtcggggcggtagccgccgtcgtacatcgcgtagatcacacggcgatgcaccggcttcatgccgtcgcgtacgtccgggagcgcacggtccacgatcacggacatggcgtatgccaggtaggaatcgcgcatttcctgctgcagatccttcttctggatgcgttcgcccaccatcaggccgtaatcggtgtcgtcggcctcctgcgggctcaacggctccatggagccatcaggcacgaactggccgtcttcgttgctgttgttttcgtctgccaacttctaagtccttctaaatccttatgaaaccttgcctgaagtccttgaaatccctacgcgtcgatccagctgacgttgcgtgcgttgcgctggatgaacagacggcgaggttcgacttcgtcgcccatgagcatggagaaggtttcgtcggctgcagccgcgtcttcgatttgcacctgcttcagaatgcggtggtcaggatccatggtggtttcccacagttcctggtagctcatttcacccagacccttgtaacgctggatgccttcgcccttcggcaactgacggccggcggccttgccttcggcgagcacgcggtcgcgttcggcgtcggtgtacacgaagtcgtgcgcgcctttggtccacttgagtcggtacagcggcggcatggccacatacacgtaaccagcggtaatcatcgggcgcatgtagcggaagaacagcgtcagattcagggttgcgatatgcgcgccgtccacatcagcatcggccatgatgatgaccttgtgatagcggactttgttcaggtcgaaatcctcgccgtaaccgccaccgaccgcggtgatcagcgattcgatggtttcggacttcatcatgcggtcaaggcttgcacgctcggtgttgaggattttgcctcgcagcggcagaatggcctgcgtgatcgggttgcgtccctgaattgcggagccgcctgcggagtcaccctccacgatgaacagttcgcattcttcaggattgttggactggcaatccttcagtttgtctggcatgcccgcggattcgaagattgacttgcggcgggtattctcacgtgccttcttggctgcaagacgcgcacgggaggcttcaatggccttctggatgatgttcttggcttcgctaggatgcgaatcgaaccagtcgccgagcttgtcggtcatcacgcgctgcacgaaggttttcgcttcggaattgccgagcttggtcttggtctggccttcgaactgcggggtggtgagcttcaccgacaccactgcggtcaggccttcgcgcacgtcgtcgccggagaggttctcatccttgtctttgaggatgttcttctcacgtgcgtaacgattgacgagcgaagtcagagccgcacggaagccttcttcgtgggtgccgccttcggtggtggagatggtgttggcgaaggtgtgcaccgcttcggagtatgcggtggtccactgcatggcgatttccgcggaaatgccgattttcagatcttccgcttcgaaatcgatcacgtccggttcgaccggggttgccttgcgggacttcaccaagtaatcgacataatccttgatgccgtcgttgtattggtaggtgaccgtctgatgcttcggttcggcattgtcgtcgctttcgcccgcgacttcgtctccggcctgatccggttcgcgcaaatcggtcagggacagtttcagccccttgttgaggaatgccatctgctggaagcggttacgcagaatctcgaaatcgtaggtggtggtttcgaagatcgcgccgtctgcccagaaggtcacggaagtgccggtggactcgtcttcgcccatcggctcgcccttggcaagacgtgcggtcggcttctggtcgatgtaggtctgggtccagtggaagccctgtcggcgcacttcgatgtcgacgcgggtcgacagcgcgttcaccacggagatgcccacgccgtgcagaccgccggaaaccgcatagccgccgccaccgaacttgccgccggcatgcagcttggtcatcacggtttccacaccggaaacgccttcgcccggcacttcgtcgaccggaatgcctcggccatcatcgaccacgcgcacgccgccgtccggcagaatcgtcacttcgatatgcgaggcatagcccgccagcgcttcgtcgacggagttgtcgacgatctcatacaccaggtggtgcaggccacgggggccggtggagccgatgtacatgcccgggcggattcgcaccgcctcaaggccttccagaaccctcagatcggacgcgtcgtaatgctccggagccaaggtgtcgtcgagctgcgcatcttcgagctgatcgttttggatctgatcttcctgcgtgttttcagctgattcgttcagcgaatccgcatcaaggtctgccacagagattccttcctgcatttttcccgccaatgagggtcattcacgcaggtgataccacctagaacgcaaataaaggccccttctaggcgtttacatacactacttgatattctactcatgcagggggacagcgcaccagaggcatttatccttgaaattcagccgtttacccctgttttttcgctttcggaaaacaacattcgaccgttgcgaacggcccgcttggaagcgtcgcagggggaattcttcgacgaagcgccttcaacgaacgtctgatagcacgtggtgtcgcgctaatatcgcggccttcgtgtcattcgtcctcggctgaatccctgttgttgcgggccggtgacgcgcacctcgttgatggtcagcccctcgagcctacggcgaatggtgtcggtcagcagcggaatcatgtacgtcaaggtggtggtccatgcggggctgtcgcatcggatcgtcagaatgccgtcgcgcaggtcgacggggtaggagtggcgcgcgttttcgacgccgaccacctgatcccaatgattctgcatctgcgcgattttcagatgcggcgtccaagaaccttgcgttgcgatcacgttgaaaatattgccgaccgtctgcgggtcgcgtccgggtttgccgaaattctcccacgcctgccgcgcacgttcctcacgttccttatatcggccggcacgtcggctgatacgttcgaatacttcggcgggcaacttgcgttggtcgagatgcaatgtttcgcagattggaggattcggcatcagcgctgctcctgtcgattcaccgactgttgcgctgcagacgattgcgttgcagattcccgtcccgcgacaagttgcgccatcatcgccgtcaaatcgtcatgctgtccatcttgcgattgcctgcgcaacgcggccacgtcgatcacatgcgcgtccgcgtgaaagcgcccagcatccatgcgcggaatatcgcttgccgcggcgacggtgatcagcacctggtcctgccgcatcgcaaaatcgaggatctgcccacgacgggcctcgtcaagctgtgcgaacacatcatcgagaatcacgattggcttgctttcaaaatgtgcggaaaccgcctcatatagcgccattttcaacgccaaagccatggtccacatctcaccgttggacgcgaattcgcgtgcgttcatatcgttgagcagcaaagtcaggtcgtcgcgatgcggaccgatcagattctgcccgcgcgccacttcgccggggtagatgcgttggaaatggcggctgatctccgcggccggatcgtcgaacagcatcacttcgtcgaaggacggctcgtaggcgagcgccgcccgttcgtcatctcccgccaaagacgcgtagatccgcgcaaaaggctcttccaagcgtgagatcacgttgttgcggtcccgcgtcagctgcatgccgaggtcgatgaattgccccgtccagatttccagcccgcttaagaccgcctgctggccgtattgcgggtcgagattcgtgccgtcgccgagttgtttgagcagtgccgtgcgctgtttcgccacgtgcgtgaactgttgcagggtctgcgcatagtgggggagcagcagagacgcggcctggttgatgaagttgcgtcgggttgcgggatcccctgctaccagacgttgatcttcgggggtaaaggagacggagggcgtgcgcccgatgagatccctcatatattgagattttccgccgtcgatgcgcgctcggttagcaccccgtgccacgatggtcgcctcgtaggtgtgctgcgtttcactgtcttccacgttggctcggatggtggccgacgtgcaccctttttcgattaatggcagtgatgatgacgcgcgatggctggatcctgtggaaagcacttcgatggcttccacgatattggttttgccgagtccgttggcaccttgcagaatgttgattcccggtttgaaatcgagcacgcaatgttcccacgatcgatagtggtcgagtgccagtcgggaaatatacatgcaagatccttgagatagtgcgaatttcttacgtaaataatcgcaattaatcatgcaaatgggctgaactggcaataacagccatgttcagccctattttttgcgatgtatccgcgttttcgtgtaggtcagcttagttcagctgttgaagcgcatcggcacgagcaggtagcggtagtccatggattcttcggaattcgattcctgctggccgttgaattccaccggcttgaccgcggtggtcatcttcatgcgtacgaacggctcgctgatggcgctcagaccttcgatcaggtaggcgggattgaaggccacggtgatgtcttcgccatccatgtcgatgtcgaggatctccttggcttgggcttcatccaccgagcctgcggtcagcgtgagttcctggctggtgaaggccatgcggatcggagcgttgcgttcggccacgagggacacgcgcttgatggcgctgatgagatcctgcttgttgatgaccgcatgaatcgggtattcgtcagcgtacaggcggtccaccgcggggaattcgccgtcgatcagctgcgaggtggatacgcgtccggcgttctcaaagcccagcagcgacggattctccggatcgaaatccacgacgatgttttgatgctcgtccaaggaacgggccacatcgcgcaacagtgcgccgcgcacgagtgcggtggtgttgatgtccgggttttccggcgtccaggtgaagctcgaacgcgacaagcggaatcggtcggtggagctcatgatcaccttgttgccttggaactgcacacgaatgccggtcagtaccggacggttctcctcgcgggaaacggcgacggacgcctgggcaacggcctgtgcgaaggtttgggcgtccacctgccccagtttggcgggaaccaccggcagatccggatattcgttatccggcatgagctgcatggtgaaggtggacttgcccgacgtgatggtcagtgtggatccgtcagtggataggtaggttttcgcggcgggaagcgacttggtgatatctgccagcagcttgccgagcaccagaatggatccgctttcatcaacgcctgcttcgatatggtggcgtgcggaaatggcgtaattgaaggcggaaagctggagggtgccgtcgatggcctccaagcgaatgcctgccaaaatgggggatgcaggacgagcgtcgatcacgcgagtggtccaggctactgcgtctgccagcgcttgggaattgacttcaactttcatggctagtttcctcgtttcgttcggtccataagtcattctagcgagactgtcggcgtttgacgaagcgtggggaattccccacttatgacgacgatgatgaatttcttataacaacctacattcgtcataataaggcctgtggataatgtgggtaagtgctcagaccccacgttttgcaatggctcacaacatctcattgcttgtggataacttttggacgaagtgtggacaaatcatcgggttatccacagcctcgtcgctttgaaaaagttatccacaaaaccatgtggatagtccacaattcatccaccggcgattctggcgtttccaacgggttttccaccgagaaatcattgatttgtgtataaccatgtggataacttcaataaaaatcttccacaggccggcgtgtcaggatggtcggtaaaacagctgataaagaatttactgatactcatacttggcttgtgaaaatcgcctgagaaaggcagaaaacgcctaaaatcgtttttttgagacgcacgaaaacacatgcaaacgcgcaaagtcgcatagaaaacgttatttttcgccggaacgctgcttgagctgcagagtcagttccgtcacgtagttgtagatctcctgcttttcctgcatctcgtcgctgatgcgggtgtatgcatgcatcaccgtggtgtggtccttgccgccaaacacctggccgatgtcgttcaggctcatgctggtgagctcacgcaccaaatacatggcgatctgacgcgccagcgcgatcttcttcgtacgcgaacgtccgacaatgtcatcgaacgtaatgtagaagtacttggccacctgggtgatgatgtcggtgggcttgatctccacatcggtcgagaaaaagtcctgcaacgtctgttccgccaacgcgcgggtcaccggctggccgctcagcgatgccatggcggtcacgcggttcagcgcgccttccagctcgcgaatattctcggtgaaccgctccgcgatgaggttgagcacatcgtcctgaacgttggtgccgtgggcgatcatgcgcagaatggcgatgcgcgtctccagatccggcggcttgacgtcaacggtcaggccggattcgaaacgggagatcagacgttcgttgaatccctgcagatccttcggaggcacatcggatgcgatcacaatgcgcttgttcgcctgatgcagggtattgaatgtatggaagaactgttcaagcgtcgcgtccttgccgctcagaaattgaatatcgtcgatgagcagcacgtcgacttcgcggtagcgacggttgaattccttgatttgaccggaattctggttggtgtcacccaacgcttcgatgaattcgttggtgaattcctcactggtcacataacggactttcagcgtgggatccttgaccagtgcgtaattgccgatggcgttcagcaagtgggttttacccaatcctgatccgccgtaaatacaaagcgggttgaaatcgtgaccggaaccttccgcgacggccaacgcgacggtacgtgcgaaacgattggaatcgccaggaacgaaggtgtcgaacgtggcgttcttattcaaatgggtcttaggatccagcagaggcctgttttggccgcgttggaagttgttgcggcgctccggcggcatgacaaccggaatcggcagctgcccctgcgtggtttcctccgcatgtggcgcgggggagaagtgggggtattcctcgacggcaggttgggccggttcctttttttccacaatcttgaatgcggggaaaatatcctgttcggcggcttcccgcaaggcttccagcaggggctggttcaattcgttctgcaacgtctgctgtgcggccgcgcttggcacgcataagacaatggtaggaccccacatgccttcgggaaaaacgttttccagccagcttttatctcggatggacagcgccggattctggtgcaacaacgccagcgcgtcggaccagactccccgagcctgctcgagagggtcagttgtcgtgtcggccacggattcccctttctcgacagactttttccaagtgtgcaactgtttatttgtactctcttttccccaagttatccaccggtaagcgtgttgaaaagactgaattgtgaataacatcattgtagtttgtggataacttttgtggggagtttggcgacatatcaacgtttctgtggattgttttgtggggagaatccccatgaaaatgtgaaggatttgatatgcgtattcatctctgttcaggggtcagagtaacttggtagagcttgactcatgaggagccgtgccttggcatggcaaaaaacaccgggagcattaattatgaagaggacattccagccgaacaaccgtcgtcgtcacatgaagcacggtttccgtcagcgcatgcgcacccgcgcaggccgcgctctgatcaaccgtcgccgcgccaagggccgcaagtccctcgctgcctgatttaacggcatagagcggtggaacggctgaaaagccatcgcgatttcgtcgcggtgctcaaacgccgtcgtagggtatcgcgagaagacatcgtcgtgcattatttggtgcacgacgatgccattatcgacgattctgcggcgatgcggggccgacgtgtcggtttggccgtttccaaggctgtcggcaacgctgtgacgcgtaatgccgtcaagcgtcgtttccgcgtgcttgcacgaaagtacgaatctgccttacctgaatcctgcgatatcgtgttgcgtgccaagccaagtgctgcgcatgccgattttctatcgttggaacagcagatcgcagcatgttttgaagcggtgaatcgtaaggccgtgcgtcggtaatgaacgccggtcgtaacggaaattggatgattcgtgccattcgctggtaccaacgtcatatttccgcgaataccgcgccttgctgcagatattatccaagttgttccaattacgcgattcaggcgattgaacgatttggccgccttaagggtggccttcttgcgttattgcgccttcttcgctgcaatcagtggaaccgtgggggaattgacgacgttccgcagctttattccttgttttacagatgttcgtggtcgaagacacacgaggaacctcggctcacgcctctgaacgtagaaaaacctataggcgataaggagactggcctgtaatgaatcaaaatcaattcctcctcgacagcggtttctggggctggctgtataagctcctgtatcccgtcgagtggctcatgacgcagatcatggccgtattccataagttcctggtgatgctgggcatgaacgagatcggtttctcgtgggtcatgtccatcgtattcctagtacttgtggtccaggcatgcgtttttccgctgttctacaagtccatgaagggtatgcgcaagatgcaggcccagatgaccgtcctgcagccaaagatgcagcgtatccaaaacaaatacaagggcaagaacgatcccgccagcaaggaagccatgcagcgcgagatgatgaagctctaccaggacaatgatgcgaacccgatgggtggctgcacttccatgctccctatgttcgtgcagggtcccgtattcatgtgcatgttctatacgctgtcagccattccgtacatcgcacgcggcaaattcagggacggacagggtcttggcgctttcgacatcgccacagccaagcagttcacgtccaccacagtgttcggtgtgaacgtggctgataacttcacgaccgccgccgtgcatggcaaagtagttatcgccatcttcgttgcattgatgtgcttctgcctgtggttcatgcagtacaacagcatgaagcgtaacatggctcagtctgcggcaaacaagcagaccgaaatgatgcagaagatgatgttgtggatgttcccgatcatgtacattttctccggtattgccatgccgttcgctgtgctggtgtactggctcaccaacaacatctgcaatctgttgcgttccatctggcagatccacgtcttcccgactccgggatctccggccgccgaagcgaaggaaaagcgtgatcatgttcatgagaacgcccgccgagccaaggccggtctgccatccctcgaggaagaggcgctgcagaaggccaaggaagccgccgaagtgaaggaaaagagcggctaccagcgtcagcagccgagccgtaaaaagaaaaagaagtgagtaaaagtgtgtcccgtgtttcacgtgaaacgcgggacacaccacttttatcagcgtttattgtcgacgtggtaaacaggaattagactttacacaataagactttagtaatagaaaccccgctcaaaggagtacaaccactatggcgcaagatgaggaaaagaccatcgatcagctcaacgaggaagctgatatcgctgccgattatcttgaaggactgcttgatatcgtcgattacgaaggcgatatcgaaatgggcgtgcgcaacaatcgccctaccgtgcaaatcgtcgccgatgatgatacggacatcaagcatctcatcggacgcaacggcgaagtcgttgacgctctgcagcagctgacgcgactggccgtgcagcagaagaccggcgagcgttcccatctcattgtggacgtcgacggctatctgaagcgcaagcgccagcgtctgcacgacatcgcgctggacgccatcgacgaggtgcgcgagacgggggagccggttgatctcaagccgatgaactccttcgaacgcaagatcgtgcatgatgtggtgcgtgaggagggcatgaagtcccgttcccacggcgaggaaccgcgtcgttacgtcacggtgtatctcaaggcttccgctgccgaagatgctgaagacgaggatgaggcctgagttcggctcgtttcacgtgaaacatggcgtcaccatttggtggcgcttttttttgcgattttttgagtgacttcatgctggctgtgcgccggacatgtgatattgccgtcaatggtcggaaagtacttgctggaataccggcaatgaggaagagcaggatataggatggtgcccatgagtgatgtgacagacgaacttgatgattcgccgatgcttgaggaagtgctgggggatgcgttgggcaagcttcgtgttttccatgcgaaacttgccgaagaaggcgaacctcgcggtctgattgggccaagagatgttggcattatttgggaacgccatattctgaattcggccgccattgtgcctttcgtaaaggaagccacggccaaggagcagttcaagacggttgccgatatcggcagtggcggcggttttcccggtattgtcgcggccgcctgcctgccggatcaccggttcacgcttgtggagccgatggaacgtcgtgtcgaatggctgaacgagtgcgtggccgatatggagttgaataacgttaccgtggtgcgtgccagggccaatgagatgatcgaggccattgcgggtgctgctggcgctcaaggcggcaatcgtggcaatggcagcgccaggaacggcaaaggcggcaagaacggcaggggagtggccgttcgcggtcctgtactggatttggatggcaagcctattcaggcgaaacgtccgtttgccgtggtgacgtgccgtgccgtggctcctatgaccaaactttcggggtggacgctgccgttgcttgagcgcggtggacgtttggtcgcactgaaggggcggtccgcgcaagaggagatcgaaaaggcttccaaagagatcgccaaatgcggtggcattcgtccgcgggtggtggatgccgaggttggtccgggcttggaatcgacccatgtgctcatggtggataaaaagtaagttatccaccatttcggtgagttatgcacattgtccacaactggaaaatcgactaaaaaaagcggcggaaaaatgttgaagtagcaacgaaagatcggtggataactttttgcgaacaacgtaagttatccaccgactatccacagctattcacatttgtgcacagtgggtgagatgagctgattctgtccacccgaatgatgaaacttgaatgttaagcatatcgtaaggaaggctagtgtatgactggacctgaaggaccagataacctgacatcgatggaatcggcaacggaaaccatcaaacgaattttcggaggatcggattcccctcttggttcgcagattgccgacgaatcgactcgctatcgcgccttgcagaaggccgtttgcccaaagccggagcagacgcgcctgatcgcggtcgccaaccagaagggtggcgttggcaaaaccacgtcggccgtgaatctttccgctgcgttggctcagttcggttccaaggtgctgctgatcgatatggatccgcagggcaatgcgtcgaccgcgttgggcgctccgcatgcgtcgggggagccttcggtgtacgacgtgatcgaaggcaggaagaccatcgccgaagtcaagcgcacatgccctgattttgatctgctcgatgtggttccagcttcgatcgatttgagcggtgccgagctggaagtcgccgacatggaaaatcgtaatgtgcttctgaagaccgcggttgacgagtttctggaaaccagcgaggagcactacgactacgtgattatcgattgcccgccaagcctcggcctgctggtaattaatgccatgtgtgcggtgcatgagatgctgattccgatccaggctgagtactatgcgctggaaggtctcggccagctcatcaataccatcggactggtgcaggagcatttcaatccgtcgctgctggtttccaccatgctgatcaccatgttcgataagaggacgttactcagccgtgaagtgcatgacgaagtcaaaaatcattatccgactatcgtactgaataccacgattccccgaacggtgaaaatatcggaagctccaagcttcaatcaaagcgtgatcgcctacgatcccaagggaatgggagcgattgcctattgtgaggccgcattggaaatcgcacgtcgctcgcagacggtgctgaaggctatcgatgcaagaaggaatgagaactgatcatggctacgaaatcacgtttaggcaagggtctcggcgcactgtttccgtctcttccaggagagtcggcgaaatcggaagccgctactgaaccggctgtggctgttgcgggtgcaaaggctgataacaagatcgctggaaaggtttcagaaaacgtagccggtggtgcgactgttgccgggcaatccgcggggaagaccgcggtcaagagttccgtggcaaccgccaaggcttccgtcgatgccgtccatgacatgaagaagaacgtttcacgtgaaaccaagaaggggagtggccatcgagccagtatgccttccatcacgttgaatgagactgctcatcctgccgacatgttcttcggttccaccagtcctgttgccacttccgaagtgaagcaggaaagtgtttcacgtgaaaccgctgcggtaaaaaagaccgaagataagaagaatgacgaacctgaactgttgccggtgcagggcggttatctcgttgaattgcgactgagtgatgttggaccgaacctgcatcagccgcgtaccattttcgatgaggatgatcttcgtgagcttgccgattccatcaaagaagtcggcgtgctgcagcctattgtcgtacggaagcgtccactcgcgcagattgaggctgctcgcaaggagaacgccgctaaagatgccgagtcgcacaatatgttcgacgggcgcatggatagcatgtacgagctcattatgggtgaacgtcgttggcgcgcatcgcagatcgcaggtttgaaaacgattcctgcgattgtcaaaaccactgccgacgacgatatgttgcgtgacgctttgctggaaaacctgcatcgcgttgcgttgaatccattggaagaggcggccgcctatcagcagatgatcgacgattttggcttgacgcaggcgcaattgtcaaagtcggtgtcgaagtcgcgtccgcaaatcgccaatactctgcgactgctgaatctgcctgcgaccgtgcaaaagaaggttgcttccggcttgctgtcggccggtcatgcgcgcgcattgctcggattaccgacggaagctgacatggaacagcttgcgacgcgcattatttccgaagggttgtcggtacgcagcaccgaggaaatcgtgtcgatgaaggtcgctgaatcggaccagccgaagaaagcgaaaaccaacaagctgaacccttgggccggaacgccgatgcaggtcggtcttgaaaagaggttcggcacgaaggtgtcgatcaagggatccaaggagcatggacgcatcgaaatcgtgttcaaatccgaagacgacatgaagcgcattgtcgacctgctcatgcccactgccgaaaaatagtatttcttaagttttttggtgtccgcggaaggggcggcatattctgttcacgacacactcaaggccgtttggccaagcttacagtcgtgaacagaatatgccgccccttccgctcgtttttcaagtttttgtagggtatgaccgtgatgggaagtgttactgctggaggtaggcttgggcatcgagggcggcccggcagcccatgccggcggcactgatcgcttgacggtaaatactatcaacacagtcgccggctgcaaaaatgccggcagtgctggtgcgtgtgctggcgccgtccacctgaatatatccacccgcatctcgctgcacaatgccgtcaataaaagctgtgtcgggggagtggccgatcgccacaaaaatgccgtttgcggcaatcgtgctggtctctccggtgatgacgttgcgaatgttcacggattgggctccattgtcgtcacccaagatttcctccaccacggaatccgtgacgatggtgatcttcggattctgctgagcgcgttccacgagaatctgcgatgcgcggaattcagaacgacgatgaatcaacgtcaccgacgatccaaatcgtgaaagaaaatcagcctcggtgaatgcgctatcgccgccgccgaccacaataatcggcttatctcggaagaagaagccgtcgcaggtcgcgcaatatgacactcccttgccggaatattccgcctctccggggatgtcgagtttgcgatattccgatccggttgcgatgatcaaagcatgggtttcaaaaacgtctccctgatcgacgctcacggttttcacgccggtgacgtcattgttgctcacggaaacaacatcatcccaaacgatttccgcgccgaacttctcagcctggcgttgcatattatccatgagttccggtcccataacgccgtcggggaaacccggaaaattctccacttcagtggtgttgacgagctgcccgcctggggtcagcgcacccgcgatgaccagtggtttgaatccagcccggcccaagtatatggccgcggtatatccggcagggccggatccgacaataatcacatctcgcaaatcactcatattcccactgtagcgaaccaccaaagcaaccagccgcgcactgcacgatttcacgcattcctttttcttatggcgtattatcaagtgctttccaagctggatcatctacagagtttcacgtgaaacaccagctgttgtgcgtggttgcgtgcggtgctgtgtgtgcagttgctggggtggctggattcttggcgtcgcttgatcggaacatgagaaagggcttgcgctccacatggagcgcaagcccttcggtcgtgttaatgtgacgcctgcctgtgcgggccttggatcacttgttgatgaccttcttgaacagatcggcgctggccttggcgagtgcgaactggccgaagcccggatcgacggaagcgaggttggcgttgatgatctggttgaaagtgttgttcttcatgatgtttcctttcgttcggcttggcggcgttcttgttttctgttctttcctctggccgctgccgtaagtctgttgctttttggttacgttcagcgcgggtggcgttgccgtttccccgcgtgtggggtgcggctccggttttctctccggttcctgccgcatcgtgtctctttgttctgttgtgccttcatcataggcaggctcaaccgtcgatgtcatgcaacgatcgtcgattcttttgtattttcatcggctaatcttgaaataaacgtaacgatgctgtgatgaacatcaatcgtcgattgcagggcagtattgccgtcgcaaaagaaacggcgcgatcttcagattttctatcttttctatcttttctatgaaagtctcaaaatcgttctcccgtaagacttttcgcaaggtcggcattgttctatccattttctatcttccttatttgcgggagtatttgcgcttgttgccggcgaatgtcaggttacattgattgatatcgggctgattgggctgggctgattggtgtggctgttcgacaggctgattggtgtcgggcataagaaaggaacgtgatatggcgactattcctgaacaatatgagagccagcgcgtgggcgtgcagggatatcgcgtgctcaatctcgatttggacggcgtttgcgcggattacaagggcgcgatccgcgattacctgcagcggcagggcattgacgtgccggaacgtgcgctgcagaccgcgcattacaatctcacgcgcgaggacggatggccgttcgagacgctcgacgattacatcgaaacgcacaaagccgcggagcgtgagcatctgtatgcgacgatgaagccgcttccgggggtcgcgcaggcattgcagcgattggcgaatgagcacgtgtacattcgcattgtcacgcaccggctgttcgtgtccggccagcatcagatggtcgtttccgacactgcgcaatggctggacagcaaccgcattccgtacatgagtctgtgctttactgggctgaaagacagtatgcaggccacgattcatattgacgattcgccggcgaatatcgaaactttgcgtgaggcagggcagcatgtggtcgtgttcgatcagccgtacaacagtacgtatgctggtcccagaatcgacagttggagcgacaccaacgttgaaacgctcctcaccctcttcgaatcctggccggagtaaggggtgtgctggcggtagctgcgattccgtccgtgtgactctggtaatcggttttaggtgcgggttgtgcggacgggattatgtgagcgaccgcatgatttgtcagttgaccgcacgatttcttctatctggcctcatgattttgttttggcgacctcacgatctggaaaagagtgtccccgattgaaatcgtgaggtcgccagatcacaatcatgaggtcagccaaaccagatcatgggtcagactaatgctggggtagacgtttcagcgcgtcagccagtctgcggcggaatatacctgctcgtctttggcttgaaaacttgattccacgcgagccgccacaaagcgccgctcagagcgcaaagacgcaggaatttgtggaaagcggtcacgtttcgcacattgagataaccggccacgtctcgctcgacatatgtgctgagatatgacgaaaagaagagttcaagcggcatttcggaactgtagagacgggggtagccgtcgcgcagcataaaatcatccgcgagcaagctcccgaatctgacattagagttctgacatcagagtgataaaaatggcgaaaagttggttgtcgattcttgagccaagttccatcgcttttcgactacgaccatattccaaaaataaatacgaaaagagcctgccatacgtgaggtgacgcatggcaggctcttttcgtatcgcaatcttcagaagtaatcggatattgcgatgtgctgacgatcagaacacttgaatgctttcgatgtacagctggttgcccggcaggctatcaagtgggacccacagcatgatgtcctgcgtttccacggccttgtcgaacttgatgtcggtcgtgccggaagcgtcaaacttgaactgcgccacctgttcgccttgggacgggctgtttgtcgcattcacgcgaatatatccctgaccaccggaagaacgaattttgatgaccatgcgatacgccttctgcggctggctcagatgcacgtaatatccgtagccctgctgtccgtcaggattcgacaggaattgacgattgtcgatttcgtacgcggtcgtgttttccggctgcttcggatccggcactttcttcgactgcttatcggcggtcacgaccttgtcctcggttttcttgggttgcttggacgccgtagactcgccggatgccggcgtattggcggaagcatcggaagaatccttggaattggacgaatcggtattgccggacgtatcggaattggaagaatccgcggaattcgcatccgactgatctccctcgccgaacggcacttcgtcaagatttatttccggccatggtccttttgaatcagtcgtaaccgaatctgaaggctgcatcaaaccatgaactgcaaacccaagcgcaaccgcaacaacgatgaccgccacgataatcgcaacgaccttcgttttcagcttgccaaacagtttcgcgtcggcaacgtcagtattcgccgaagcggaagaaggattctttggcgtgaagctcggcggaaccgcggctcgaccggcggcatacgcggcatcgatcgcctcctgctctgctttcaacgcacgggcggactcctcgccgggctgaatgacctgaccatccgcgccgatcactggaatgcgaccggttttttccaactgggaatcgtcggatgacatgccatcgtccggtacggaaaccctgatggggaaggagaagggagaatcgctggtgtcggtcacgccatcgatgtcttcttcgctcagcagttcacggccgctgctccacaacgatttcaccgctccactggtggccgcgacgcttttcgccaaagcctccttgccatcggaaaaatcgttatgcggttcgggagccgtgaacgtcatttccggaatgcttccagccgctgccagcgtatccggcagcgggagcacatccttctcaagaatctgcagtaacggaacattggcgattgagcattccgaatccatggaaggcaacgtgatatccatgcttcccaacgatgacagcggttggtactcgccaagcaacgcttccaattccgcaatggttgccatcggaacggtggggaagccgtcgtcctcttcaagttcgagaccgcgcttgcagatcacgcggaattccatcggcgtggtcggcgcgagcgcttcaagacggaaatccgtcgacagcgtggacgggcgtcggatcagcatagcgtacaacagcgctgagatttgacggatcgcaagctgttcccgattttccaaagcctgcgcgcgggaagtgtcggcaagcatgatgctcactggagcatctgcgatctgaatgccggaacgggtcagtcgcaccgtgtcggtgctgatggagaaatgcgtgagattgtctttttgcagcgcatgcaatgattcgatgacttcgccaatgatggagcgcatggctgtatagctcaacggctggttggcgttcagcgcaagatattcactgagggtcatgccttcgtcaagctgcgtcaccaccagcgcgacctggccggcatgctggagctgcagcactttcgtgaagtgggaatcatgcgaaatagccagcatggaagcggttgcgttgacttcctgcaatgccttgctgctgctgacaataaacagctggcaatcccgtgcgagcacatggtcgctggccttccagacctgcagtccggtttcttcgcgcaatggcgaaacgagcacgtagcgattgctgatggtatctcccagctgaggtttcatgggttccttcaactttttgtaaacgtttgttctgcctatggtcactcgccgttttcggcgtcgtcctgttccagtctatcgttggggctggtcggcttgcgaagtccgggaatacgtgaggaaatcagtgcgatcgcctccttgaattcctcggaacgtagcagccgcaacatgcctacgtaaacgatgaaggccactatggccagcagtgcggcacacgccactgcctgaatccagttcatatgaccgtccaccgctccgatttgggcgccgacaagctggtagacgctgtcacgtaccgtcacgccgatgaacatggtagctactgccgcgccaatcgatttcagatacgagatggctatgcgcggaccgtcgatattgttttcgaatcgtttgcgcagcatggcatacaggatggggatcggcagtatgtagctcatggctcctaccatgccgatcattgtcgtccattcggtaggggggagtagtttcgcgccgatgatcacgcttaccgcttgaatgcccatggcgaacagcatgaaaatgaacggcgatttgccgtcttcgaatgcatagaacgtgcgctggataatcagatacgcgctggcgaacggaagtcccacgccaagcgtgaccaacggtcccgccataagaatcgcctctctgacgctcacagacggcagcaacgcgagaatgatcggaacgggcatcaccacgaaagcgaccgcgaaatagcacatgatcacacccatattgcgcagcgcctggctgagatcgatgcgcgcttcggcgatattatgatcggcgaccgcacgggatattttcgggaaaatcgcggttgccagcgaaacggcaatcagcgaatacggcaacatgtaaatcgtgtacgcgttctggtatgaagcattgccggccacgtagagcggattgatgccgaactgctgctgcgcgagcatcggcgcgttagtggaggtacgcgtgattacgatattggcgagctggtcgattacgacaatgccgacactccaagccgcgaccggtcccatggaacgcaatccaatgccacgaaggccgaagatggggcggtatttcaatccgattttggtcagtggaatgaacagtaccagcgcctggaatgccacgcccaacgtccacgtgcctgcggtcagggcgattttgtcggcggtccaaaaatcaagcggatgctcggtggcacggccgaatagcgcgatgaacgtgccgaagccgatgcagctgatgatgttcgcacccacggaactccacgcatacgcagtgaaatggtctttggccgcgagaatctggccgaccaccgtatataggccgtagaagaagatctgcggcatgcaccacagggtgaatgaggtcgccaacgccatggtttcggggctaccgttcacatacagcttggtgagcagcggcgtgcatagggccatcaggatcgtcaccgccaacagcatggtgatggcaagcgtgatgagcttgttgagtttggtttcggcgtcttttgccttcaacgtgcgcacgatctgcggcacgagcacggcgttgaaaataccgccggaaaccaaggtgtagatcacctgcggaatcatggatccggcttggtaggcgttcgccgcatagccggtggtgcctaaagcccaagcgagcagaatggtacggatttgcccggtcacgcgcgaggccgcggtgccggaggccatgatcagtgaattacggccaacggaagaactcattcgtctggatccttcttacggtggaattggcgccacagtcccaaagctccaagcagcacggcgatgccgatgatgatgaagccggttttgtcgctgatctgcaatgcgctggtgatgtgggtggtttgtgtcgctccgaatgtgatgccctgcctgtcctgcaggctgagcgtggcgtccgcggtgccggaggtggccacgcggatggtgaacgccacttgggcttcgctgtgcgcgggcacttccacggtgtcgaaacgcgaagtgacgatctgcatggagttggtcaatgatgagacttttaccgtgaccggataggggtggctgttgctgatggtaacgggcatttgcgcggtttcgctgaccacgttgacgttttccgtcggtgtgatggccacgccgttgatgagcagggacgccagttgcccggctccttccaccatggtgcttccggctggattttcgccgcctagcgcgtgcagggccatgatgccgtgcgcgttgacgagctgcctgcgccacgctttgaggcctgcgggggtctgcttggcatcgtcggcgacgtcggtgaggatggatgcgttgaatcgtttgatgtcgtttgtcgaggctgccagtgtgttgagcgtctgcctgagattggcttgcgtcgcatcattgattccgtcggattgcggcacgatcgaggctgcatcgtcgccgctcaaggcggggtcggcgttgttgagcgtgttcagatcggtgatgttcagccatggcgattgttcgacgtccgtcatcagtgcgtccacgacggccggatcagagttgccgttcaggcagaccagcagattgcgttccgaatacggctgctccatctggtagaacgcgctttgcgcgacgaatcgcgcgagacgcccggccgttgttccctcgccgtccgcttcggcgtcggcactggtcgccttgccttgtgcaaggttggaaagcacgctttgcgcggtcagtacggtgatgtcgccggcgtcggtggttactacggtcttgccggtttccgcggtggccgcatcatcctcttcgaaatcatgcgtggcgatgacggtgtcgtacccctgctgcttggctttcgccagcgcgtcggcggtccaattgccggtgccctgccatgcatacgtggtcatactcgcgttcgggtcacccaacgccgattgatagtttttcaaggcctgttcggcgttccattgcgaggtgccgacgcctgccgaatcataggttttgctgtcgttcagcgcggaataggcggtgatgtcgaacagggccggttgcgtgatgccgtcgacttgcgtcggcatcggcatcgccttcagataggttggatcggccaccacctgcagtttgtcatgcttggtgaacgtctgttccagcgacttgagtcgtgcctcgtcttctttgccgggaacggcgattttcgagagttccgcggaggtgacgccacctttgttgacgagctgttccagcatggtgttgtcggtggtccatccttgcgcttcgagcggctgcacgatggtgatattcatcgcgggcgtgtcgggggtattgattccagctccggtccgtgttgcgaaagtgtgcgcttcgtcttgttgaacgccattggcctcataactgagcgtgaccggtttcggcccccaggagttgacggacgccagcgtctcctgattcgagtccgcgtcgatgtgcacgttcgccgaagctcccggttgaagcgcgggaacctcgctctgcccaacgatattgggcgtgggaatctgcccgatgccttccgaccattcctggatatcgttgcgcgacacgaacgtgtagaaggcgttcatggcaagggtgagcgtgcctgaagggatttcctgatcggtggtgttggtcaccgtcgcgctcaaatgatagccggaagtgtcggtcagcacggcggtggaggagtcgatcgacagcatggtgtcggattgcgattcctgtgtttcttcggcttcggctttcggcacaggtgcgtataacaacatcaacgccatggtcataaccatggcgaggattgccgaaagcgcacgcatgccgtgcggaacgttccgttgtgcgggttgattcaccttcacgcctgtctgttgagtttccttgcgtacaaccatgctatctttcgttcgttcgggtagctgagaacgtcgtccaaatcagcaaaatccacccaaatcgcgtcttccgcctcatgatccgggtcgccttccaccgtcaactcgccgccgatctgacgcaatgcgaaatgatgcaccagcttgtgcacgcgctggctggttccggtgaaccagtagtcgatggtggcgatggaatcgaccacttcacctaggattcctgtttcctcgtgaacttcgcgaacggcggtttgctgcggtgtttcgcctttttcgatatgacctttcggcaggcaccattccaaatgtccgctacgcgagtggcgtgcgatgatcgccacacggcccttgtcgtcgaatacgagacctcccgccgaatattcgcgcactaccggcagttcctgcgcgtcgagcgaggcgaacgtggtcggaccgtccgtggcgcgccgctgcggcattattgccggggtgggtgcgttgggcgtgatgatggtctcttgccgcaaggaaacggactgcgatgtgtacagcagtttgtccggttccatcggattttgggcatggtcgtccgcagcatgggcaagcatgcgtgcaaggtctgcgggcgtaatcatgattccaaccatactcaattctgtgtgcaggtggggtaacggtatgctggtaaggcagaaacttgtggtgccggaaagggatggcgtgaacttcgaagtgtggccagaggccattgaattagggcgtatgttcgccgcggaaggctatgaattggcgttggtgggaggtcccgttcgagacctgctgttgcatcgtaaatcgcatgatttggatttttgcacatcggcgcgtcctgagcagtttgaacacattttgcgccgtttcgggcgcgatggcttttgggatatgggccgtaaattcggcacgttgggcgccatgcgcaggcgtgaggatggcacggaagtgcaggttgaggtaacgacctaccgttccgacacgtatgaccccgactcgcgcaagccggaagtcaattatggcgacacgctggaaggcgatctttcccgccgtgatttcacggtgaatgccatggcgttgcgtgtgccggaattgcaattcgtcgatccgttcggcggcgcgaacgatttggccaagggcgtgttgcgcacgccggtcgatcctcgccagtcgtttgacgacgatccgctgcgcatgatgcgcgccgtacgtttcgtggcgcaactgggcttccgtatcgaaccggaaaccgctgaagcgctgaccgacatggtcgatcgcattgaaatcgtttccgctgagcgcgtacgcgacgaactggtcaaaatgctgctgtccgatcgcccgcgcgcaggtatcgaagcgctggtcgattccggtcttgccgatatcgtcttcccggaaattccggcattgcagctcgaaatcgacgaacatcatcgtcataaggacgtgttcgagcacaccatgatcgtcattgatcgtgcggttgccctcgaaaccggcccggacggccctgtgccggcaccggatctgacgttgcgtttggccgcgctgatgcacgatatcggcaagccgaagacgcgtcgtttcgaatcgggtggcaaggtgagcttccatcatcatgatgcggtcggcgcgaaaatgacccgcaagcgccttaaggcattgcatttcgaccatcatatggtcgaggacgtcagcgagctggtcaatttgcacttgcgcttccacggctacgtggaggagccgtggacggattccgcggtccgccgttacgtcaaggatgcgggtccgctgtatgagcgcctgaaccgccttacgcgtgccgacgcgaccacgcagaacaagcgcaaggccatggtgttctcgtcggcgatggacgagatggaacagcgcgtgcgcgatctgaaggagaaggaggatttcgacgcgatccgccctgatctgaacggtgacgaaatcatgcagctgctcggcattgacccggggccgctggttggcaaggcgtacaagcacatgctggaatatcgcctcgataacggcccggtcgagcgtgatgtcgctgttgccgagttgaaccgttggtatgaggaacagcaggccgagtagtctgcttgctgacctcacgatttggattctatgaccgcacgattcgatttttcgggcaaaaatagaatcgtgaggtcagtcggttccgaaaagtgcggtttcgggggtattctctggaggatttcgcccgcgatttaacccacgaatataagaattgacctcacgatcttgattttcagtgaaaaatcgaaatcgtgaggtcaatccgaaaatctgcaaatcaaaaatctgcaaatcacacggcgtcgtgttcgggggccttctgtacgtcggtcatcttgtcgacggtaacgcatccctcgaagctgtcgatctccttgccggcggtcggcaccttcttctgattctgcagattgtcgaaagtcgcgccaaccacaacgtcgatcagcatatcctcacgatcgtccatcaccatcgtcgcgtcggtgaagttgctgttcaccgtgtacgcctgattgatggcgttcttgccgaagatgatcatcgtgcgttccactttggagctggtgtagttgccggctgcctgggtgttgaactcgcggttctgcaacgcgctgctgacggcttgcgcgaagccggcgaattcagtgccgttgagcacgcgcacggtgatgttgcggttttccacgtacttgcctttgctgccgtcctgttcctgtgctgcgcaaggggcctgctggccgtaattcggctgtaccgcggccgacttgacattgcccaatcctccaacatggaagaagaacagcagggaaatcaccaatgcgatcgtcaaaatggtgccggtgatggtgaacaccaccttttgacggcggcgaatgtactgtttgcgcgcggcgcgctcgtcgttagcctgagtcatgtacgagtccttctccaaaaatcggttgacttcaaccttactgttacgcgatgatatgcacaatcggatgggccggtgccttggtggcgatgatgcggtcgacgcaacggctttgttgccatgccgactgcacggcgcgtgccgcatcgtcggttggcacgaatgcgattacggaagggccggatccggagacgaacgcctgcttggcgcctgcctgcaacgcttcgtcgatcgcctgtccgctgcgtggatgcagtgagatcgacgcctgttgcagatgattgttgtcggttgcgccggcgccgatttggtcgaacatggcatacacttccggcgtgcgcagttccgcctgatacgcgccgaccagcagacggcctgcaaagccctgatccgtcagttccagcacggcgtcgctgttttcgctgagttgttcgatctgctcgccgaagccggtgcctcgcgcatagcctccggtcaggcagaacggcatatccgcgcccaatgtggcggcaacctgttgcaaccgttcaatggaccaatcaagattccatagcgtgttcaatgccagaatcgtggcggccgcatccgcggaacctcctgccatgcccgcgccaacgggaatgcgtttttcgatgttcaacgccacatccggttcatggccgctcgcttcggccatggcgaacagggcgagcacggcatggttgcgtcgcatgtcgctgccggaggaggccagatcgccaagataggcaccttcaagattcagggagaaaccggatccgggctttttgcgactggtggtgacggtgtcgtacacgccgacggcgcagtagatggtgtcgagctcgtgtcggccaccccattcgctgcgtggcctgcctacgtgcagggtcagattcgttttcgccgggcagtccacgctgaccgtgttgattgcggtattagtgtcgctcatgcttgcgacacctcgcccacggctcgtgccaatgccacgaattcgtcgatggcaagcgtttcgccacggcgcgtcggatcgatgcccgcctgctcgaacgcttcggagggcacgatcttcttcaacgcggcatgcagggttttgcgcctctggccgaatgcggcgtcgataagacggaacacgttttcgcggtccactacggaaccgtcgggattgttggccgaaggcgtgtgcccgccctcatatcgtttgaacagcaccagcgcggaatccacattcggtgccggccagaacacattgcgcccgataatgcccacacgttccgcggtaccataccaagcgagcttcacgcttggagtgccgtagatctttgaaccgggcttttcgctcagtcggtccgcgacttccttctgcaccatcacgaggaacgtgccgagattgtcgaaacgttccagcaaggtcagcagaatcggcgtggccacgttgtatggcagattggcgaccagtgtaaacgaatcatcattttggaaatcaggcagattttccggcgtcacggtcaacgcatcgcgattgaccacgcggaaacgatccaccgcatccggcatgaattcggcgatggtgccgggcagtcgttccgcaacgggcgggtcgatctccacggcggtcatcgtggcgccggtttccaaaatcgccaatgtcagtgaaccgagtccaggtccgacttccagcacatgatcgtcggcggtcacacctgcctcgcgcacgatacgacgaaccgtgcccgggtcgattacgaaattctgcccgaattttttcgtcgggctgataccggcctcggccgcgatacgccgaatgtcggcagcccccaacaggcggccttgcgcggtttcgtcggttgcgttggtttcgttcgcgtgttctgtcattacctcattatccgttcaactggtatgaaaagtgtgcgctgttgcgtttgcgtattgttgcgatcggcgttgtttaataccatccgacctgctcggaatgctcccatgccttcgacgggctgccgtagcgttgcgcgatgtagctcaggccccagtcgatctgcacggccgcatcgtcacgccagtttgcgccgaatgccgccattttgctgccaggaagcgactgcgggatgccgtaggctccggaagatgcgttttccgcataccacagccagctcgattcacgcgtccacagtttcaccagatcggtccagttttgcccggtccagccatattgcgccgcggctccggccgcgtaggcctgtgcctgcgcgggggaggggtgatagaggcggcatcctgccgaaggatcggaaggttgcggtgtcggggtgggcgtcggatccggcgtgggggtcgggtcaggagttggcgtgggggtcgggtctggagttggcgtcggatccgggtccgttttcgatccggaatcgtccttcttgttgtcgtctgaattatccgtattgccggaattactgttcgaatcgtctttcttgtcggaattatcggaattgttgttcttgttcgaattgtcgttctttccggaattatcggaattgccggtatctccggaattgccggatccgtcatccgatcccgaatcgtcggaagatgctgccggtcctactgcgataatctgatcgagggcgattttcgtggtcgtttcgttggtcagcgtctcgctttccttctcgccgtccacatacgtgacgtcgtacgtttgctggatttcgccgtcctcgccttcctgcctgactacgacttcgccgggctgcaggctgggatcgacgatggtttgcgtgccgaaaggcaccgctttcgtgcgtgtttcctcgccgtgcgtcacgcggcggacgcgcaggatcgtttcgccgttgtctttttcgacgctgacgcgatcctccttgttcagcgtgatgcctttggagtcaagaatggaggccgccggcagtttgccattcggcgattcggagctttgcccgtctgcgatgacggtgaccggcccgttttggttgatgatcagtccgccggtgagtttgttgtacacgttgtcgatattgacggtgacttttgccgcgtctgcttcgttttgttcgaagaatccgatcagctgttcggcgctggtcgccactgtccagaagggcacttcctgcccgttgatggtgatggtggtctggtaggcgcttcgtaccgtcaccacgtcatggttgctcagcatgctggtggggctggtggattccacgagatcatgcgttttgaccttcacgccgcgttcctgcagcagacggtcgacgctcatcgcgtatgtggttacggtggtggtttcgccatcgatggtcagagccacggttttgcgcgcgcctacgccgaatgcgagcgtcgaggcgagcgtcaacgagaccacgcatgccgtcactcgaacacgccgaagcgtcacgaatctccggggggtccaccttcttgtcatacgtcctctttccagcgactgcctacatcgccgtcattgtaacggtcagatcgggacgaatggcatggtttccgctggctttatctataccgccacattttcgaggaaaaggagtaaagaaaaaagggggcaggagagaaggggatgtcctgccccctgcccggacgaggcaggttgggggaagcctcgtccggtcgccagaagccataagttgggggaaggcttctggatcacttacccatggtaagaggtcaaagcccgtcaaaacgggtttcgagcctcctgtcgggatcgaaccgacgacctgccgcttacaaggcggccgctctggccatctgagctaaggaggcttgtgccgctttctagcataatgcataaaaacggcaacgattgaatagcataaccagcgtgcccgatgccgtcaacttggaactgcgctttggctggcacgctggcgagtaggggggtataatttttcgattatgaggattgcgtagggctgatcactcgccagtggtgttggagatcggatccttgtcggagccgatggagggcatcacgcctcccttgccgatgtcgtcggacttgattccgatggcctccagcaggccttcctcaatggtctcctgcgcagtgctcaactggttcatatcccagaacttgccgttgatggtcaccgttggggtggtcatgctgtctttgtaggttccggacgtgttccacagttcggagcgcttcggcgtataggtgtcgatggcgtcaagccaatcctggtagtcgcggccgaacgccttgtccgccacatcctcggaaactcccgaggcgatcatctgttccttgatctgatcgtcgctgacggacttgtaattcgagctttcctcaggctggaaatcctcggcgtacattttttcgaggaaggtgatcagatggctcggatcgctgtcatgctcggccagatagatcgcggcattcgctgcgcggcttgaataatcgtcggtggaccacttgtccataaacgccatgaaatgcaaatcaagattgatctgacccgcgtcgaccatcttctgcagatcctcatcaagctgacgatgcagattgccgcagcccgggcacaggaaatccatgtagatctcaacagtcggtgcgccttcgacggacttgccgtagccatccttcgaaatcagcaatccgcccttcttatcgacgagcttaggggtgttttcgacttgctgcagcttgtcgtacgcttcttccacggtctgggtggaagcctgcgtttcggtgttcttgtgcatgttgtgatacacggtgaacgcgccgatcgccaccaggatcaccagcaccgccatcacgatggcgccgatgagggtctgctgcttgcgctccttctccatctgttcggcgcgagccttcatctccgcggcctcagcggccctacgctcggcgcggctggcgcgcttctgcgcatccttactgttctgggccatccacattcctttcgatgttcacatcacgatgctgtgcaccatagtagtgtgggcacgctattgctgaatgaagtatttcgtaaaagctcacgttgccatactacgtgcgattatctgatgtttttctgatgattgcaaacgtttgccgatttttgattttcgctgcgtatttcgtgagatggcgtcactacatatcgtacgattcggcagtggtgccggatttcgggcggccgcgcaatgcgccggcacccaatcgcagcaccaatgctcccggagcgagggcgcataccagccagccgatggcgcagcaaccggcctgggcgacgccgctttgcgaaaccggcccttcaatccaggtcggcagcggaatcgtgaatccgaatatcgacgtatcaaccatggcaaacggcagttgcagcgtgactgtggcaatcgtcaatcctaatgcggcgatgaccgccatgatcagtgcgcgtggcaccgcataacccagccccttgagcacatgccaaggcagcgtggcggcgcgggcgaaccagtcggaagtcctgcggctgcccccacggcggccttcgcgttccagctgcgcctccatattgaatccaatggtggcgagcaaccaggccagcagcgcgcccgcgatcagggcgatccatggcgagaacaggccgcatgcggccacaggaatcgccatcagcacgcagaggggcacgcctctgcctagcagttcgccgcgttgcacgtcggccggattcggcggctgcagtacactctgcggcacgttcgggttgagcggcgcggccggagtgaccggtgcggttggcacggcagatgtttgcatgtcttgtggttgcgcactttgcgccatttcaaccgatgcgttcggtattacggcaggaggccgctggttggcgatgcgctgcaatgcaggtttgatggccgggtcgatctgtgtagcctcttgagcgggattccaagcgtcctggaccggcatcacccgcgtggattgcggtgtatcttgcggcagcacactggtatccccactattgacaggcagcacgagcgtgccggtgccaagaggaatggttgcggtatgcgcgttgatatccatgaccgaggtgccgacatcgggcgcatcggcaataacggtatcggttatgtcagcaataacggttgcgccgattgcctgcgtggcctcaacgaattgcggcaaggtgcgcgtgccgatggcgtcttctcccgtcacatggtctaacgcccgccaaagcattcgtggattgtcgggcgatccatcaaaagggagcatcgcctccgacccggcactatcggcggcatccgaagtattccccgaaatccaagcttgcggattcaacgcatccaacgcaatcgcctgcaacaactcgtctggagtgcaacgtttcgtacgatccggatccaacgccgaacggaacgcggccatggtcccagccggcaatcccgccaaattcgcgcttcccgcggcagcacgctccaataccgccatcatcggtttcgtgccgaacaccggctcgccagtggcggcaaatgccagcacgctcgccaccgaccaccaatcgctcatctcatcggattcggcaccgtcgatgatttccggcgcgatgaatccaggcgtgcccatcaccaatccggtacgagtcacatgactttcgccctcgcccatggcaatgccgaaatccaccaataccggtccggtattcgacaccatcacattcgtcggtttgatatcgcgatgcacaataccggccgcatgcacggccttcaccgcctcgatcagcttgcgtcccaaccgttccaaatcatcgcccacataccggccgttggtacgcacatcttcacgtagattcttgccctcgatcagctcggtcacaatgaaggccagagcatcatccaattccatatccacaatgccgcacacgcccggatgacgcactttctgcagcgccatagcctccctacgcaggcgctcgcgtgcggtcagctgatcgcgggagcgttcgctggacgcatcgtcctcggcaagggaatcgcgcaaaattttcatcgcatactgatggccgccgtcatctcgcacccgccataccgatcccatggcacccgaaccaagccgggaaatcaacgtgtatccgccaacgaggctgcctgcctccagattcaatgcgcttaagtcgctcatggcacccatggtacttgccttacgtaagttgccgctggaacagctcgctgtagtgtgccgaaaatatcgcaggaattgcgattatggagttggaagcgcaatgaagatcgatgatttccgcaatcaaggcaaggatgttgcaacaatctgcggatgagcgcacattgtgccagatgcatgcgcgcaacgggattatatgtgcacgaatggtagttttacatgcgcaggtggtatgcagattatgcacgcgaaacgacaggctgggaaaaatcagggtgcttttttcgcggattttggtgaaatcgaaacatcgacatgaagaagtgtcttcacttctggaaattgcgtgacgcggggcagcgttgcatgatttctggtttcgatgaggaaatcggagcctgcatgtcgtttggttatgagaatcaaggaggaggcagaccatgctgcaaatcaacatggctgacgtcatgaacgttatcggttcgttgacgccgtacctgattgcgattggcgtgctatttgtgctcgcgctgatcattacttttgccgtcaacaagaagacggtgaaggaagtggcgacccgtaagatcatccactccgagtcttggcttgtggctttggtcggcattgtcgtcgcggtttccatgatgctgtccggtccgctgtcgacgctgctcaacaacgcgaccatcaccaagtacatgctgtctgacaccactgtttccaaggctaacgagctggccaaggaagtgcagtcggaagccatcaccatgctgaagaacgatgattccaacctgccgctggctaacaagaaggtcaacgtgttcggttggggctccaccaacccggtatacggcggcaccggctccggctccatgtctgaccagtatgacaccgtttccctgcttgatggcatgaaggaagccggcatcgagaccaacgccgacctgaccaagctgtacaccgattaccgtgcagatcgcccagttgttggcatgtgggcacaggattggaccctgcctgaggttccggccgaccagtattccgattccctgatctccgatgccaagagcttctccgatgaggctgttgtagtgctcacccgcgtcggtggcgagggcgctgaccttccgatgaacatgaaggccgaaggcatcacctatgagaacaactccaaggattacgaggacttcaaggacggcgaaagcttcctgcagctgagccagaccgagcgcgatatgctcgacctggtcaccaagaacttcaacaaggtcacgctcgtctacaacggcgccaacaccttccagttcgacttcctgaacgactatccgcagatcaaatccgtcgtgtggtgcccgcctgcaggccagaccggcttctccgcactcggtgacgtgcttgccggcgataccaacccgtccggcaagacttccgacaccttcctgaaggatctcacccagtcggtgtcttacaacaacttcggcaagttcgaatacaccaacatggaagacaaggccgccaagtacacgggcttcactggtgacgaagtcaccgccatcccgggctttgtgaactactccgaaggcatctatgtgggctacaagttctatgagaccgcagcggccgaaggtgccatcgattacgattccatggttgcattcccgttcggttacggtctgagctacaccaccttcgagcagaagctcaacgatgtgacgtacaaggatggcaaggtcaccgttgatgtgaccgtcaccaacaccggcgacaccgctggcaaggatgttgttgaggtctactacaacccgccgtacaccgaaggtggcatcgaaaaggccagtgccaacctggttggcttcgagaagaccgagaagcttgagccgggcgcttccgaggacgtgaccgtcgaattcgaagacgatgacatggcttcctatgattacaagaatgccaaggcatacgtgctcgaaaagggcgattacaacatctccatcaactccgactcccacactgtgatcggctccaagaagatcaccgtggacgacaccatcacctacgactccgattcgaacacccacaatggcgaccagaccgtggccaccaaccagttcgatgatgctgcaggcgatgtgacctacctgagccgtgcaggacatttcgcaaactacaaggaagtcaccgccgctccgaccaacttcgaaatgtctgataaggcaaaggaaaccttctacaacaacaccaactacgatccgtctcagttcaacgacgattccgacgagatgccgaccaccggtgccaagaatggcctccgcctggccgacatgtacggcaaggattacgacgatgctgattgggagaagctgcttgacgagctgaccttcgacgatatggacaacctcattgccaacggcggctacggcactccggccgtctcctccgtcggcaagatccagctcaccgacgctgacggcccggcctcgttgaacaacaacttcactggtgttggctccatcggcttcccggcttccaccgcattcgcttgcacttggaacaaggatctggccaagcagttcggcgagatgatcggcgatatggctcacgacatgcacgttgccggctggtacgctccggccatgaacatccaccgcaacgcattctccggccgtaccttcgagtatttctctgaggatgcgctgctctccggtgccatggcttccaacgagatcgccggtgccaaggagaagggcgtgtactccttcatgaagcacttcgccctgaacgatcaggaaaccaagcgtaccgagatgctctgcacctggaccaacgagcaggccatgcgtgagatctacctcaagccgttcgagatgagcgtgaaagaaggcggcgcacaggccgtgatgagcgccttcaactacatcggcaacacctatgccggtggcaataacgctctgctgaacaccgtgctccgtgacgagtggggcttcaagggcttcgttctgaccgattacttcggcggctacggctaccagaatggtgatcaggagatccgtaacggcaacgattccatgctggctaccacctccatcaccaaccacatcaccgacaagtccgcaacctccgtgaaggccatgcgtaccgccgcccacaatattctgtacaccgccgccaacagctggcagtatgcagacggtgagccgaaggtcgccaccccgatctggaagaccgccatgtacgtggcttggggcgtgaccgcaatcctggtgatcgcacttgaggctctggctatcaagcgctacatggatcgcaagaaggccaaggctgaggtcactgcctgatctcacttccttctcacaggtcaaaacataactgaataacaattgaaacagcgagagccgtcgacttccctgagtcggcggctcttgttgtatttcagcgtgcgtgccgtcgcaagtgcagccaggtttcatgcttcttcgcgtctcttttgtatttctgctctttctgttccgctggaatcatgatttgcgattgcatttgggtattcatcacatgggaatgagatgtatatgggtatgacacgccgtttatagtttgtttttggttcatgtaggcgttgtcttcggggtctagactggctgtacggccgttcggaggcctttttcgacacgccgatggatgtgtttatttgcaacggttttagggtatctttggaagggtcgatttgcgtgattgccggggttcgtgtaaattgactcttcgctgccgctcggcgagtggttccccggttggggtgcctcgaggcgggtgagcggtggtggtttgagaactcaagagcgtatttgtactacttctttatagtcaatgattgccagttcatcgtccgctcgttcgcgagtggccgggaggccttgaaggacggtgaggttttcgtgcgatgcgcctttccttataaggcgatcgtcaattttcttgtttttgagagtcacatgttggctttctgcaaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggcgttatattggttttgcggtggtcatggcccaggtgagacgcccggtccctttccgaacccggaagctaaggcctggcacggcgatggtactgcactcgagagggtgtgggagagtagcacgccgccgcattctttcgttgggggttcccgtcgagcttcggctccgggaacccccatttttttatgctttgttgtgccggccagccggccggagcacgttgcccgggggttcccgtcgggcctttcccgttgctcggcgtccggattattccacgcgccgggagacctagaacgccgagggatttcaggaatttcaggggagcctcttgcgcttatccgatggttgaatagactgaagaactatgcattatttcgtacccaaacgctgtgtcgaatcgaacaaaatcatgtatcacgacaaagcaacagcccagcaggccgccgaccaaagttggcgtgaacgcggcactgaactttgggtctatcggtgcgaattctgcggaacttggcatctcacgcatcgcgatccacaatccagctacacgtacgtgcctttcaatcagcagattaaaccgcattcccgcaaaaaaggctacaaaccacgccgcaagtagtagttccgtcagcgttcgaggcggaagccttggcgcttggcgtttggagccacggtcttgctggtcacaccgggatcgaccgcatttgatgcgatctgatcgctgaacgtatcaaccgggcgctcggtattgcgtaaatcgtaataccgatgcacttcctcgtcgaaatcctgcaaaccggcaagcaacgtctcattgttcggcggatactcattctcaaagaactgcatggaacgcggcatacgcggcttaagtgcaggatcctgatcgggcttaccgatcgcaagtcccagcacagggtacgtgtattccggaagattcagcagatcgatcagcgccggaacgtcattcagcagcgagccgcgaatcacgcagccaaggccgagtgagtatgcggccgtttccatcgcatgcagggccagtacggcatcgttctgggcctgtgagtagcggtaactgccattcagcgtaaacgtgtcggaagtggtatctacgccctttgtggaagcgattgcggcattgcggtgttcgtcaagtacgaacacatacagcagtggcgcggtggcgatatacggctgtccgccgatttcggcgagacgcttcttggctgcgggatcggtcacgcggattgcggaccagtcattgaggaactggctgctcgccgcatgctgtgcaacggtttcaagggtttcgattacatcatcccccagcggcttcgacttgaatttgcggatggaacgacgttccagcagagtgtcaacagtggcattgtgaagaagattgctcatgtcacccattttcgtccgttttgcaggattacgcaaggatgccttggttcagccggtagaggattccggattcttcggcagcaggatccgcaacgtgaacacactgtcggtatcatccacctgcatggtgccgccgtactgttcgaccgtgtgcagcatgcttttcatgccgaatccgtgtcgggtggcatcctgatgcgtcgtaatgggcaggccattacgaaaacgcagccgacgctgatgatagttctgaatctgaatcagcatcaggttgccttgtgatgagaagcgtacgttgattaccctcttggatgggtcattcagttccatagtggcgttgatggcattgtcgagcgcgttgccgaacagtgcatagatatccgcgacctgcatgaagtccagtgaatcgccgctcggcatgcaggtgagttgaatatcgtgagattgacagtacaggcctttttccatcagtacggtattgagggccttgttgcctgtgtcgatgcgggtgtcatagatcatgatcgcccgttcggcttcggcgaagtatgcgtcacgctccgggctttcctgcatggtctgcagcgtgcgaatctgatgtttcaggtcgtggcacttacgattgatgatgtcgatcgtctcctggctgaccgtatactgcttctgttgctgcagcagcgtgtatcgtacgccgtcgagttcgcgctgcagttcggccttgtcatgattgctgcgctgagcccacatgatgtaaaagcagcataatgcgtcactgatgtggtagaccacgccatggagcgagacatcatcatggcacaacacgcccaatacccacacgaacagcagaatgcaggccatggggaacaggtcattgcgattcacccgataatgtccatgcactgcgagtttgcgtgcaaacatgatgaagaacgcgccgtagatggcgatatagatcaccgtggtcaacagtccgttgaggagcgtgggcagatcggcgttgtgcgtccgagtgcgatgctgagcgccagatagcattcgttggccgcatgctgcgtggcgttcgcacagatggtgcagtagagtacttccgacaatcccgcctgcagacacaacgccactgcgggaaggcatatgaccgcgaatgcaggccaatacagtatggccaacagcaggttgtcgggtaccgtgacggcggcgccgaacatataggcgatcattagcagaacaatggtgcatgaagcgaatcgtgcggggaaacgacgtcgttttgcgaccggaatcatgaacagtaggcaggccacgatgatctgtgccatgtaggaaacctgcagccaggcgtggtcgatcatacgctggtgcctcccatgtattcggtgagtgcgttcataaacggtttctttttggttcggctgattggcagccagtcgcatccgacctgcacggagtccttggccacggccgtaacctgcttgagattgaccagatagctgttattgcagcgttcgaacggcaatccctccagtttggcttcccagttgcgtagggagtcacgttgccggatgacgccttgtgtggtgtggaaggacagatggtgcccacgcacttccacatagtagagattgtcggatgaaatgcgtagaaaaccgtccgtcgtcgggaaaacgagcgatttcctacgacgattgccgatcagtgccagaataccgcgcattttgatggagaaggagtagtagttgatgggtttgagtatgaaatccaacgcatgtacggcatagccatgaatcgccatctgcgccatgttggtgacgaataccagtggaacttcggcgtccatctgacgtaggcgttgtgcggcggacatgccgtcggtgccgggcatgtcgatatccatgcagatcaggtcgaaggagcggtcgtagccgtcaagaaaatcatcggcgccggcaaattcaatgatgacgattgcggatccgctctcctgcgcaagccgttcgaacgatgcctgcagggtcttgcgttcgtcggcgtcatcgtcgatgattgcgatcctcacggtgttcatgcctcctcattgcgacggattccattataggaaacgtcacatgctcgggtcgaatggcgaaagaaccagttatgcccctgggaatgaccagttacgccatccgggaaggtagggggtggccgtgccgcgcaccatggaattgacattgatgtcggtatcaacatgtgacaacgaaggagtcgagatgaaagggaattccggtctgctgtggcgagggctcacatcggtgacaggcacattgctggtgcttggcatctgtgggacgcaatgctcgtacatgtatgcgggaacgatcaactccgcgctgggaacgtccagcacgagaatcgtcgccggtgaaggcggcggaaacactacgtactacgccagcgaatatggcgacttgaatgccgaaaatctacagaagctcatcgccgacgcgtacggcgagtccgtgcttgagcaggaggagggttcggtgctgttgcgcaacaacgacggcacgctgccgcttgcctcagacaaacatgtcacgttgttcggccacgccgtggtgcagccggtctacagcccgggtggcgccaacagcgccgccgacatcggcaaatatgtgattgatctgaaatccgcactggaacatgccggtttctcggtgaacaacactctgtttgacgcctattcgaagagcgataccaagcgtgtggccagcaacaacctgcaggtttccggcgatccacgttcgaatggcgcgttgaatgacgccccggtgcttggcgaggagccggcatcgttctataccgatcagctcaaggccagctggcaggacgattaccacgatgtcgccatcgtcatgcttgcccgtgaaggcggtgaagacaaggagatgatgatgaaggatccggagggcatcagtgctctgagtctgcatcaggacgagaaggacctgctgcggatgatcaaggattccggcaagttctccaagaccgtcgtgctgctcaattccgcctttccgatggaggtcggctggcttgatgactacggtgtggatgcctgcatgtggatcggcaatccagggcagcgtggtttcgaaggagtggccaatctgttggtgggcaaggccaacccttcgggccgtttgaccgacacgtatgccgtcgattccatgtcgtcgccggccgcgcacacttccagccagaactcaaaccaatggacgaacgtcgatgaagtgaacgccgcagtcagcgataagacggtcaatatcgataatgtgaccgtacagcccgagaacatctatgtcggctataaatactatgagacccgctacgcggacgccgtgacgaatccgggcagcggagcggccagctcggtcggagcttcacatggtgcctcggcatggaactatgcggacgaagtcagttatccgtttgggtacggtctgagctacaccacttttgaacagacgctcgacggtgtgagctacgaccgtgacaaggatgaattcaccgccaaggtaacggtgaagaacaccggtgatattgcgggtgcctctgtagtggaactgtatgcgcagaccccgtatggtgaatatgagcggaagaatctggtcgagaaatccgccatccagcttgccggctaaggccgtaccaagacattgcagccgggtgcttccgaaaccgtggacgttacggtggaccgctacctgttggccagctatgactacaccaaggccaagggctatattctgagcgccggtgactactatttcaccattggcgacaatgcgcatgatgctttgaataatgtacttgcggccgaaaacgccactggtatgaccgacttcgatggcaagccggtggaaggggatgcggccaaaacctaccggtggtcgtatgacgacgtcgacaccaagacctatgccaaatccgatgcgggcgaacgggtcaccaaccggttcgaggatgccgacgcgaactattggaaggatggtgccgtcacctatctgacccgttccgattggaaaggcaccttcccgaccgaaccggtcaagatgaccgctaccggcaagatgatcgaactgcttaagggtgatctgtatcggcagtccaaggattccaagtccgtcagcgactacacgcagggagccgacaatggtctgacgttcgtgatgatgaaagacgtcgattacaacgatgacgagacctggaacaaatatcttgacgaaatgaccatcgatgagatgaccacccagctttccgatttgttcggcacggccgaagcggcttccgtgaaccgaccggcgtatgcggctggtgacggtaccgccagcgtcggcggcaatacctacgccaaagagtacggtgacgcccgtgacgtcaccctgtatccggcgaccaatgtgctcgccagcacttgggattatggacgcatgcaacgtcgtggcgaactggtcggtgaggaagccctgtatgccaagaccccggtcggatggggtggtggcggcaatctgcaccgcactccgttcggcgggcgcaatggcgaatactggtccgaagacagcatcatggtctaccttgacaacctcgtggaactttcagctgctcagaagaaaggcttcgcacagggtgtcaagcatgttgcaggcaatgatcaggagctgtatcgcgaaggtctgaacatgttcttcaacgagcaggcattccgcgagggtgcgctcaagggcgtggaaggcatcgtcagcaacgagaacgccaccgctttgatgatgtcgttcaacagactcggtgtggtctggtcctcagccagcaccgcgctgaccactcaggtgatccgcaacgaatggggctttaagggcatgatcgaaaccgacggcgtggccggcggctcctacaagtcgcatttcccgtcatcattggcagcaggcgtgaccacctactgcatcgatccgggcaataccgcggccgcaggcatcaagaatcagatcgaagacaatgacgacggcgatatgctcggctatctgcgcacctcaatgaagaacttccactatgcgctgactcgtaccagcctgatcaacgggttggatgccaacgccaaagtggtcaaagtcaccccttggtggcgttacgcgatcttcggtgtggatgcggcgtttgcgttgatgacgcttggctgcgcctacatgatgtggcgttccggacgtcgaggcaagaatgcgcgggaaacggtcaaggtcgaatccgaaaccgcgacgggaaagtgaggaatcattatgaatagcagaactccatccatgttctccaacagaactatcggcttttacctaggactcgccgccggtgtgatggccatcgtctcactggttgcctacgccatgtatgccgttgccgccggctcatacaacgtgtgggtcatcgcaccgcttgtgttggtcgtgcttgcgcaggccgcgaccatacctcttgacaatgactggctgattgccgtaacgccggcgataggcatgatcgcatggtgtgcgttcgtcatggaatgcatgtatacgttcgtcggccatttcatgaatctgaacatgttcggcgaccagagcctgttcggtccggtcatgacggtgaccgtgctgaccgcagtcaccgtgctgatgctcatggtgtcgtcgttcatgcgtaagcgtaagtaggctgccggccctccgtcatttgtcagacgtcgttcgggcgaaggggcgccacgatcgttcttgcgcccgaatgacgaccttccttcgtgaacgtctttgaaagcaccatcatgaacagaatcccattcaataccggctggatgtgccgtccggccgcatccgaggccgaggaagtgccggtgaccattccccacgacgccatgcagtgggatccgaaaagcgccgacagcccatccggagtgaacagcggctggtacagcgctcgcgactacctgtacaccaagcatttctcttccgccgacattcgcagatcttccggtgatctcaccctgctcgagttcgaaggtgtctaccgtaatgcccgcatacgattgaacggtaggctgatcgtctcccatgattatggctattccggcttctatgcggatctgagcgagtacatagccgaaggcgacaacgtgttgacggtcgaagcgcataacagcgaccagccgaactgtcgctggtattccggtaccggcatctatcgtccggtatggctatgtgtcatgccggagcgacatatcatgcccgacggcgtgcgcataacgacggtcgattaccgtaccagacgcatcgcggtcgacgtacgcaccagccatccgggagtcgtatatgtgagcgttcttgatgtcgatggcaggtccatggcgcaattcaaggcgttgtcggatcggctcgatgggcagggcaatctcatgcatgaggaatgcgtgattcccgatgttcgcctgtggaacaccgatgagccgaatctctacacctgtgtggtgcggttcggtgatgacgagcaacgtgaggtcttcggcgtgcgtacggtggaatgtgatgcgcgacggggattccgtatcaatggcgaacgtgtgatcctgcgtggttgctgcctccaccatgacaacggactgctgggtgcatgcgcatatccggctgccgaggaacgcaaggtggcgttgctgaaaggcggcggttataatgccatccgttccgcgcacaatccttgttccaaggcgttgcttgacgcctatgaccgactgggcatgttgatgctcgacgagtatgtggacggctggtacatccacaagacccgctacgactacggcactgaagtggaggcgaactatcgtgatgatctggctgatctggtggccaaggactataaccatccgagcgtgatcatgtattcgatcggcaatgaagtgtcggaaaccgcgcagccgcgaggtatcgctctgaccgatgccatgacgcaatatctgcatgggctcgatgcgaccagaccagtgacctgcggcgtcaatatcttcttcaatttcttgtcatccatgggacttggcgtgtataccgacgaaaaagcgatgaaggaaatcgaacattccggcaagaagaaggcggtcggcagcgaattcttcaatcggctcgcaggcatcatgggagccgacttcatgaagttcggtgcgaccttgcctccttgcgattggaagacgcgcggcgcgttcgccgtgatggacgttgccggatacaactacggcatccgccgatacaggcatgacctgaacagatatccgaatcgcgtgatcgtcggctcggaaaccttctgctcggatgcggcgcgattctgggatttggcgcagagcaatccgcggctgatcggtgatttcgtatggtccggtatggattatctcggggaagtcggtatcggctcgcaggagtatgcggaatatgccaagaacttcgacggatcacttggctgggtgagtgcgggcgccggtcgattcgacctgaccggcaagcctttggcggaggcttcatacactcaggtcgcattcggtctgaaaccgattgcgatcggcgtggtgccggtcggtcttggccgtgaacattcgccgtccgcctggaagatgaccaatgcggtcgaaagttggtcgtgggacggtcaggaaggtgaacgcacgcaagtggaggtatatgcgcgtgccgccagggtgaaactcttgctgaacgggcgtgaaatcgggtcggctcgtgtcggacgtgacgctcgcgtgacattcacggccgtctacaggccgggcagtctgacggcggtggcgtatgacgccgacggcgtggaaatcgcgagaacatcactggccacggcgggcaaggaaacgagattgcatgccgtgccggaagcggagcgcatcgcgctcggtgacgggctcgcatatgtgcggttcatgtatgccgacgctgcgggaaccgtcaaaccattactgcgaggtgacgtgcatatcgaagtggaaaacggcgaaatcctaggttttggcagcgcctgcccatactacgagcgtagctatcgcagcgataccgccgacacctactacggcgaggcgatggccatcatcaggccttgcgagacgggaatcctcagcgtgaaggcaagcagtccgtacggtgaggccacggctcgaatcgaggtgagataatggcggtcaatccttggcgaacctttgcgaggaatcatccgaaggccgcaaaatgggtctggcagataggcgtgttctatctgttcagtctggcggtcaccgtgctgcaatatgcgttgttcacgttcctgccgtatctgtttggcgaggggctggcctccacggcattcatgtggccgcatattccgatatcgttcgcaggcatcgactactcgtggaatgtgcttggctatggggtggcgcgcaatgcggccggggaagtggtgatcggcggtggccttggatatttcctgagctatgagatcagatcattcgtggcgcagtgcgtcaacttcccgctgcaacgcaacgtgacgttcaaatcacatggcaacgtggcatatcagatactgtggtacttcatcgcatgggtgctgatctcattgttctgcaacgccatcaacggcctgtggctgccgttggcgcaggtacggttcgatccagccgtatacaatctgctggtcacgttcatcaccggaggcgtgtccatggtgatctacttcttcgtatacaagatcatcttcccggagggcaagtcggacgatcggtgatgatcgtgctacctgcgcttggcgtggcgatggttgacgatggccttggaaccgcggtcggacagttgcgagaccagtgcgcctaaggctgcggaaatgacggcgaaggcgatgccgaggatggcgtccttgcgtgcgtcggtggtgccgtcgggaagggtcgccttgcggccaacgctctgcttccacgccatctcgaacaccttgccgaacgccagtccgactagcgtaggcatggcgaatttgaagattttgtcaccgaaggaatcgggatcgttcagtctctgatcgcgcttggcgttcactttcccgtcgatgttgcgcagggccgctaccacacggtccgctgtagattccagatctggcgtttcactcatggttccatagtaatgcgtgatcgacgtgctttcctgccaatccggatgggcgaagcgcgtagcggaatgatgttgcgatttccgaagacacgagggagcaagtgcaggggttcatgggcggggtcggttagagtagggatatgactgaaaatcatgttggaagcaaggacgcttccgttgttgcgcccggacgcttggtgctgttgcgccacggacagacggtgtggagcgaatccggtcagcataccggacgcactgatattccattgaccgacaccggtcggctacaggccgaatccgcgggagaacgtttgcgttcggccttcccgaacggtttcgatccaggctgcatgttcgcaagtccgcttcgccgtgcccgccagaccgcggcgctcgccggttacggcgattacaggatcctgcccgagatcgccgaatgggattacggtcgcgccgaggggcgcacacgccagcaggtcagcgaggccagcggtttcgcctgggacgtatggcgggatggtccgcgttcgctgaaccccggacttgaaggcgattggattgagacattgccgtccggcgagcaggttccggtgcataacggtccgggcgaggacgtggaggaggccgccgcgcgtacccgggacgccatcgaacgagtattgccgttgctgaacgtcggccacgatgtgctgctggtggctcatgcgcatattctgcgcatccttacttcgcaatggttgggcgtcgacccgcatttcgcccgtctgctgcggctcgataccgcgcattactgcatcctgagccagtacaagggtgacaatgtcatagagcgttggaactgctgaagacatatcggatggaaggtcggttgcctaccggcatttgcagcagtctggcacaatcagccgtcataacggcggtatgacaatgatgtaaacgcattcagcatataatgagacaatcgccgtaagacggcgctaatcatatgcaaggagtgcgcatgcaggccaatatcgaagacgtggcgcagctggctggtgtctccatcgctacggtttcgcgtactttcaagcatcctgacgtggtagcgaagaagacacgtgacaaggttctggctgccgcaaatgaactgaatttttcgatctctcactccgtcactgtgtttcaggccgggcggacgtaccgtattgccctattgctgaacgatcgctttgcgtcatagttcaacgcacgaatttacgagggccttgatgcagtgttcaatccggccggttacgacatctccgtctaccccatctccaccaaggaagacaggcgcacttttttcgagaacctaccgattcgccgcaacgctgatgccgtaatcattccctccttcgacatagaccctgatgaggcgagtcgtttgcaaagtgcgaacctaccgcttgtcggcattaatgcattgcctgaaagcgcctttacgttgtctgtttccatcgacgatgagcaggcgatgcgactcgctacgcggtaccttaaacttttacacactggaatcacagtgatttatacattattagaatcatgtgcggcgtatccattcctgctggtttacattcgtttgcaattgtggataagaagtacggtgtcttctttaaccgtttcatttttgacaacgttggcagtatgatatacgtagatatgttcgcgcgcgcacaacgaatgtgtcgcgtgccgtgcaagacgagaagtagcaaaggggcatcatgaccaaagtaggcattcgtgaggtggccaaagcgtcaggcgtctccgtttccacggtgtcgcgagctttcacgcgtcctgacttggtatccgataaaacacgtcggaaggtgttggaaaccgccgacagacttgatttcaacatttcccgttccgccacggcactcaagtctggcctgacctatcgtgcggcgatgctgatgaatgaagacatcaccagttggttcaataacagggtgcttgctgggttggatgatgtcatgcatggtgctggctatgacatttcactgttccagcatatcgataccgctgagaaccgcgaacggttcttcaccactttgccggtacgtcgcaatgtggatgcagtattcgtcgcttccttcgccgtcgattcgcgtgaagttgagcagctcaagcgcattcgtgtgccgatcgttggtatcaatacgccgggacgtgaagatttcgatgccaccgtatgcattgacgacgacgagggcatgatgattgctacgcagcatctcatcaatctcggtcacaaatacatcgtgtacatctgctcgcgcgccgccgattcgcttaatgcctctatcgatgctcgtcgtcagggtttcatccatgcttgtcagaccgctgagacaagccacgacctgcactggaaggtgcttgaagtgccgcgcgatggtggctacgccgacagtgccttggcctcgttgttggcgcttgatcaattcccggatgcaatctgttgtcaaaccgacaccattgcgattccgctgattgtgcgactggaacggtatgacaagctcacgccgcgggattattcgattatcggatttgatgacagtcagtatgcggatatcatgaacctgactaccatgaaacaagatccgtttctgatgggccgtaaagccgcacataaagcgctcacactcattaatggggagactctcggtcagccgcatgaaatcatgcatgctcgcctgaccttacgtgagaccgacgcgccggtgcagttggtgttgcgtgacaatgaccgggcaatcaacgagtagcgaacctaaagggccatgcattggctgtcgctcactctgcaggaaatacgtcagttcgatgtaagcggtactgcatatcgatagtgttgtatgctgtgacgtcagcgacaactccatgctcatcatggcttacggcatcggcgcgattttcattgccgtgctgttcgtcatattctgatcttacatccggtgatgttgtcgctgtttgcactgttctagtccgctcatgtgacgatgaatgcgggcagtgtgcaaaacgtcgtagtgcaaacgtatgtcataaaacaatatccaaggatgcggattgttgacgtggtgtcgccataagcgccgcaacatgccgtttgttggtattgcaaacgatgtcaatctgcgatattctaaagatgagaaacattcctgttgcactatctgttcatgatagtgataacaggctcagggattcatatgattacgcagtctggcaatgatcagccagcaaaggagagcgaagatgccgaattcaccagtcgctgcacccagaaacgaagaaagcgccgaacgtcttgcacgtccgttgattcagctagccaaagccaacggtatttcgacatcatacatcgatcagttgggcgcttatgtggagattcgcgacgaagtactcgtctccgtactgcgggcgcttggcgtggatgcctccaccgatgaggcggttacgaaatcatatgaggcaactgtgcgtaagacccagactacgctggtgccgtcgaccattgttaaattcctcggtacgcctaccgccattccgattcgtccggcaggccggaacgttacattgcgcctgctgctggaagacggtaccgcctacgcaggcaatctggcgatgtgcctattagcagagaatgacggtacattgagattgaacctgccagatgatattccctctggctatcacacgttgcgtatcaatgctggcgacgcatatggcgaggcgacgctgatttgtgcacctgccagtattccggtcccgaaagcggtggccgataggcaacgttggggatggatggcgcagatgtattccgtacgttcctccgaatcgtggggtgtgggcgattacggtgatttgcgacacctcctcaaggacgctgcagaaaaaacgcatgccgactttatgctgatcaatccgattcacgcatgtgcgccgatcccgccgttggaaccttcgccgtacctgccggaatcccgtcgcttcctgaatgtcacgtatattcgtccgcaggatatcgccgaatacgctgatctaagtgaatccgataaggcggaggtggcgcgtctgcatgcgcaggtgtcggctgccaatgatgatgtgaatccgatggacatcaattccgcatggtgtcataaacgacaggcgctgaaaatcatcttcaggcaaccgcgttccgttgagcgtcagtctgccttcgaacggttcaaggagcaggccggtccggatttgaaagcgttcgctgcttggtctgtggcgttcgaggtgtggggtgcgccgtgggaaacttcctggtttaacgacaccaatcgtgactcgccggaagtggccgaacttatacgtgagcatgccgatttggttgaatttcagtgctggttgcagtggattgccgacgaacaagtgtcggcggctcagcagattgccaagaactccggtatggcattaggcttgatgcaggacatggccgtgggtgtgcattcgttaggtgcggatgtgtggtggaatccggaacgattcgctgtcggtagcgtgaccgtgggctgcccgcctgacttctacaaccaacaggggcaggattggggtcagccgccgttcaatccgaattatctgaacgccaccggttacggtgtgtaccgtgacatggtgcataccatgttcgctcacgccggtgcggtgcgtatcgaccatgtactcggcctgttccgcctatggtggattcctcagggcgaaggcgccaagaacggtgcctacgtgacatacaacgttgatgcgatgatagccatccttaccatcgaagcctcccgtgcggacggcctggtgatcggtgaggacttgggtacagtgccgaactatgtacgcaaggtgcttgcttcacatggtgtgcttggtaccgtggtggagtggttcgcacgagtggatgactctcccaacgcaggcgatccatacgatgatccgaccaactatcgcaagtatgcgttagcgtccgtcactacgcacgatctgccaccgaccgcagggtacctgcagttcgagcatgtacagttgcgtgagcggctccatctgcttaccgaatcggtggaatccttccaagcatcggccaccgcggaacgtcaggccatgctcaatcgtctgcggacacttggtctgatctccgatgaggaagctgacgatgcggacagccacatcccgcagattgttgaagccatgcacgccatgctgcgtaaatcaccatcgttgctaatacaggccgcactggttgatggcgtcggcgagcgtcgtacccagaaccagcctggaacgtccgatcagtatccgaattggcgtattccgctggctgatgagcatggacgtgtcgtgcacaccgacgaagtgttcgatttgccacgagtcaaatcgttagctgccatcatggatgcttgagacagaccgtttccttagcatagctgagtcaagagccgtcgcggcaatatgtgtcacgacggctcttgacatgattttaatagcaatttggttgccgagcgaccgccgccgatttcatcggaaaccaccgatggaaattcagcgtgcctagcagagcagttcaccagaaccgctctggttttgcgtaagatttcgggaggagttacctgccggtgcgcccaagatgaatgaatgatgctatctatctggtggtccatcttggattcaaaggcctgcggttcaacgtttttcaccattggtgtccacgatcagcagaatcataccttgatgccatgccccatcctgcgagcctcgaatgacttgtccggcatggggcgcgccatcgctgatgaagccaataagtttagagagcccactgacccaacccttcgccaatgcgttggggcgatatccaaattgttgtgcaaccttgcgtgctcggcttcttatggattctggaatgttgacctttgttgttcgccacccagggaacggtggccactgacactccggctgctctggccataatcttgaatcgtcactccgttcatgccatgtaacctacgcaacctgtcccagcaacccatcgcttagttcggtggccgcatgcgcagccgtggccagacgctgcgagacggagggccgagggagattcttgtgacagtaatgctcccgtgttgctgatgcttcattgggggggtaacacgggagcattcaatgtgtggattagagcagcatccagatggttgtgtcttggggcaattgcccgttggatacatcgccagacgccagtatgatctctccgtttggcagtgaagctggagtcttaccgaagttcgtataggaggcgaatgtgcgaccatcggcggcagggcgcgtgtaggcgattatctcatcgcctacgtcgattagagtgcaggaggtatccgccgtggcggtgagtatgtcctgacgtgcggcgagtgctgcgcgatacagcgacaacattgaatccggatcctgtgcttcgctgtcggcggtgaaattgccgtaccagagaggctgcggcaaatgggggcgttcggattgggtaccatccaccttggtgacgggggagaagccaaaggaggctccgtcgccaaaactctcattccaggaagccggcgtcggcttgtccgcggcgatccacggcatcggcacgcgacagccatcgcggcccttttcataataacgctgggtggtgaagtacggagttgggtcctcaagacgatcccaaggaatatctgctacctcgaacaggcccagttcctctccttgatacacatatacagaacctggtagcccggtttccatcatgatggcggcgcgggagcgcttggtgccgagttcacggtcttcaatataagaggtgccgtcgcgcagcaaccagtccttggctacctgatgatgactgggggtcttgatctgaggcagggcgtaacggctggcatgacgcggtacatcgtggttgctcatgacccacgtggtggtggagccgccggaatgtgtggctgaatccaagccctcctcgatggcggtacgcatctcggcggcgttccagttggcttcggcgaactcgaaattgaacacctgtcccagctcttcgggggaggcgtacagatgctgatgctccggtacgcaccaggcctcaccgacggcgaagcgtggcggatcgtactcgttgaacacttcgcgccactcgcggtagatgtcgtgcacttcaaaacgatcccaaatcgggttagtgccgtcatggcatagcgattcgtgaatcggatagcgtttgcccatctcttcaagtggcatgcattcaagatccttggctaggccgtgcgccacatcgatacggaagccatcagtgccatggtcggaccagaagcgtagcgttttcttgaattcctcgtgtacctccgggttcttccagttgaggtctggttgttccttggtgaagatatgtaggtaccattggccatcttccacacgctcccaggctgggccgccgaacagggagatccagtcattcggtggaagttcaccgttctcaccgcgtccctcgcggaagatgtagcggtcgcgttccttggagccgcgccccgcggcaagagcctctaggaacatccgatgcttgttggcggtgtggttgggtacgatgtcgacgattactttgatgccggcctcgtgagccctgagcgtcatctcgtcgaagtcgtccatggtgcctaggcgtgggtctacgtcacggtagtcgatcacgtcgtagccgccgtcggcgagttcggagggatagaacgggctcagccagacggcgtccacgccgagggcccgcagatagtccatcttctcggagacgccggcgatgtcgcccaagccatccccgtcggaatccttgaacgatcgtggatagacctgatatacaacggcctgcttccaccaatccgcacgttcattattcgcggtcatgatgttgtccttacgtctttgtcccgatatgtccctgttctagtgattgttcgcctatgaacagctaatgacaacgatatcaccaatggtgccaatgcatcacgggtgtgttgtgattacgttgtcacggacatggcggagtcttggtaagattgaacacaacgttggcggtcatggccttgcacaaaggagcgatatgaaattcctgtcacctgattcaggtctcatgcgcggttggaacaatctgaccgacggtgtgtggatcaatattctcatgcttgtcaccagcattccgcttgtgactgtcggtgccgcgctgaccgccggccacgacgctgctcgcaagacgcttgcgggagagggacacgtcaccaccaattatttcagatcattcaaaagtaattttgtgaagtccacggtgcagtggctaatcttcggtgtggcgctggcagtgctgtcctacgcgtgggtcgttctgcagattgtaccgttgctaattccaaaattcggtttcaccatcgtatggatcatgggcttcgaatgggtctgggcgttacaggctcgtttcgaaaatagccttggtggcaccctcgccaatgcattcatcttcggcgtgactaatgtcgcgtcgaccatcgcgctggcgataatcgatgttgcgttcctagggctgattgtcggctcttggttctacatgccgcagggtctgtttttgctggtggtgcttgggtatggcagcgtgcttatgcttcacgtcccgattctcgaacatgcgttcgccaaatacgtcaacaagccggagtctgatggtcgggggacggtatggcgaaagtaacgttgcaagacgttgccaaagcggccggcgtctctatcgcgactgcttcatgggcggtgaatgacaatcgtaatgtgcgtatcccggaatccacgcgccgcaaagtccgtaaggccgccgattcgctcggttaccatcacaatgcattggctcgggggttggcccgtggctgttccgacatcataggcttcatcagcgacggtgtggctacctctccgttcgcggggcaggtaatccaaggtgcgcaggatgaggcttggcgtaacgggaagattctgctggtggttaacaccaacggtaaaaaagatgtggaacgtaagactttcgcgttcatgcttgagcatcaggtcgaaggcgtcatctactcgaagtgggttcatgaatcaattacgccaccgagcgaactcgataaggtgccggcggtgttggtgaactgctatgacgaacgcggccgatttcctgctgtggtgccgaacgaagttcagggtggggccacagccacgcgactattgcttgaggccggacatcggcgtatcgcgttcgttaacgccattacgccctcgcctgcgtcgcttggccgacttgaaggatacaaagcggcgcttgcggcattcggcatcgattttgattcgtcactggtggtacctgcgaacgctgaccaagaaggtggatacggggcagcggaaaaggtgatggcgacggatgcgaccgcagtgttttgccataatgaccgcactgcgcttggtttgtacgatgcgttgcgtgagttaggtaaacgtgtgccggatgatatctccgtggttgggttcgataatcaggaaatgatttccgcgcacatgcatcccgcgctgaccaccgtgggtctgccacaatatgagctcggtgtgatgggcgtgcgaacgttgttgcggcagtgcggccgcaatgaggatgatggtgatgaacatgtagtgacgaggacgttcgagccgatttttgtgcaatgtccggcggtatctagggattcggtgaagaggttgtagcatggtcgtcgtagtgctgcgacactcgtggaaacactcacgaaacggtggaaaaacggcattgtgcaaggtgactgcgtcaatcgtttgacattttgattttaagtgctatatttgtgcttaatcgcttaaacagtttaagcgcttaaactgaataatgcgaagtaatactggttccttcaaaaggtaatcgcagacgattgccgggcgaaaggcaaagcagctgaagaaaggtaaagatatgaagctttattaccagttccctggcacttggttcggtgactgcatgccatttggcaagggcgacgaattcttcctgttccaccagcgggacaatcgcaacccggagccgttcggagagccgttcggctgggatcttgccacaaccaaagatttcgtaaactacgagaatcatggagtggcaatcccccgtggtgcatatgacgcacaggatcaattcatcttcgcgggctcggtgtttgagggcgagggccagtaccacatcttctacaccggctataaccgcgattatcccgcacagggcaggcctgcgcaggtgctcatgcatgcggtcagtgacgacctgtaccactggaccaaaacacaggatgctatcacctttacgccgcaagagggctatgaccctgatgactggcgtgacccgtgggtcattcgggacgaagaacatgaccagtatctgctgattcttggtgcccgtaaaatcggtccgaaaacctgccagaccggccgtaccgtgaagttcacctctaaggatctcaaggactggaaatttgagggtgatttctgggctccaaacctgtacaccatgcacgaaatgcccgacctgttcaagatgggcgactggtggtaccacatcgtcaccgaatacagcgacaagcacaagatggtctatcgtatggccaagagccttgacggcccatggattgcaccgtcggacgatgcattcgacggcagtgcctactatgccggccgtaccttcgaactgaatggccaacgcatcctgtttggctgggtcggcaccaaagagaagtgcgatgacaggagcaacttcgaatgggccggaactttcgtggcgcacgaggtgtatcagcgcgaagacggcacgctcggtgtgcgcattcccgataccgtgtggaatgcattcaatgagcgcgagaatgtcggcaatgtgaccatcgatggtactggtgcgcgacaggaggcggtactcgcccttggctgcggtgatttgttctcgttcgaagccgacatcaccttctcagaaggaactcgctccttcggcctgcgtgtcaacgagaacgaagataccgcgctgggataccagttcatcttccccgtagctgaaaatcgctatgtgttcgaaggcagtccgaacttcccatggtttaatgtcatgaacatcgggcttgagcgacctatcaagctcgaggcaggccgtaactatcatctgcaactcatcgtcgatgacactatcggcacgttgtatgtggatggagtggcactgaacgtgcgcatgtatgagcgccccggcgagtcgctgagcattttcgccaccgacggcgtcgttgaggtgcgcaatgtctccatcgctcgcggattgaaggaggtctgaccaatctgatttctttttgactgattacgggtcgtcgaggtcgtttcgtaccttcttttcgcctcggcggctctccttgcggcttttcctctcatttttgcttaagcgattaaactatacttcggtaccacatatcgcacgatgcacgacgtttgtcatcatctgacgacgctgtcagaatcattattttttggaggagatcatgaagaaactcactcgtaccattgccgcagtgtcggcgctcgccatgtccgttggtgcgctctccgcatgcggcggctcaaatgtcaacgctgacaaagggcatgtatattttctcagcatgaaggtggaacaacaggaccagttcaaggaactggccgaaaagttcaccaagaagaccggtatccaggtcgatatcgccactgcgtcatccgacacctacgaacagtcgcttaagagtgagctggccaaatccgaggcgcctacgttgttcgatgtcgacaacaacgactttctgaattggactgattattatgccgacatgtcgggaaccaacatctacaaggatcaggagaaccccgactatgcgctgaaggatggcgatacggttggtgctgtgccctacgtcatggaacgatatggcatcatctacaacaagaagctgctgcagaagtacttcgattcttcctgggcaagcattaagtcggttgacagcatcaacaatttcaagacactgaagacagttgccgatgaaatacaagcacataaggatgagatgggcgtgaaaggtgcgttcacctccgccggcttcgacaccagctccatcaaacgtttcggtgatcaactggcgcatatctccgtctactatgagtatcgcgatcagggtgtcacgcaaatgccggccaccatttccgacaagtacgtatcgaacttcaagaacattttcgacctgtacatcaacgacgccacgattccgaagacgcagctcgccagtgccaccatggacgacgccaactccgagttcgcactgggtgaggccgtgttcttgcagaatggctcttggggctattcgcagattcgcgatcaagaggtcgccgatgaagatatgggcgtattgccgatctatatgggtgtgaagggtgaggagaatgcaggcctgaccgtgagcttcctgtactttgcgatgaacaagaacgcctctgaaaaagatcagaaggccaccaagcagttccttgactacatcctgaacgatgatgaggcacgtgacatcatcacgaatgaggcgggtttcgaaacaccgtttaagtcgtatgcgaaggccggctaccagaccaagaacccgattcatcgcgccaacgatgcctatgccaaggcagataagtacgatattgtgatctatccgttgccaagcactcagtgggtgttgacgctgggcaacgcgatgttggaatatgcgcaggagaccggtacatgggacaccgtgcatgatgcatttgtggatggttgggcgtctgaatataagaccactcattgagcgcaatagagtctcatcgaatgcgcaaacggggcttggcggtttatctgccaagccccgtttgcgtattacgatataggactagtcaggttgagcttcaccggtaccgcgaagatttgccatgctgaacctcaccgtaatgcgtatgtgttcatctggcttggtgcagggcctttaaccactacactcaaaccttctttgctgagggggcgcataccataggcaggctgaagggccggagtgtcgatgatgagtaggtcatcctgcagggtcttggtgaattgctggtcggattccggtcgtgatgtcatgactatctgcgtgtcgtggttttcgaaaatgccatcttcctgccattccggacagaattagagattcgatgatgatgccgatgcgccaaggtcactctgaatggtgatttcggattcatagccggttgggcagtcagttacagcatatgtgccatagagaaccctttggcgaggtagtagtggcttggtcagtcgatgaatgcggtggtttcacgcatcatgagttgtgcctgtagtgtttcatgcagcggtttcggtgtttttccggacatgacactcagcatcttacgtgcggcgttttcgcccatgttgaacggatcctgatgcaacgtggtcaggccgatctttgcggcaagtggtacgtcgtcgaatccgatgaccgagagctcttgagggacggcgtgcccgtactggcacaacttatagatgacaggcaatgccagctcgtcactttcgcaatacagtgcggtgggggcggggtccatggtcagcaatgaattgagaatagtgttggtggcgtcttcatagttgcggattgcgatgcgttccaccgttatctttcgctcttcggcagtttccatcagcccatgcagacgcgcttctgcgctgaagaccatgttctggttattgtcatttgatgtctcgtacgcataagcgatacgtcggtggcccatggagaacaagtgcttcacagcaacatgcatggcctgacggtcgtcgatactcaccgtggcattgaatccgttgattgatggaatgttgatgccgacgatcggtaccttcatgttcgaaagtttttcgacctcttcgggcacgatgttgaaggagtttacgatgaccgcgtcgacgttgcggcgtaccggcaacgttgcgaagaactcatggcggtcgtgcgcgtcggccatctcgaagatggaaatgtcatatccggccgggtgcagcacggaatccaatccggcataggtattggaattgaaccaagtcgaaatcgaatcgctcatcaacagcgcgacgcggaacgattgaccggttttcagtgcggccgctgagcgggagatgcggtagtcaagtttttccgcggctgccatcactttgctgcgagtctccggcagcaccagattcggtttggcgaatgtgcgagagacggtcgaaatcgatactcccgcttcggcggccacggcttggatgctcgctttcatagagaatcctccactgacgaacgacattgctgtcatgacaactgctagagacacgttaacataagtgtttgcaacggttgacgtgcgtgttctgcggatatgaagaaaaggggtgccgacgaaaattccgacagcacccctcatgcgatgaagttaatcagcctttgacagcgccggccatcacgcccttgatgatgtacttctggcagcacaggtagaatatgatgatcggcacaatcgccaccaccaagcaggccatcatggcgcccatgtccactgatccataaccacccttgaggtactgaatcgcaatcgacatcgtcttgaaacggcgcatgtccaacgtcaggtacggcagcaggaagtcattccagatccacatcgtctgcaggatcgccactgaaatcaggctcgggcgcatgataggcagtacgatttggaagaagattctcggtaccgacgcgccgtcgatcatcgcagactcctcgagttcggacgggatgcccttgaccacgccagtgaagatgaacacggctaagcccgcaccgaagcctagatacacaatccacaggccccatggggtgttcaggcccatcatgtcggcgagcttggaaagcgtgaacatgaccatctggaacggaacaatcatgttaaacaggaacagtgtgtacagcaggcgcgcagcccagttgttcgtacgtacaatccaccaagcgcacatcgacgtgcacacgatgatcagcaggaccgcgccgaccgtgacgactacggtccagccaaaactgctgattaggttcgtgcgctcgatgcctctgatgtagttctccagtcccacgaaggccttgccggtgggcagggagaatgcgttgcgcgagatgtaagccttctgcttgaagctattgatcagcaccagcacgattggatagacccatgccagcgagacgatggaaaggaaaaccgtccagaatacaggatgcttgaccttgtcgctcatgcttggacctccttgctggtggtgagcttgttctggatgagggcaatcacggccacgatgatgaagaacaccacggccttggcctggcccacgccctcgaagccggcgcgtccgtagaacgtgcggtagatgttcagagccaagagctcggagctatttgacggggcgccattggtcagggcgaggttctggtcgaacatcttgaagccgttggtcaccgtcaagaatgtgcacactgtgattgacggcatcatcaatggaatcgtcacgttgaacagcgtctggcgggagttcgcgccgtcaaccgcggcagcctcgatcacatcgccgggcaggccctgcagacccgcgatgtagatgatcatcatgtaaccgatttgctgccagcaggtcagcagaaccatgccccagaagccgtacacgcccgagaatgtgatcgaacgaccccagtgcgccagtacgccgttgagcagcagtagccagatatagcccaagatgatgccgccgattaggttcggcatgaagaacaccgaacggaacagcgtggagcccttgatggccttggtcagcatgtacgcaatggcgaacgcgactacgttgatcaccacggttgtcacaatcgtgaacaggaccgtgtacaccagcgcgtgcaggaactccggatccgtgattatgttttggtagttcgacacgcccacgaacgtggcgtcagtgaccgtgctgaacttgcagaacgacaggtacacgcccatggcgaacggcaccaggaaaccaatgacgaaagccgcgaacgtgggtagcgcaaacagcgcccaccacctgcgaattgccttgccggacatcgtaatcatttcatgcccactttctcctccttgggtacacccggggaacacccctcgagtgattcaacgacagttcgaccgtgaccgcaacgtcgggttcgaaccggttcgagaataccctacttcacagataaataaaagtcaaacgttgtcatgattttcatgcaacgtcaattcatttatcaaatgtgaacagttatcagtatacggatacccttggaaataagcaagaaatacgtattgtcgtgtcgttgcaaacgtttggatattttttgcaaaacacgttgtgtcttgtagtatctactgccataaaggagttgtgcatgtcagtcaatattcaagacgttgccaaagcggcaaaggtgtcggtttccacggtgtccagatcattcacccgacctgagctcgtatctgaggcgacacggtccagggtgttgcgcatcgccgacgagatgagtttctccatctcccgttcggccactgcgctcaagtccggcaaagcattgcgtgtcgccttgctgatgagcgaccatatccgactatggttcagcgcttccgtcatcgaagggttgaaccaggttttgcacgcagacggctatgatttatcgatcttccagatctccagtatcgaggaacgccgtgagttctttgatatgctgccggttcgtcgcaatgccgacgcggtgatcgttgcttccatcgatgtcgatgcgcaggaaagcgcacagctggccagcaccggcgtaccaattatcggcatcaactgtgtgaatccaagagaatacggtttcactgcggccgtggggatagacgatgatcaaggttcgcgtctggttgcgcgccatcttatcgggctggggcatcgcaacattgtctacgtacgtacgtcgcgtgaggtttccttgcacttcagtgtgcagcaacgttatgactccttcgtcaaggcctgtctggaacagggtgtcacgccaactacgttggttgcgcaggaaagtgaggaccgcattagcacgattgtctccgagttgctgagcttgccgcaaatgccaaccgccatcgcttgtcaggaggacggcatcgcgattccactgatttatcagcttgtgcgttgtggctaccgtattccgtctgatatttccgtcatcggctatgacgacagcttctatgcgcacgatatcggcttgaccacgattcgccaggatccgattggcatggcacacgaggcggcttgtaagactcttgacttgatcaatcgcaagaccacgggtatgccgtttcagacgtttccggcgcaactgatcgttcgctccagcacttcgcgagtgtccttggataagggctaatcgcttaccgatacatagaaaaccgctccggttggttccggagcggttttctataaggagagaatcagacagtgaagtcaattgcggtcacttgtgggcgttggcatattccttggcccagccatccacgaacgcggacttgacgccatcccaattgccggtgccttgggcatactcgagcaaagcggagccgaggtcgttcttccattgttcggacggcatcatggtgaagttccaagacactgcggtggtaccggacttttggtcgtccatggcgtcagtgaccagcgggttgtcggatttgacgctggagaaggtcttgaacggggtggtgaagcccatcttctgagacagcgcttctttgcccttatcggaggtgatgacccacttcaggaagtcggcggtcgctttctgattggccttggatgctttcgaattaatgcaccagtaattctcggagccggttgccagaccttggttctcctcgcccttggcgccgatgtagattggcatcataccaacggaatcggcctccatgccggctttctgcaaatcggaccatgcccaagtgccgttttgatagaaagcggcctcgccgagtgcgaattcggaattggcgtcgtcaccagtcttggagcttagttgggacggctcggtggtggaatcggtgatgtacaggtcaaagatgttcttgtactccggcagataggttcccttgatagtggccggctgttcagtgatgttgtcatctttgaactcatagtaaagaggcaggttggctagatgggtcttgaaacgccaatcggagctggagtcgaaaccagcagaggtgaaggcgcccttaatgccgagttcatccttcttggactgcatgtcgtcagcaacggccttcagcttactaaaggagttgatgtctttgatggacttggccttggcgccggaagtgctgaagtatttgttaaggatgtctttgttgtagattaggccataagtctccatgacgtacggtacgccaacgaccttgtcgccatccttgagggcaacatcttggttctgcagttgcttgtatacctctgtgccggacatgtcagcagtgtagttcttccagttggcgtaaccgaccggaccgttgacttggaacagggtcggtgcctcggacttagccatctcgctcttgagctgctgctcataggtattggaggccgcggtctgaacgttgacctcgacaccggtttccttagtgtactccgcagccaaatcggcccactcgtcggcggcttctggtttgaaattgaggtagtataccttgcccttgcttgaatcagagctcgatgagctgccacaagcggcaaatgtcgtgacagacatggcggtgaccgcaatgagggctagtgcggacttcaatttacgattcatcttcgaaccttccttttctgcatcgggtccaacgtccccgttggatatgtgcactgagatagtgctgctttctgccgatgcccctattatgcatcactttcatcttttttgcaaacgatggcagtattttgttgatttatcacgttgcaataccgggcaatccgctatttgctgccatttttaggcataaaattaggcgacacactatgcaagcgtttgctaaaaaagttgtacatcaaacgattgactgtagcaaaaagccgcatcccctgagagacaagggatgcggcttgaggtgagctacttatggatgacgtcagcgcggccagcgttcctcggcgctaggtagttgcggaaatggagcgtgtggccccttctggtaccagtaggcaactgatgccacatcatcctgacgttcgaagaatccgcggtgaccaacaccgatttgctgaacggtcaccttcaggttggaacggaaacgaatcggatcggggatgtgccaacggtagaagccacgcatcggggggcaatcatcattgtgataatcgttgtgaatcagctcgtcgtgtgaagagtaatacgggtatccgagatacggtgtgcagtagttttgctccacggtcttgccattgacctgcttggcgaagctccaagagcctccgaaatagtcctcggtgccggtgccgcagatcgtggggtactcttcatcgtcatcgatgtagaatttgaattcgccttcaccccaccagtagcgctcaagcgtggtcagtgccaggtaggtacctacataatgcccttcacctttcacgccatcaagcaccacatagtctctccccttttcagtaaggcgctggcgccgccattgtgcgtggaaataggcaatgtcatcgtcgaacggctcgtcattcacggtgtagtcaatctggtagaaaaatgcgctgatggcgttcttgtgttggttttcgagcgtgatgcgtgcgcgtgcgccgaacggcatcgaaaagtacatgttgaaaccgcggttcggcactacggcgacaggcatggaatttactaggcacgcacggccgaatccgcagcaaaagaagtcaccaagcggacactccacacttggttcctcctcgtcatcccaatagaagcgcagcacaaggtcccgcagtacaaaacaatcggcatcggtggtcttctcgtcaacggttatccagatgtgtcgaatgcagccggggccggtgatatcagcaagagtcgccgttgcgccgacgggtatgttacgtaggcaagggctgcctttgcgacttgggccaagctcactggccgctatgccgcctttgcccggttcgccggtcgggttttccgcgttgactgcgcggcttgattcgtgccgtatcttggtcaaggattctagtgtcatgttcgttcctttcatggcgtatgctgcgtctgtttgcgcgatacattcatatctgtgcgtatcagcttcggtcacagacgttgtttgttttttgaatatgagaaagtctccatcggcgagcgagaaagccgatggagactgtggtcatgccgttatggaccaggtgaaaatggcgttatgcgattcaccgcggcccataggcgaatcacttgtgggccggcggaagcatgccgaagttgttttcataatcattccaggcgctggtccaatcgtccagatatgccttcttcacgccattccagtcaccggtgccctgagcgtactcgagcagtgcattggccacgccgtcagcccatgcctgtcccggaatataggcgccatgaattggagtgaggccatcggactcaagcttgagcgcagacttggtcagcgggttgtcaggctggaaatcctcggagtcaaaggtggtgaacggaacggcgaagcccatatccttggagagaatcttcttggcatcctcgtcggagaccatccacttgatgaaatcctcagtggccttcttgtccttgtcggaagcgttcttgttcacagaccaggagatgtcatagatggagttcgcggcgtacttgctctcattcgggaaacccatgtagtacggcagcatggccaagtcttcatcggcaacttcgttgcctttgatctggctataggcccatacaccattcgggtagaaagcgaccttgccggcggagaactcggcggtggagtcctcataattcaccgagccaagcatggtgttttcggtcgggttgtccttcatctcgagatcccacagattcttgtagttatcgagataggtgcccttgagttccttctcgaagtccacgccctcgtcaatgtactcgtaggcgactggcacctgagtcatatgcgaagcatatcggtagtagttggatgagtccagacccggcgtggagaacgcgccgtcgatgcccaaatcatccttatgctgttgcatgctgtcggcgaccttcttcaaagtgttgtagtccttgatgtcgtcgaaggacttgatgacggcgtagtcctttttggcatactcgttgatgagcttcttgttgacgatgataccgaaccattcggcggcatatggcaggccgtacacgttgtcgccgtccttgtgggccatctgcttgccctgatcgttgagaagcttgtaagcctcagtatcctgcaaaggttcgaggtagtccttatatttggcatactgatcgaagccgccgataccgaacatggtcggggcgttgttcttagcgagttcggacgacagagtggactcgtagctgccggaggtggcgctctgaatatccactttcacgccggtttgcttggtgtacatttcggcgagttcgttccactgattgacaacttccggcttgttgttcaggaaatagacatgtcctttgtcgtccgcggtgttggaaccgcaggcgccgacgcccgtcaacatggccaacgcgccgacagcggcgatgcctttcgtgagattcttcatggggtttcctttcctccttgcgaccttccttcgtcggaaatcacttgtcaaggtcatatgcgggccctctcttgcctgatacaatctgaccgtggcctgattcttgcagacggtcatcgtctgtgtcgaaccggtccgagattgattgtatcgaaccggttcgctactgtcaaagtcggagggtttatgcgtgttggcgtattttttgttgccgtattgcgacatgtgtcgagactttgccgatacaagtagacgctctttttgggagcaatagtggcttcggacatgcccaatagtagatggccattatcctctgcgtgcgactgcagcaacatcgggcgtgatagcggaagatggaaggagggttgcgtcatggggacgatatgactgaaaatgatgggcaggatcgcctattcgggccgaatccgagtgggctggatgaatcgcctcacggcatgatggtgctggtgattgtcggcatgatcgtcggcctgttgtccggcatgttcggcatcggcggcggtacggtgatcgtgcccgcactggtgtggctcggactgtcgcaacgccatgcggcggcgacctccatgctggcgatcgtaccgacgtcgatttccggtgtgatttcctatgcgcacaatggcaacgtcgactgggtcgcggccgcgctgctgagcaacgcgcaatcctgctacgcccgtgccgaactggaaatgacgggacttgccggcgtgcttgacgatgtgatcatctccagcgaggagaagatccgcaagcccgcgcgcgacttgtacatgctggcgctcgaccgcgaattcgtgaccgccaagcatgcgctgatggtgggcaatgacgagcagaacgatattgttggcgctcgcaccgcgggcattgacggcgtgtatttccgcacggagatttcgccggcagatgatccggaaacgtcgagctatgcggtgcgttcgtttaccggcgccgattatgagggattgctggattacgtgctgaacgcataagcctgcgtggtgcatgggttttgacaacgtttgcagtataataaaaaacagattgagagggcgttgttgctccaaataccctcgtacttgccatttttgattcacggtactagtgcaggggtatttgcatatgcagcccgctgctgtctgttgtcgccgtctgcgcgaatcccgttccgcgtctgcatcaccccggaatcgctcccaaatccgacttgtgcagacggaggacttgaattgtgtgaacgtaaggaagtcttggaatggcgttactttccgagcatccagtcgattgcgttggcaacggtcacgccgtcgcttttgccgagtccgaaacgatctagcgtcagcaccattcttttcgcagacaaatcgcgtgcattcagcagtggtgacagttcgcgctcgcgagtgtgctcgtccaatatgctggcgctcacctggatatacagtttctcttccgtaagatctgcatgtttccgagtcgcaacaaaatcaatttcagctttaccgattttcccgacgcgaatctgatatccgcgaatcttaagctcattatgtacggcattttccagaagaaatccgaaatcttctatggaatatccgagcagcatattgcgaattcctaaatctgctggataatacttagctaatccttgtaaatatgcgccacctttaacgttaattcgttgcgcattgtagaaaagaaaagcattgagaagtccactaatatatcgttcgatggtctcatttgaagctggtcgatgcgcgcttctcaatcgattttctatcttcgaagttgagactggagatcctgcggtatctgccaaatatcgtgcgacatcgttgaaaactagtggatttcttacttgcagaaattgcgaaatatctcgcaccaaaatagtgtcgtaaattccggaaagcacggtgtatgccaggttttgatcggtgccttgattcacgaccggcggcaatcctccatatcttgtgtacctttcgaaggccgcgttctcgtcggtcagatcggcgtacgccatgaattccgcgaaagaaagcggaaatacattgatctccatgtatctgccggaaagcagcgttgccagctggctggaaagcaggtaggcgttcgatccagtgatggtgatgtccacgtcggcatccgtgtggagcgcgttcacggctcgctcccacttgtccaccagttgcacctcgtcgagcagcagataatagtggtcgtcttgctgcatacggtcggcgatcgcgttgtgcaggtcttcgaaggtgaatgacgagtattggaacgattccaggttcatcatgatgatgtggtcttcggcgatgccctgctgcagaagatgctgtcggaagagtgtgagtagtgatgattttccgcagcggcgcatgcccgtgatgactttgatgaggctgttgtcttgcgccgcgacgagtttgctgaggtactgcggcctgggtttaagtttcatgatgttcaacttttgctagtgtatccggaaaagtatgtattctaatgcgactttcactagtatacctttaaaagtgtgctctgagatacgacttttactagtatgaccggaaaagtgtgtgccataatatgacttttgccggtatggctggaaaagtacggccgtacggttgtgggctggggggggtagggtgaactcgcgcaggctgctcgtgcgcgggcatcgcataccgaatccgaagcaatgtgcgcgtgcaaacgggtgcatgtaacgttgggcaaatcttggcatgggagggggctttttctcttcttgctttctcgcaatgtgccgggtttgcggtgctgaaatgtgcgggaatgtactatcgcaactatcgcaattatcgcaagatgaagaaagtgcgatggtaggggagagatgaagaaatcggatatttccaatatttcgaatgctgaaagtgttgaacgcgctgaagaaagtgtgcgatcgagtgtgcagccgagcgggaaattcggcgagaaagcggatcggctatttggtgcggatcctgtgggactcgacgaatccgcgcgaggcattgcggtgctggtgatcgtcggcgtggcagtggggctattgtccggaatgttcggtatcggtggcggcacggtgatcgtgcccgcgctggtatggctcggcttgacgcaacgcaatgcggcggcgacgtcaatgcttgcgatcgtaccgacctcgatttccggcgtcatttcgtacgcgacttgcggaaacgtggactggctcgccgcgctgctgctgttttgcggcatgttcgtaggcgggcagattggcagttggttgctttcgcgattgccggaactcgtattgcggtggattttcgtagtgttcctcgtgtttgtggtgttgaaccagataagtttcgtgccgtcgcgagaccagcacattacgatgagcgtgctgaccggagtctgcctggtgctgctgggcgtggtgattggcatcttggcgggactgctggggattggcggcggggcgctcgccgtgcccgcactgtcgatgctgttcaacgcttctgatctgattgcgcgaggcacgtcgctgctggccatgttcccgaactcgatcaccacgagcgtggcaaacctgaagcgcaagctggtgcatgtgaaggccgcgctgattattggcttggtagctgccgttaccgcgccattcggcacatggattgcgggcgcggtgtcgccccgcgtcggctcgatcatgttcgccatctacctgtgcgtgctcctgatccgcagcttcttcgtagctgtcaaggccactcgttccgcccgcgcctctgcctgaccgtttgcacttcatgcgggaaaagcatgagtcataattcagcatttagggggtattggggatgatggttgacggaaagaggatttgagataagtgttcactttgtgaagacgagagttcatattgtgttcgtctaaaacgcctcggaagttggtttgcggaacctagcgtgggaatcgcaatacagcacaggctgaagaaagaagaacaagatgagcaatcgaaaggctctcaagggagcgattgcagcaatcgcttccgttgcaacgctcggcgcactcgcggcaccggcgctcgctgacgaaaccaccacctacaacctgaacggcaagtccgttgcggaactggctcagcatggcggcgcacagcgcattgctgccatcggcaacggcaacgccaagaacgtcatcctgttcatcggtgacggcatgggcgattccgaaatcaccgtcgcccgcgattatctcaagggtgcgaacggccacttcgaaggcctcgatgcagtcggccagtcggcagaactcggcgacaccaacgccggcaccggccagtacaccaccttctcgctgggcggcaacagcggcgacagcgcagtcggcaagaactccgacggcagcctcaacgccaacccgaacccgggcaagctcaccgcagtgaccgattcctccgcatccggctccgcatgggcaaccggcaccaagacctacaacaacgccgtggacgttgacgtgtacggcaacccgcagctcaacctgttcgaactcgccaaagcggcgggcaaggccaccggcaatgtgaccaccgccgaaatccaggacgccaccccggccgtgctcgaatcgcactccaccgagcgtggctgctacggcccacagggcaagaccgacggcagctccaacgacgcgctcaagcgctgcctcgccaaccagctcaaggaaaacggcggcatcggttccatttccgagcagctgctcgatacccgcgctgacgtgaccatcggcggcggctccaagtacttccgccagaccgtgcagggcggcgaatacgctggcaagaccgtgtgggagcaggccaaggaaatgggctaccagaccgtcgaaaacgattcggccgcaatgaacgcgctcgaatacaaggagggccaaccggtgctcgccctgatgagcgacggcaacatgcctaccaagttcaacccgtccaaggccaccgcgcaggatccggccaaggacgccaacccgaccgtgtgcactatgaacgacaagtggctcggcaaccagggctcctcgctcaaggacatgaccaagaaggcgctcgatctgctcgaagccaacccggccagcgacgcgaatggctacttcctgcaggttgagggcgcttccatcgacaagcaggaccacgctggcaacgcttgcggccagatcggtgaaaccgacgatttcgatcaggccatcgcctacgccatgaagaacgttgacctgaccaacaccctcgtgatcgtcaccgccgaccacgcccacacttcccagatcctcaacgctcagccggcctacgcactctccaccgtgctcaagaccgctgacggcaacaatatggtcgtctcctacggcaccgctgaagccgactcccgcgatgaggacggcggctacaacggcggcgacatggctcacaccggcacccagctgcgcatcgccgcttccggccctggcgcccagcgcgtgattggcctgaccgaccagaccgacaacttctacaccatcgccaacaccctcggccttgcctccacctccgacgatcagaagtcgctctccaacgacgccaagaccgaagtgaagctcaccgacggcaagtatgtggccgaatccaccggattcaacggcgacgcagtgctctcctatgagcttaaggacaagtccggcaacgttctcgccgcttccgacagctccactccggtttccggcgtgcgcgtcaagaccgctcagaccaccagcatcgcgctcgacaaagttgctgaaggcaacgagtacacgctcaccgtcaccggccgccagtccggcaagaccgtgaccgtcgacttccaagctccggcccgcgattcctcagatgagaagccgggtgacggtaagaatgacgtgatcgcttccggcaaggtgagcaacaatccgaagtccggtgtgctcggcaacaccggtgccgcgatcaccatcgccgcacttgcgatcgccatgctggccgcaatcgcgatgatcgtcaagaccgccaagatcagccgctgaaaatctgaagtggtctgaagatcgcagattggatccggatcgcacgcgtcgcagtgtgatccggatcttttatctcaccgtacgatcgggtttgatggcgatctcaccttgaaatcgtgtcttgagattgcgcttaagattgcacccggcaaaaagttgagctctcttcgctcaacttttttgtagatttgggaataatcgcttgcgattcaaagttgagtggtgtaggctcaagttttggaaagttcgagagacggaaaaccgaaactcgggcgaaagaacgaacagaacagaaaacgcatagcgaacctatctacaaaggagacaagttatgggacgcgcagttggcatcgatctgggtactactaattcctgcatcgcaactcttgaaggtggccagcccaccgttatcgtgaacgctgaaggcgctcgcaccacgccgtccgtcgtggcattcagcaagtccggcgagatcctcgtcggcgaagtcgccaagcgtcaggccgtgaccaacgtcgaccgcaccatcagctccgtcaagcgccacatgggcaccgactggaccgttgaaatcgacggcaagaagtggactccgcaggagatctccgcacaggtgctgatgaagctgaagcgcgacgccgaagcctatctcggcgaaccggtcaccgacgccgtgatcacctgcccggcatacttcaacgacgctcagcgtcaggccaccaaggacgccggcaccatcgcaggcctgaacgtgctgcgtatcatcaacgagccgaccgcggccgcactggcctacggcctcgaaaagggcaaggaagacgaaaccatcctggtcttcgatctcggtggcggcaccttcgatgtgtccctgctggagatcggcaaggacgacgacagcttctccaccattcaggtgcaggccaccaacggcgacaaccacctgggcggcgacgattgggatcagaagatcatcgactggctcgtcggcgaagtcaagaacaagtacggcatcgacctgagcaaggacaagatcgccctgcagcgcctgaaggaagccgcagagcaggccaagaaggagctgagctcctcctcgagcacctccatctccatgcagtacctggccatgacccctgacggtactccggtgcacttggacgaaaccctgacccgtgcccacttcgagagcatgacctccgacctgctgggtcgctgccgcaccccgttcaacaacgtgctgcacgacgctggcatcggtgtttccgacatcgaccacgtggtgctcgtcggcggttccacccgtatgccggccgtcaaggagctcgtcaaggagcttaccggcggtaaggaagccaaccagtccgtgaacccggatgaagtcgtggccgtcggcgcagccgtgcagtccggcgtcatcaagggcgaccgcaaggacgtgctgctcatcgacgtgaccccgctgtccctcggcatcgagaccaagggtggcatcatgaccaagctcatcgaccgcaacaccgccattccgaccaagcgttccgaggtcttctccaccgctgaagacaaccagccgtccgtgcttatccaggtctatcagggcgagcgtgagttcgctcgcgataacaagccgctgggcaccttcgagctgaccggcatcgctccggctccgcgtggcgttccgcagatcgaggtcaccttcgatatcgacgccaacggcatcgtgcacgtgtccgccaaggacaagggcaccggcaaggaacagtccatgaccatcaccggcggttccggcctgggcaaggacgaaatcgaccgcatggtcaaggaagccgaagctcacgaagccgaagacaagaagcgcaaggaagacgccgaaacccgcaaccaggccgaatccttcgcctatcagaccgagaagctcgtcaacgacaataaagacaagctctccgacgatgtggccaaggaagtcaccgataaggtcaacgagctcaaggaagccctgaagggtgaggacattgagaagatcaagtccgcccagagcgagctgatgacctccgcccagaagatcggccaggccctctacgcacagcagggtgccgccgacgctgcaggtgccgcaggcgccgccggttccgctcccgctgacgacgacgtggttgacgccgaagtcgtggacgatgacgacaaggacaacaagtaatcatgtccgacttcaacaaggacgaatatctgaacgacctgcccgacatggacaacctgtccgggcaggccgcccctgcagccggtgcatcgcaggaatcgcagaataatggcgattctgcagctagtgcaacttccgaaactgcagcgaacgcagcatcttccgaatcgcaagaaaacggcgatgctgcggatggtgcaacgcaagatggtgaagatacgctgactccgcttggccaggccaagaaggaagcggcggaatacttggaagccctccagcgcgaacgtgcggaattcatcaacttccgcaatcgttcgcagaaggagcaggaacgtttccgccagcacggcatcatcgacgtgctgaccgcactgctgccagcacttgatgacatcgatcgcattcgcgaacacagcgaaatggacgaatccttcaaagccgtttccgccaaaatcgacaaggcgttcgaaaagttcggcgtcgagaagttcggcgaaaaaggcgaggatttcgacccgaccaagcatgacgcgatcctgcacaagccggatccgcaggccgagaaggaaaccgtcgacaccgtggtggaagccggctaccgcatcggcgaccgcgtgattcgcgcggctcgcgtggttgtggcatccccgcagagctagcgcagtgacagcgatttcaacaacaacaggcatttgacatcagcaacctcgtgaaaggaggcacatcatggctgagaatgaatggctgagcaaggatttctacaaggtcctcggtgtctccaaagacgccacggacgatgagattaccaaagcgtaccgcaagctggcgcgcaagtaccatcctgatctgaacaagaccaaggaggcggaggagaagttcaaagacatctccgaagcgtacgacgtgctcagcgacaaagacaaccgccagaagtacgacgccatccgccagttcggcatgggtggcgcgcgcttcgcaggcggttccggtgcgggcggattcgacgcgggggcattctccgacattttcggatcaatgttcggcggtggcgctggcgctggagcgtatggcacgggcggcaatggctcgcgcatccgcttccagaccggtggcggcaatccgaatatcaacgatattttctcgatgttcggtggcggcgctggtggccctgccggggctggcaacccctacgggggcagctacgagcaggctgcgcagccggaagatggcgaagaccgcaattccaagatcaatttgactttccgccagtcggtcaagggggcaacggtttcgctgtctgccgacggaaaaaagttcaagacgcatgttccagcgggtgtgcgtgacgggcagaaaatccgtattccaggcaagggcaagccgggtcgtaacggcggaaaaaacggcgatctgtacctgcagatcaacgttgccgaagatccgaaattcagcctgcgcaagcgtgacatcatcatggatctgccaatcaccgtcggtcaggctgtggcgggcgcgaaagtgaccgcacaggatatcgacggcaacgaagtcaccttcaaagtgccggcaggctcgtccagcggcaccgaagtgcgcatctccggcaggggcgtggccaacaggcagggcgacggcgatctgatcgggcgtgtgcaaatccgcattcccgacaagccgagcctgaaagtcaagcatgcggcaaaggaattcgacaaggagtgcggcgatttcgctgacgaacttgccaaggagcgctgattgccatggcacgcgcatcccggacctcccaagcccgtgcggcgcggcaggccaaaatgctgtacgacatgtgcgcaatggcgatcgtggccggcagggccgatctggacggggcggatgaagttggtttcgacatcgaactgccgatgttcacggtcggtcgcgccggcgaactcgccaacgtgcatccgcagacgctccgccaatacgatcgtttggggctggtggtgccgcaacgcacggacggtggcgctcgccggtattcgctgcgagacatctcgcgccttgcgaaagcgcagcagctgagtcaggaagaaggcatcaacctggctggcatcgcgcggatcctttccttggaagaggagaaccgcgagctgcgccggcaagtcgagcgattgcgccggccggccggttccagcgtgttcgcggccgatgcggacggtgacattgtggaaatcgaacgttcccgccgcgctcgcatgtggcgtcggcagattcaggtcgacgcccgtcagctgccgtcgcgcgagtccgtggaggccgcgcgtgtcgcggctgatgcgtacgacacgcgcggtgggggtgtcgcaggcgaaaacgaggggattgagaggggtaaacccgtttctcagccgatttctaggtctatcgtgctttgggggattgactgattttcagaaaacattgaaaaaaattcaaaaacaggcatatcttgcaacagatgtgcctgttttgttatatagttttaccaaatgcattgcttcctgcgacgatgtcgttgttgtgggaaataatgttgagcatccgcgttctaactgtcattcttccggtcgtcaaggtgcttcggtgaaagatggttctctttgcccatgaataatcatggaggagggggtaagatatgcggcgagaacaggaaaggttaggagcgtacagtgccaagagttgcgttcacagctaagacccgcaagtatctcgggtctctggatgccgtggaatcggtcacccagtatcgtatttgttactccaaggagtttcgcgatgattgcatgcgcaggtatgccgaaggtggctcgcctgccgcgattttccgcgaggccgggcttgatccgaagatcatcggatacaagcgcgtggaacgttgcatcgctcgctggaaggcggaaaatgcggaaaaggccgctgaaaccgctgtggaaaacagtgaaaatcagggagagtgaatttcaaatctcccgatacaagtgaaattttcgaatttcatggattatagcgatgggggttgccgataattcgtgaaaaaaatcggatgattttgcgaatacgtaggcgcgaagtattgcgtcgatatgggaagcgctcggatggaggaccgtccgggcgcttttcgtttgcctcgcttgtatgcctgtttgttgtctgccgttttgccgcgactcgcgaatgctgccgtcttgccgctctgctgaaatggcagtggaagtcgcgatggacggcgctgcccggaaatccggtgctccgcgtccgacggtcgtagggaaggaacatcatgaccgagacgaacctgatgatcaaggccgtgttttgggatatggacggcacgctgatcgattccgaaccgtattggcatgagggtgagatgaaaatcgccgccgcgcatggcggatattgggatgaggagctcgcctggcagggttcgggcacgccggttccggatgtggcccgtcgcatggtggagcatggttgccagctgtcgattgaagagatcggccagggcatgatcgattacgtcgcccaaaaggaattcgagcgcattccgtggatcgaaggcgtggaagacgtgcttgtcgcgctgcgtgacgctggcgttccttcgatgctggtcaccacgtcgccgcgtcatcttgcggagaatctggttgcccaagcgccggctggcgcgtttgcgggctacgtgtgcggcgatgatgatgttgagaagaagccgtctccggccccgtatttggaggcgggtcgtcgcttgggtatcgctccggaagatatgaagtactgcattgcgattgaggattccatgtcgggcctgcgttcggccgtcgcctccggcgcgacgacgatcggccagaccgggttcatgcagatcgacaattccaacggcccgcagttcgcctcgatcaagggctacgagggcattgacgcggcctcgctcgacgctttcgtgcgtcagcgcgtatcccaggcctgatttttcgccccatctcgcttacgtatggcagatttgtctggtggctaggaaaagaaaaagcccgctgcggtggaatgaatgcagcgggcttagtggagccgacggtagtcgaaaccgcgacctcttcgatgcgaacgaagcgctctaccaactgagctacggccccaagtcatgtctagcaacacgctaagcaagacaactctcgcgattctagtacgaagtctgtacgaatgcaatctgcgagattcgcgtgttgcggaatatcccttgcaggaaaagcatgcgaaagcatacgaaaacggtgccttccgaaaaatcgaaagacaccgcaatcgcaagaaaaggagaaaacgtaagatcaggcttccgcggtcgcggtatcagccttctttttgccgaactttgctttgagcaagccgacgaaggtaggaatcagcgacagcacgagaatcgcaatgatgaccagctcgaaatgcttctgcacggccggaatgccgccgaagaagtagccgagcagcgtgaacagggtggaccagcacaggccgccgagcacggagaacggggtgaaacggctccaacgcatgccggaaatgccggaaatgaacggcatgaacgtgcggatgaacgggaagaaacggccgaggaacacggcgagcgggccccacttttcgatcatgccttcggttttggcgaggcgttcgggggtcatagccttgactctgccggattcgatgatgcgacggccgaagaagtggccgatccagtagttgcactggtcgccgatgatcggagcgcaccagaccacgggcagcagcgcgaacagcggtagtgcggaaacgccggtctgggcgtcgggcgcggcgaagaagccggcggcgaacagcagggagtcgcccggcaggaacgggaagaacacgacgccggtttcgacgaacacaatcaggaagatgaaaccaagcgtgggggcgacgcccatggagatccagctggcgatcgccgtgcgcggatccttgagcagattaatgaagaagttgataattcccatgaaatgctctctgtgagtaccttacatctaaacgtccaaaattaagtggttcaggctgccttgtgtgggttggcctcgcggaaccaatgtcagcctaccagtggccctctaatgcggcgcctagtaatgcccgacggttggcaaatctgcacaaacaggcgcaaagtgtcaactgcggtcggcgtttgtttcttttgacggctggttttgggtggctgtgttgcgcgactgggagattttgccttggtggccgcgcgattgaaaaagggcagattttcaaatgactgtctcccatttttggggcaacagaaagtgggaggccgttcattttcctttgcgttggataggctgaaggcatggaacgcatgaatgagcgcgaatgcgaagacaagcgcgaacgtgaagatgaaaacgcagacggcgatgcgggacttgacgctctcgtgagcggaaccaacgttccgcaaggcacggtcgtgctggcggccacgccgatcggcaatactgccgacgcttccgcacgcctcattgcgctgctggagcgcgctgacatcgtcgcagccgaagacacccgccgtctctatgcgctcgccaaccgtctcggcgtgcacgtgaacggccgcgtggtggcctaccacgatcacaacgagcgagacaagtccgacggtctgctcgatcaggtggaaaccggcgctaccgtgctggtcgtgtccgacgcgggcatgccgaccatcaacgatccgggcctcgcgatcgtgcgtcgcgccatcgaacgtggtctgcccgtcacctgcgctcccggcccgtccgcagtgctggacgcgctgtgcctttcaggactgcccaccgaccgcttctgctatgaaggattcctgccgcgcaagcattccgaacgcgtgcaatacctgcgtaccctgcgttctgaacgccgcaccatcgtgttttacgaaaccctgcatcgcatcgacgattccatggccgacctgcttgacgtgttcggtccgaaccgcaagatggcgctttgccgtgaacttaccaaggattttgagcagatccgtcgcggaaccatcgagcagattcgccagagcgtgatcgacgagccgccgcgcggcgaaatggtgttggtcgttgccggcgcttccgaagaggaggctgacgctgctgcccccgcatcgttgagcgtcgaagacttggcggtgctgtcgatcgaccgtgcgcaggaagacaatctgcgcatcaaagacgcgatttcgcaggtcgttgccgagcatccccttgcggacggctcgcttgccaatcgcaagcaggtctacaatgcggttcttgccatgaaagagtaagcttttcgcattgtctgccgtttggcgatcgcttgccatacgatcgcttaccgcgcgattgcccgctgcatacttgcgattgtgctactttagccatcatgcacaatcgcatctaatgcgcgcgattccaacgattccaacagtatttgcagggaacgtgccacatccggtccgccgacttgcgcaagatattccagcatcgcaggtgttgcggaaggattagcaatcagccatttgcgcagtcgaggcgcgtattccgcgatatgccagagcacgtcctgcgcagtgctgggactgcatgccaccagcggcgtcaacagaatcgggggagatggcggctcgatcagtggtttcggtcgtggcttgggctggtatggcggtgctttgcgcctgccgtgcgccttatgcctgctatgcgccgcgcacatattcggcatccttacggttcttacggtcttcgcaatccttacggttcccgtgttcgtaacctttgccgtcaatcgcaagaatgtaattccgtgcctgcggagcgttgcgaatatgcttcgcatcttccatgatttgcatgcaatcgttggagcggaaatgaaattcctgcatgagcatgcagatgatttcggaaaccaacgattcgctttcgggggtgcagttcaatgcgagatcgcatgcggtgcgaacaggcgtggtcacgatgatcggaccgactttgatggtgtgttcgtttggtgcgagacggttgaaaacgttgattttacggccgtaacgtagcgctcgatagtgggctttcgcgataatgtcgatggattcggggaaggtgccgcctagccaaacccatgcggcggtgcgtgaacatgccacggaccggctcggcagcaatgtcgcgatgatgcaggaccgcccgtacaacgtgtccgaatcgtggcatgaataggcgttcgcgctgtcgagcttgcacagcgcgccggatgaggccagcaggttcaggcacatcgggcccggaaggtcatcgttgcccagaaggggtggtggagtgtccatgacggtaccgtagcggattcgaattccgttgcgccaccagcccccgaaaatctgtggatatgtggaaaatgattgttacgtaatgcaacaatgtggatagatcggcagatatgcaaattatgatgcaaactatttcaaacgattgaaatcgatgatcgcacgtccatcctccaataaaaatccaactaccgaaatacatggaaaatgcgggatatggcgctttgtataatcgggcaccatgagtcatattttggtgaatgttgcttggccgtatgctaacggcccccgtcatatcggtcacgtcgccggattcggcgtgccctccgacgtatacgcgcgctacgagcgcatgaagggcaatgacgtgctgatggtgtctggcaccgacgagcacggcaccccgatcctggtggaagccgacaaggaaggcgtcagcgcacaggagctcgccaaccgttacaaccgtgtgatcgccaaggatctgtgcgatctcggcctgagctacgacctgttcacccgcaccaccaccggcaatcacgagcaggtggtgcaggaactgttcaagcagtgcctcgccaacggctacatttataagggcacccagaaggtcgccatctcgccgtccaccggccgcaccctgcctgaccgttacatcgaaggcacctgcccgatctgcggtgccgacggtgcccgcggcgaccagtgcgacgcctgcggcaacgaactcgacccggacgagctcatcaatcccgtttccaaaatcaacggcgaaaccccgcgctttgaggaaaccgaacacttcttcctcgacctgccggcgctcgccgaagccaatctcgcatggctgaagacccgcgaaggctggcgtaccaacgtcatcaacttctccatcggcctgttcaaggaagtcaagccgcgtgccatcacgcgtgacatcgactggggcattcccgttccggttgccggctggatcgacaatccgaacaagaagctgtacgtgtggttcgacgcggtgatcggctacttgtcggcatccatcgaatgggctcgccgcaagggcgatccggaagcatggcgcgcatggtggaatgatccggaaaccccgggctactacttcatgggcaaagacaacatcacgttccactcccagatctggccgtccgaaatgcttggctacaacggtcagggctccaagggcggcgaaaccggcaagctcggtccgctgaacatgccggagcaggtcgtggcttccgaattcatgaccatggaaggcaagaagttctcgtcttcgcgtggcatcgtcatttatgtgaaggacattctcgcccgctaccctgtggatgccgtgcgctactacatttccgtggccggtccggaaagctccgattccgacttcacatgggctgagttcgtgcgccacaacaacgaggagcttgccgcttcctggggcaacctcgtcaaccgtgtggccaatctgatgaacaagaacttcggtgagattccggcgctcgatgagagcgaaatgaccgatgaggatcgcgctctgctgagcgaaaccaaggccgcgttcgacacggtcggttcgctgatcgagaaccatcgccagaagaacgcgctgagcgaagccatgcgcgtggtcggcgacatcaacaagtacatttccgccaccgaaccgtggaagatcaaggacaatccggctcgcctcggcaccgtgctgcacgttgccgcccaggccgtgtccgacgcgaaccacctgctggccccgttcctgccgcattccgcgcagaaggtgtgggaggctctcggcggcacaggcacgttctcgccgttgccgcgcttggaagaggtcgaggatctcgacaagccgggcttcatgtatccgatcatcaccggcgactacaagctgggcgaaaccgtgcatccgtgggcttccgagccgatcgtggccggcactgcagtgccgaagccgcatccgattttcgcgaagattccgccggaggccgttgaagaggagctcgctcgcttcgattcggagctgaaggctcgtcgtgaggccgaggcggcccgtcttgccgccgaaaaggccaagctggaaggctgattcgctgattcacctggggattcggcttgatttggcctgatttgccgctaaggtgagttgttctgattgccggtgcaaggaattacgaagttcttgcaccggctttttatatctgattttgcaaatccgacttgtaaatctaatgcgcaatattcgactttctgtatacgattttacaaatctatagtgcaatccggattgaatcgatttcaaaatccgtaacaatcgctatttctcttcgccattcctctcgttacaatggggaagttgagggaaatgcgatgctgcagggaggctcttatgttggacgtcaagcgagtgctgaaagccgcgcctacgaaaatgcgttcccaagagccgctgcagcagttgtggacgccttggggcgaacagatcgccggcgaatggttgtcttccaacgacgcccacaaggcgttctgccctgcaaaagacggcgaacgcaaactggaaaacggccgcacgccaatcctgaacgagcatccgcgcccaaccatggtgcgcggcaatcacaccatgctcaacggattctgggattacgcgatcgtgtccattcccgaaagcggcaacggctcgaaatggcgcaaatccgcggctgtgctcacccgtgacgaagcggtgcaggcagtgaaggaagcggccatccccgaaacgttcgacggcaagattttggtgccgttctccccggaatccgcgctttccggcgtgcatcagacgatttacccagacaatatgatctggtatcgcacggtggtgcatcccgtgacgcttgggggaggggaagcggttcggcagatcggcgatgcgaaccgcttggttctgcatttcgaagcggtcgattacgtgtgcgcctgctttatcaacgggcagtttgcagggatgcatgtcgggggatatttgccgtttgacgtcgatatttcggcattcgtcgatcccgatgatgctttcgagattgcgttgtgcgtgtacgatccgaacgattcgggcacgcaaatgcgcggcaagcagaaaatcgagcgcgaggggatttggtacaccgcgcaaagcggcatttggcagagcgtgtggatggagatcgtgccggaagcgtacgtgcagacgcttacgctgaagggcgccgccgacggcagattgtttattcgcgcggaaatcggcggagacaagccgaatgccaaactgcatatcgtcgtagccgatcccgcggacggcacgatcgtcgcggacgaactgctgccggctggcatgcgtaaggtgcgcacggaaatcgcaacgcgggccgaacacttgtggtcgccgaacgatccgtatttgtatgacgtgacggcgacgctggaatttggtgcggcgaaatcgcagggaaagcaggaaaagctgcagcaagaatcgcaggaaattcaagagaaacccgcgaaatcgcaggaaaagcaagatattgtgcgctcgtattgcgcgttccgcacggttgagattaagcctgatttgaagggtatcgcgcgcttccatctcaatggcaagccggtgttcctcaagggtgtgctcgaccagggctattggccggacggcctgctgaccgcgccgagtgatgaagcgctggtgcatgacataaccgccatgaaggaatccggctttactatgctgcgcaagcatatcaaaatcgagtcggcgcgctggtactaccattgcgaccgcctcggcatgctggtatggcaggacgcggtgtcgggtggcggcgaatacaacgcgtgggtcaccaaccgcaagccgacgctcatgcgtgccacatggaacaagtaccgcgacgacacggcgaagcatttcgcggcgctcggtgccgacgattcgacgtaccgccgcgactggtcgcgcacctgcgatgccatggtgcacatgcttgccggccacccgtcgatcgtcacgtgggtgctgttcaacgaagggtgggggcagttcgacgcgtgcgatgcggcggaacgcattcatgcgcttgacccgacgcgcccgatcgacgccacgagtggctggtatgaccagcgttgcggcgatgttcacagcgtgcacaactacttccgtccgctggaaatctacccggataaggggccgttgcgtgggtatgtggccgaatatgaaaagcggcataagcggcgtcgtcgtgccgcgcattacgcggtgttgccggttgcgcagcatggcgttcgtgcgttcgtgatttcggaattcggaggattggcgcagttggttgccgatcatgctgcggtttcgcgcgcgtacggctacggtgaatacgattcgattgaggattggcgcactgccgtccgttccgtgcttgattcggcggaatcgttggaatcacgcggattggcgggctacgtgtatacgcaggtttccgacgtcgaagaagagctcaacggcctcatgacctacgatcgccgcctcaacaaattcgcgcaatgattcgccgagattgagtgcggtcatggctgtcatggaagcgttctgcttcttgcgtttcggtggcgcgttcggtacgttgggaacggcggctattatggcgccatcacagcgagccacggcggaacggagcgaggagatgtgcgttgcgtttgcattggccgcattaaccgagggggtcttgtgaccatgaatcatgttccggaagcgccgcagtccgcaagcggcgattatgcgtggttgggagccgagccgggttccgtagccgatcagctgtatatgtcggcggccgacgaatggaatcaggcaatcaattcgcgttttgtgaatgaattgctggatgatacacttccagaatcgattttgaagtcttatttaattcaggatttcaagttctttaatcagggcatcatggcacatgcgattgaacttgcgccgcgtcaggaaaccaaagatatgctggcgaaacaatcgcaatggtttgctgacaatgaagcaacatattttaccggattccttaaggaatacggaattactgacgaagaatacaataattccgagcagactccggcaaatcgtgaatattgcgaatatctgaccaagctggttcagggaacttgggaagaactcattactgcgctgtgctgcatggaatggatttatcttgcctgggccaagcgcaccatcgacgctggcgtcgttcagcagattccggcgcacaagggttgggttgatttgcatgagggcgattatttccgcgcctggacgggccgcctgatcgcgctcgtcaacgagtatgcgtcggtggatggctcggaggccgacgtgttccgcaccatcgtgcatctcgagcgtcgcttctttgaggattcctatccgcagcggtgagcggtgagcatgatatgaggcaatgagcgccaatgcaaattggcggtaacgcggtaacgcaataacgcaagcagggggtccgcagaatacgcggacccccgtaattgttggggcaaccggcatgccccaacgtgtcagatcagctcgatatccacatccaagtggagcggcttatcggctggaatgtggtactgcgggtgcaccgggctcatccaggaatcgtcgccgccgacgcccatttgcgcggcgagtacgcgcaggaacatgtgcttcggagcgggcagttcgtcctgatgctgggcttcttccaacatgaatgcgctgtacggctgcaggctgagcgcgaacgctgattcgccgtgacggctcacacgcatgccatgaccggcatcatccgtgatctcagcccaacgcacatcctcatggttgccggtttcctgcggcatgaggtacggcgcatgatcgtcgtaagcgttggtgttccaaatgcccagcttggcatgcttgcggtcggcgtaggtttcgtcgggtccggggccgtagaagcgcaggttggagtattcgaccggcagcgtccattccaaaccgaaagccggaatggtcggggcttcctgagtttcacccggatagtcgacgctcaagtgcagcttgccggtggtgtctgccacatacgtgatggtgacgtgcgtgcgctgcggagtggcgagctcgtactcgtatacggctttcagcgtatcgtcattgacctgttcgatggtgttgttgacgcacttggcgtaacggcctgcgccgacccactgcgcgcggtcgtaaccgtggcctgcaccgcgatcgttgtcggtcagcgcgcggaacgtggtgagcgtgggcttgcgcagcacgaattcacggccgtcaagcgtgtacgaaacaatgccgccctgcgtacgcgacagcagaatctcacgaccggatccctgcacgccagcattccaacggccaacggtcacgatgccgtcaacaggcttcgtctcgctggcagcaaccggcttggagcctgcaaccacggtctggccgaacgacagctcgtagcccttcgacgcccactcttccgcggcggcaaggcgttggctcacttcgagcgtgagctcgttggcttggcctcggtaggcctccaacggccattcaatatcgaagtgcttggtttcgccagccggcacatcaaaacgctgttcggcctgccataccggctcgccatccgcaagcacgcgcgtaacgaacacatagtcggcggtggaaacgaacagattgtcattcgcgatctcaacgccggtttcacccggcacaatgcgcacgttggcatacagctgcttgacgtcttgcgcctttggcgacggcgtgcgatcggcgaacacaataccgtctccggcaaactcgtaatcgctcggacgatcgccgaaatcgccgccgtagcagagacgttcatcgccatcgggcaagcgcacaagaatcgcctggtcgatgaaatcccaaataaatccgccctgatattgcggatagcgttccaaagccgtgtattcgtccatgttgccgacggaattgcccatggcgtgcatgtattcgcaggaaatatacggcttcttcgggttggacttgagatattcctcgatttcgtcggcgtgcgcgtacatgcggctttcgatgtcggtcacgtcgtcatacttgcgattgtgggtcacgccctcgtagtgcactggtcggttcgggtcgagttcgtgcacgtggacgctcatcgcgcggaacacgtctcccgcatacgattcgttgccgagcgaccagatgactacggaagcatggttgtagtcgcgcttcatcatgctgttcacacggtccacgcacgcgccctcccattcgggcttgctgcccggaacggcggaatcctcggtgaccacgtctcccggcaggcaccagctgccgtgcgtttcaagattggtttcgtcgatcaggtagatgccgtattcgtcgcacaggtcgtaccagtattcctggttggggtagtgcgaggtgcggatggcgttgatgttgtgcctcttgcagaacgtgatgtcgtcgatcatgtcttgcctggtgatggcgcggccgcgcttcgcgtcgaattcgtggcggtcggcgcccttgaagaccacgcgcttgccgttgagcttcatgatgccgtcttcgatgcggaagcgacggaagccgacgcgctgcgttgcggtttcaacgatcgcgccatcatggccgatcaccacaacttgcagttcgtacagtgccgggctctcggcgctccacggcttgacgtccaacgagccggaaacgatgccggtttcgtcggatgcggccaatgcggtttcccacaccacattgccactcaaatccttcagcgtcgccgacacggtggcggcattcttcgcattgcgcaccgcgagtagcgcgtcgagcgaaccggtggcggtttccggattccaatccgcttcgaccttcatatcttcaatgtgcacatgcggctgtgcggcgagttccacggaacggaacaggccgtgcaaacgccagtaatcctgatcttccagccaggatgcgcttgcgtattcgtagcaggcgacggccacgacgttttcgccgtcgtgcagcgcttcggtgatgtcgaattcgttcggggtgtagccgtcttcgccgtagccgacgaacacgccgttgacccacacgtagatcgcggtggccatgccgtggaacgtgatgctgacggtgccgccattttgacgggccgtatcaagacgctcggcgacggtgaacgtgcggcgatacagtgccacatggttggtttcgggaacgttcggctcctgcggattctcatggccgtcccacgggtactgaatattcacgtacttgtggttcatgtatcccgcgttctgcaggtgggagggcacgtcgatgcggccgaaagcggaatcgtcgaaatcctcggctgcgaacggctcttcctcaagatcgatgtcggaggcctgcaccatttccacgcgccattcgccgtcgaggctttgcttcaaatcgctcggctcgccgatcgcgggaatgtgagaaaaggttacgtgattggaatgtgccggcgtgcgattcactgcgaacaccgtggggtcggtgagccacgcggcggatgcggtggtgatcttatctgccatgatttcctcgtttccgaaacataacttcgttgttgatgtaggtttagttggtgtgtacttttgtgtactcagagtaataaactcttttactagcatggtaaacgttgtttacttaaattgcaaatctgcgtgttgcgttatttgcaactgaatttacttatatggcgataggtgacggcaaatggcggtagtaatcatgattgcagatgtcggtatttgataagcgtaagaactgcgattgtgacacgccgtttggaggctttgtttgctaaggaattttacttttgatagtaaacaacgtatactcaattttcgaggtcaacgggtgatctcatcaaaatcttctaaggagaagagataatgagcaatacgaccactactgcgaacggcacggctcgtcgcggcaaccttggccagcgcgtagcgtacgcgtgcggcaaccttggccagtccgcgttctataacgcactgagcacctacttcgtcgtctatgtgacgagctccttgttcgctggtgttgataaaggcgtcgccaccaagctgatcggcatcatcaccggcctggtcgtggtgatccgtatcgcggagatcttcatcgacccgctgctgggcaacatcatcgacaacaccaccaccaagtggggccgtttccgcccatggcagttcctcgccggcgcgatttcgtccgtgctgatcgtgctagtgtacaccggcctgttcggcttggtgaacgtgaacaccacgtggttcatcgtactgttcgtcatcaccttcatcgtgctcgacgtgttctactccctgcgtgacatctcctactggggtatgatccctgcattgagctccgactcccacgagcgctccacctacaccgcactcggctccttcaccggctccatcggctacaacggcatcaccgtcgtggtcatcccgatcgtcacctacttcagctgggtgttcaccggtgagctcgccgaaagccagtccggctggacctgcttcggtattatcgtcggcctgctcggcctcttgaccgcatggaccgttgccttcggcaccaaggagaacgagagcgccctgcgctccaaggcccagaagaacggcaacccgatcgaagccttcaaggccatcttccagaacgaccagctgctgtgggttgccttgagctacctgctgtacgccatcgccaacgtggccaccaccggcgtgctgatcttcctgttcaagttcatcctcgacaaccaggccgcatactccctcaccggcgtgatcgcactggtcgcaggcttggttatggctccgctgtacccgatcctgaacaagcgcattccgcgccgttacctgtacatcggtggcatgatctccatgatcgccggctatgtgatgctcggcatcttctccgacaacatcatcatggtgttcgtggctctggtgcttttctacgtgccgggtaccctcattcagatgaccgccatcctgtcgctgaccgactccatcgaatacggccagctcaagaacggcaagcgcaacgaggccgtcaccctgtccgtccgcccgatgctcgacaagatcggtggcgccatgtccaacggcatcgtcggcatcatcgccgtggccgctggcatgaccggcaatgcgaccgcagccgacatgaccgcatccaacatccacatcttcaagatctgcgccttctacattccgctcgtgctcatcatcctgagcctgatcgtgtttatgttcaaggtgaagatcactgagaagatgcacgatgagatcgtcaaggagctcgaagtgaagctcgccaacggtgagatcgaagccgacgacgctcagaccgtggaagccgtcgaggcggttgccgtggctgaaaccgctggaactgctggaaccgcgactccggcgggccagcctgaatcccgataactgaacttccccctcctttccgacaaccagggccgcctgaagcactccatccgctgcaggcggcctttcatgtcttttcgtctcctcgcctctcatcccgtccgggttcctccactcactggaacaatctggacgataaaaggcctgtcagcgggaggattcctccgctcgctggaggtttttggacagtacgggggtgttttgcggtccggattcttccagcgactggagggatatggatgctcggagagttgcagacggggcgattcttccggtggctggaggtttttggacgttagcaggtctgttagcgggtagcttcctccaccgactggaggttttgggtcgcgctaaggcgtccggagctatgcttcgccgatgagggagccgcgttcgtggatcgtcggcaccagtgtgcggatcacgatggtggcctgcccgcgcagggtgagatcctcgccttgcctgcaacggtgaatttgcggcgcctcctgataatccgtggtcacggtgcggctgatttcgttttccatcgcgtcgatgaattgagtattgacgatttccggcgcaccatataccgaaatatcgcgcagatccaacaatcctgccggtatggccatgacgcgcccgagcaacgcgcccgcttcggtgagaatatgcgtacgtgcggcaggatcctgcgagatgcgttgctgcagcctgtcaccggaaacgaatgattcgagacatccctgtttgccgcattcgcagattggcccgttcgggtcgaccaccacgtgtgcgatttctccggcagtgaaggaacttccttcgatgatgacgtcgttgaggcataatgccgcgccgacgccccgcccgatggagatgagcatggaattgggagagcagtcgccgaagaatcgttccgccacaagtgccgcattggtgtcgttgtctacgatcacgggcactccggtggcgttttccacttcggctttcagcggcagttcgctccaccccaagtgcacggatttgcgcaccacgccgttgggttccacaatgccggtcaccgcgatgccgatgccaagggtcggcagtggcgttgagctgatgagctgcctgcagaggtcgatcacgtcattgacgctgcagccatggtcgacgggaagctcggtgcggtccacgattctgccggaaagatccgccagcgctcctttgacgagcatcggattcgacaggtcgacggagacgattcgccagaaatcggtgtcgatggcgagcacttgtgaacgtttaccgcgcccttcgcgattgtcggggccgagttcgcgcagaatgcgattgtcgaccatttcgccggtcacttcgctggtggtgaagcgcgaaagtccgatgagtttgccgatattggctcgcgacatttgcgttgcggggaaaagctgctcgaatgcggcggtgatattgctgattcgaatgtcggaaggtgatgcctttgcttgggtaccgctcacgatgtcctcgctttcttgtgtggagccgatacatattgtagtgtgtggcgatacaagtgcgttatgtaatttttattggcaataaagattactaaacaagagtatacggcatttttcctcgaattgcgattgctttacgattgtcactaaatggcggaatttcagcttttttgtggaatagcaatcgcgtgccggatttaaatgtaaggaaacttgacaaaaaaggattacgtaggtatgctgtgactatccggtgcaaggaggtgccggaataatctcacgaaggagagagatatgcgatcccacactcagcgtttgatggtttgcgcagcttctttcgcggctctgtgcatgggtcttgcaggatgcggttccaatacggccagcaccggcggggattccggggaggtcgtcaacctcacgtacatgcaccgtcttccggattccgaaggcatgactttggtcaaagacattgttgccaagtggaacaaggatcatccgaacattcaggtcaaggccaccaagttcgatggtgccgcacaagatatgatcaagaagctggaaaccgacgtcaaggccggcaatgctccggatcttgcacaggtcggctacgccgaagtgcctgaggtgttcaccaagggcttgctcgaagacgtgaccgaagaggccgcgaagtacaaaagcgacttcgccgaaggcccatattccatgatgcaggttgatggcaagacctacggcctgccgcaagataccggcccgcttgtgtacttctacaaccagaaggctttcgatgagctgggcatcaaggttcccaaaaccaaggatgagctgatcgaagcggcaaagaccgcggccgcgtccggcaagtacatcatggattacgaagccgatgaggccggcaacatcttcgcaggtttggcaaatgcttccgacccgtggtacaccgtcaagaatgacgcttgggtggtcaacaccaacggcagcggttcgcaggcttttgctgaaaccttccaggaactgatcgacaacaaggccacgctgaccaacccgcgttgggtgccgtcgttcgacgcatccctgcaggatggcacgctgatcggcaacatcggcgccgcttgggaggctccgctattcaaggactccgcaggagacaccggcaagggtgactggcgtgtcacccagatcggtgactggttcggcaatggcaccagcaccggccctgacggtggttccggcgtcgcagtgctcaagggttgtgagcacaaggccgaagccatggaattcctcgactggttcaacactcaggttgaggatctgacctcccaaggtctgattgtggccgccagcaccgaaaccgcgaagacccctgaatcctggaacgaattctacggcggccaagacgtgatgaaggaattcgctactgccaacgacaacatggtcgcattcaactacatgccgggctactccgcggtctccgcagctatgcaggaagccgccgacaaggcagccgacggttccggcaaggtggcggacgtgttccctgtggcacagcagacctccatcgacaccctcaagaactacggcctgtccgtagcgaagtgatcgacgtatggaaccagggatcacccgctctgattccataacccctccaacgacggtgtggagccaacgcaacacacggctccacaccgttccttatgaaaatattccttgtgaatattccctatgaatcgatctagctgattcgacggagcggctgaaaccggcactcctctcccgtgatgacgatttggatacggcgattcgaactgtgaaagatgccatcaacgatgaatggcatccgatgcgaaagataggtacatcatgactgcaacaacgcaagcggcgaaaccaaagcgcactgatgcgcaacgccgcgagaatcgaacaggatgggcgttcatggcgccattcggcatactgttcgccattgtattcatcatcccgattttctatgccatctattccagcttcttccgtcaggtcaccgagggcggcggcgcgtacggcggcggcgaattggtgaataaattcgtaggattccagaatttcgagtacgtgcttacgtccggcaatttttggtccggtgtgggcagggtgctgatttacaccctcattcaggtgccgctgatgatcatcatcgcgttggctttggcgatggtcatcgattcgttcgtggtcaagcacatcacgggtttccgtctcggctacttcctgccgtacgccattccaggtgtggtcgcatccatcatttgggtgtacctgtataacggtcagatttcgccgatcgtcaaaggtcttgcggccatcggaataaacgttgatttcttcagcaagaacgttgtgctcgcttccatggcaaacatcaccacatggacgttcaccggctacaacatgctgattttcttggccgcactgcaggcgattccgcacgaactgtacgaagccgcacgcattgatggcgcaagtggatggcagatctccatgcgcatcaaactgccgaacgtgcgttccgcggcgctgctgtccatgttgctgtccatcgtcggcacgatccagctattcaacgaaccgcagatcatgcagaccgccgatccgggcatctccaaaacctatacgccaatgatgatggccatgaacacttcccaaggcacgctgactccgggcggtgacggacccgcatcggcggtcgccatcgtcatggcactgatcgcaggcgttctcgccatgatctacgcactggtcgagaggaaggcgaacgaacaatgagcaacgcagtcgcagcaagaaaagacgaacgcgcccgcagaaaagcggaacgcatgatggaaaagcaacgcgaagcggccgaacacgatctgccgcgctccatgcgcccatcgccgatcaccaaaaccattaccgtgatcgtgctcgtcgtagcgctgatctacttcctcttcccaatctattgggccatcatcgcatccaccaaaacaccatcgcagctgaccagcagcaacggattgtggttcgccgtcggacttgaccagattcccgacgccatcgcaaccaactattcgaagcttatggggtggacccgtggccaattctggcgttgggtgctgaattccctgatctactccggggtttccgcactgatcggcaccatcatttcggtgatggcaggctatgccaccgcaaaattcaacttccgtggcaaggccatcgccatcggcgtggtcatgggatgcatgctgatgccggtcgcactgctcaccattccgcagtactccatcttccacgcactgcacctgaccaacaccatgctggcgatcatcatcccgtgctgcgtttcgccattcggcttcttcctcggacgcgtgtacgcgcaaacctccgtaccgaacgaactgctggaagcggcccgcatcgacggcgccggtgaagcgagaatcttcttcaccatcgtgctccgactgctcgccccagccatggtgaccatcttcctgttcctcttcgtaggaacgtggaacaacttcctgctgccgttgatgatggtttcctccgacaccctcaagccggtcacgctcggcctgtatggcatggtatcgctcgcaaccttcaacgatcgtggatcgctgatgatgggcgcactgctcggcgtactgccggtgatcgtgctcttcctcggcttgcagcgctactggcaggccggtcttgcggcaggcgcggtcaagggttgacgggcatccatccaactccatgcgtggcatgcaaacgccacgcatggagttggatcaacagaacaaccgtaatccgggccccactatttcaggcaggtacatgcaatgaacgcaagactgcaccataacggccgttcgcaaggatgcgtcggcatcgacatcggcggaacgaaaatcgaaggcgtgctgctcgacgcaacagaccgcgtcattgacgtctgccgtatgccatcgcactccggtgaaagcaatgtcgtaaccgacatcgtgcgcgtcgcccgcatactgtccaacgaagcgctgcccatcggcattggcattccagggcaggtgaactgcgcgaccgggcaagtgagcaacgtcgtcaatcttgatattgaaacgttggaacttggcgaacgcgtcagcgcgatcatgcacgctccggtgcacgtggaaaacgatgtgaacgcggctgcggtcggagccgcggaattcgtggaacaagtcgacggcaacgcaaccgtcgtattcctcaactttggtacgggactggccgcaggactcgtgcgcggcgggcaagccgaacacgggtacagcggatccatcggcgaaatcgggcacctacccatcgaccccaacggattcgaatgcccatgcgggcagcgtggatgcttggaaaccgtggcatccggcggggccgtggcaaaactttggccctccgcaaacccgcccatgcctgatctcatccgcaaagcgcggcaaggagacgggcatgccaacgacgtgctcgccatggtggcccacgccatgggcgacaccatccaaatcgtcgcgcaagcctacgatccgcaacgcatcatcattggcggaggcatggcgaaaaccggtgacgcactcatcgaagtcatccaagccgaactgagccgcagagccgaaggatgccgattcctgaccacactcgacatcgcatcgaacatcagaatcgcagccattgaccaaccaatcggcgcaatcggcgcggcgctcgcggcaaaacgagcgcaaccgcaatcgtgaatgcgtgatacttcagacagactggaacaagcgcaacaattccggaaatccagatccggcaatcccggcaatccgagaatcacaattgagaattgaaatcgataatcgacaatcgaaaggcgaatcgatggcaagcgagaacacccgcaaatgggcgatcattcccgaaccgaacagcatgacggtcggcgaaggcacggtgctgttgccctatgcggggcgcgtgaacgaatccattgcgattggcgatggcgatttcctgcttgcgcatcagcttgttgccgacatacgttccgcgacaggcactgattgggatattgcgacgggcgatatgtggtcgggcttcatcagattgcgtattgcggattcgcgggatttcgattcgcaggatggcggtaccgccggcgcatacacgctgactatcaacactgacggcattacgattaccggttgcgatttcgagggtgtgcgcaacggcgtgcagaccctgcgtcaactcatacggcaaaacggtgccgtactgccggaactgcagattgcagatgcccccgcatgccaaatcaggggatattatttggacgcgacgcgcggccgcgtgccaacgctcgcatggctcaaacagtgggccgacaaactctgcctctacaaatacaaccaattgcagctgtacatcgagcatacgttcgcattcgacggtatgagcgaaacatggcgcggatcaagcccgctcacgccggcagacacactcgaattcgaccaatactgcgcgaaccttggcatcgaactcgtgccgtcagtctccacattcggacaccaatatgtggcgatgcgcacgcaggaactgcgtgaacttggcgaattccccgaagacgcagaccggccgttcagcttcatcgaacgcatgaggcaccacacgctcaacgtcgccgacgatcgagccttcgcattctctgcgcaactggtcgactcgtatctgcaacttttccgttcgaagcgattcaacatctgcgccgacgaaaccttcgacctcggcaaaggcaagtcgaagcaggaagcgcaacgtgtgggcgtcgcagcgttgtacgcaacatacgtgggcaaactctgcgaacacctgtctaagcagggccgcgaacccatgttctggggagacatcgccatcgaaatgccggaaatcctcgaaaccctgccgaacaatgtcaccctgctgaactggcagtacgaaccggaagcaaccgacgaaaaaatccaactcgtggcgcaagccggagccaaacaaatcgtatgcccggccgtatgggggtggaatgcgctgctcccgcgcatcgacgatgcgtggaacaacatcgcacgcatcgcacgctacggcctcgactgcggtgcggaaggcatgctcgtcaccgattggggcgattttgggcatgtcaacgatccgcgcatggccgtgcccggcatgatattcggtgcgcaatatgcgtggaatcctgccggagatactgctgaagatgatttgcttgagcgtgtttcgcgcgtcgaatatggcgattgcagcgcaagattcgttgcattgcttcgtagcgcttccgcgcaagccgtattcacttggcgtgagcttgtggaatatctcgaattggatgacggcacgggaaactgcaataccgatgttgcgcaaaccattccctgcctggccgatcgcttggttgatcatttatctgactgtggaaacgcaatgactgtgcgtgaagcacgcaatcgcatgatgcgcaatatggcaacgacaatcgaacgaattccgcaagccaatcgtgcattgcaacaatgcatggtcgacatcgcgccgattgcggcacatatgggaaatccgggcattactgctgccgtacgcatcgccatggaagggcagctgctgctcaatcgagtgggattcgcgctcgccgaagcacatgacgtgcgtgatgcgcatggcgctggcgattggcggccttccgattatcgtgcgctggcgcgcgagctcgaatgctggtgcgaggcctatgcgaaggaatggaacgcgacaagccaaccgtcggaactgcatcgcattcaggaaaccgtgtggaaagcagccgacgagcttcgccgaatcagcaaataaatcatcaaacaaatcctcaagaaatcagcaaaacgaaaaacgtcaatccaatgtcaatgaaaggaacatcatgaccgaagtcatcatcgtgaaaaacgagcgcgaagcaggcgatatttacggccgttcagtcgccgatctcatcaaaaccaagccgaatgcggtgctgggactggcaaccggatccagtccgctcgccgcataccagtcgctcgcacgcattgtgcacagcgagcatattgacgtatcgcaggtgcgtggtttcgcattggacgaatatttgggattgccgcttgatcacccgcagtcatatcattccaccattcaccgcacggttgtggaaccgcttggactgaaccctgatttggtgcacgtgcctggtgacgtgctcgacggggcgccgctgagcgacggcgaacgcattgcggctgccggccccgcctacgataaggcaatcgaagaggccggtggcatagatgtgcagattctgggcattggcacggatgggcatgtgggcttcaatgagccgggatcgtcacttgcttccggcacgcgcgtcaaaacgttggttgagcagacgcgcatcgataacgcccgattctttgacgacgacatcgacaaggtgcctacgcattgcatcacgcagggtatcggcacgattctcaaagcccgccacttggtgatgctggccttcggttcgggcaaggccgaggctgtggccgaaacggtggagggcggtgtgagtgcgttctgcccggcgtccgcgctgcaaatgcatccgcacgccaccatcattgtggacgaggaggccgcgagccgcctgcgtcacaaggactactaccgttacgcctacgcccacaagcccgcctggcagcacatctgattgctgctccgcagtcggtgtccgctagcgtccggattcttccactcgctggaacattctggacgtttttcggcctcccagcgggaggattcctccactcgctggaaggttttgggcagtacgggggtatttggcagtccagattcctccactgactggaggaattgggactctgaggtggctgttagcgggaggatttctccactgactggaaggattgggttgctgatgggcttgtcagcggggtaattcttccactgaatggaagaattggatgctaattgaggaaaatggctgtgagtgaattggaaggtatgaagatggaacagtctcgtgagcggtttgcgaatgaggtggacgttgcgttggcgcagtcggcccgtccgtttgcgattcataatgcgcgcaaagtcgatgcgcgaggtgttgcggaacattattggctggtttccgatggtagcgcgattattgcgactgggaatcgggacgctgattttgctgcggcttgcgcaagcgtcggtttgaatgccgatactgattccgattcggtcagttcggctgattccggcaatgccatgaccggttcggccggttccataaccgacgctgcaggtcgcatgatgactcccggttatgttgacattcatgcgcacggttcgtggggcagttccttcgatgatggcgtgcagggcatacgtttggctcgtgcaggtcacatgatgcacggcaccacccgccaagtgctcagtttgatcaccaatccgcttgacgtgatgtgcgccaatctcgaaaccgtgcacggcatgatgagcgcccgccctgacattctcggcgcgcatctggaaggaccgttccttgcgctgtctcgcaagggtgcgcatgatccggaatgtttgaaggatccggttcccgaatatgttgatcggcttttgcaagcggcaggcggctgtctgcgtcagatcaccatcgcccccgaattgccgcacggcattgatgcgattcgtcgcttcgcggcggccggagtggttcctgcggtaggacattgcgatgccgattatgcgaccgctcgcaagggtttcgacgcgggcgcgggcattatgacgcacatgttcaatgcgatgaatggcttgcatcatcgcgagcctggtccaattccggctgctgttgaggatccacgcgtcactatcgagttgatcaatgatggttttcatgtgcagaatccgatggtgcgtttgggatttggtttcgcaccgcatcgcacggcattcgtgactgatgccatggctgctaccgactgcccggacggtcattatctgctgggtgcgttggatgtggatgtgatcgatggtcacgctcggctcgtgtcgaatggtgcgattgccggttccacgctgacgttggaaaaggctgttcagcgtgcggtgctcgaattgggattcacgcccgccgacgcggtggaggccgccacgttgactccggccaaagcattcggtttcgaccgcgcgaacccggtcaccaagcaacctctcggtctgcttgctcccggctacgctgccgacgtgcttctgctcgatcccgccacttggtccgtcacccacgtctggtgtgacgctcgccctctccgctaaggcgagattactgaagcgagattactgaagcgagattactgaagcacaattgcagggccggctccgcaataggatgccggcccttgccgtatctcaagtttttatatttagtcttgcggggtgaagctgtcgcgtgcgacgagactggtggagattcgcatatgctggctgattttgcggtcggcggtcagcgcttcggcaagcataagcaccgcggctttcgcaagctcgtcctggctaatgtcgtacgacgacaatgcgggagacgtgtattttgcgatctcctgattgttgatgctgatcactttgatatctcgcggcaccatcacattttcggtggcaaatgcctgcagcacgccaaccgccaacggatcggctgcgacgattaccgcgtcgggcagatcgtccgcatgatcctgcaccaactgacgcccctgcaaacggccgttttccacagtgaacgggccgtccgcatacaccaatccttgcgcatccaatcccaagcgcaacgcccaattgcggaatgcgaacgtacgaatatcttccggatattcatgcttgcccataatgttgcccaagccgccaatgaagccgatccgagagcaacccgaccccataagcgcgtcgatcgcatccaatatggtttgttccaaatccggctgtaccgaatcgaacaatgccggcgcaggattgatgtcgatgaatacgccgtgggggagcttcttatgcaagcggtgaagcgtcttgtgatttagtggggacgggccgatcgaaataaatcccgcgtatttatcggcatcggcgatcagcgaatccacgtcctcgtgcatggtcacgttcatacgctgctcttcggcatgcttgacgagcacttcgcgcagctcgtcgaaatacgcgtcctgcaagcccttgtcgggtacgacattgtcgagaatcgcaacatcctgcggaatggtgatgcgctggtattgcggtacgttcttgtatcccatttccagactggcgtttagaatcttctcgcgggtggaatccttcaccgaaaaagtgggatcgtccttcaaaaccctggaaacagtggcttgggagaaacctacccgtttcgctatctctctgatagtggccatgtgaatcctcctcaaagccatcgttggctaaacacgtttactaattaatttagcacacatgctcccatctcgccatatttcctccaagcgtttcacgagatgaagcaatcgtgcgacaaacgagactcctctttactcagcttgcctcggggcggcttcgggcaatgaagtgcccatggtttcgaggcgcatgaggaactcgttggcgctcatggcgttgctcaacagcgtgccctcggcgagcgtgcctccgatggaacggatgaactcaacctggtccagggactccacgccatcgaacaccacatggaacgcattgttatcgcgcgaaatctcgagcgtgcgctgcatgatctgctttgcgcgaggcgtacggaaatcgcgaaccaccgtcttgtcgaatcgtgcgaaatccaatggcagatgcgcgaacgcggcaacctccgaatacgtggtgccagcattggtcaaacccaactcgacgttcggcaaagcggcaagagcggcaacctcatcatcaacttcatcatgcaccacatgaatggcatgcgatcccaactgcaggccgaaacgcagctgtggctgctcatgagtcaactgctccaagcgctcgtggaagatggacgcgcctaattccgaaccattcatgcaaatgtccacaatatccaattcgggtgccaccttgcggaatgcggtcatgtctttcacgcaggtttccagcacgtcgagcgtcagctgcacgctcatgttgagacgatgcgcttcagccgttacgaaatacggtgccagcgtacggcccttcgcgtcatgcacgcgcacaatcgtatccagcgaagtgatacgtttcgtattcacatcgaaaatcggctggtagagcacggaaatcgtattgtcttcgatcgcatggcgaagcacgtcggaagcgttgaaatagtctcccgaaccattctgcgcggcgagcgtggacgtcatgccgtcgactacgggcagattggagctctccgactcgtagatgtgcgcgctcgcatcggcgaggagcacggagaagccgtctgtcgcgttcgagaacgaaatgctgctcgatacgtccacggaaacctcgccttcttcggtgtataccggcatgacggcaagattgcgcatgcgtgtggccaactcctccacatcgctggttgacgtcacatcggttacgatcatggcgaattctgcgccgttcacgcgcgaaagcgtggcgtttcccggcagcagctggcttaaacgcatgcccacggatcgcagcacggcattgccgattttgcgtccataatgttcgttgacggtgcgcaaatgctccacgccgaaatacaccacggcaaccagattatgcacattctcggtctgcagactcttcaaatgtccgatgaacgcacgatacgtgagtgcgccggtcagcgtatccgtttccgattcggtgcgtagcagcgtcacttccttgttcacgcgtaacgattcggtaagcacttcgccgcaggtgagcaatatcgtctcgtcggtcgacatgaacggacgattccaaatactgcgttccatcgcgagataatactgtcgcgagccggtggaaataggcgcggaatagcggtaggaataccctcttttattaagattgtttgcattgctgatgaaacagcgcatgcgggtgaggccacgattgatgcgtcttacgacggtctcttccggcacttgattcggcaacggcagcgcgtcgcttacattcgctatgcatttcaacgcacttcgggatcgcgtgagccggctcatcgtatcgaccgtcatcagcaacagcgagtaggcgatcagcgccagcatgaacacggaaagcacggtggcagtatccgagccaatattggcgaactccagaatttcaggaatccacacaatcgccatcaaatcagccaaagccatggcaagaatgtgagacagcgaatactcgcgcatggctttacgaatcggaatttgtacaaaaaagaacgttacaatatcacaaatcaatcgaataatcggcactgcaacagtcataatcagtaatggcagcaaccaatgctggaattgataaggattaatcgcagcattgacggaattctggctgatgataattgacagtacgtgagaagtgttcgcaaataatattttgatcagtgggattggcgcaagcgtggttccggcgcgaagaatgccgattttcagactgcgtgcggtgatgatcgacgtgatgatggtaacgatgatcaggaacatggccacgtcgggaaaatagccggttaccagcagtatgacggtcaacggtggcagcacggtgtgttcggcggcaacgcgatacgacgaacgctttttgtggtagatcaggcacggcagaaaacacagcgaccatatgcagatgcgcgcagggtcttccataagttgctgcacgccttcctgtgcatggaatgcgattgcggccgcaatgcacaacgcatagatgatggccagaatggtgagtctggctggttttctgatgccgtcttttggctggctgccggtggctgcctgatgctttgattgcttcgatgtcatgattgcctgatttcgttcccctgttgcgtgccacttttactgaaaagtagcgactgccttgtgttcctgccttgtattgtgtctgtggtcgcgtctcgctgcggcaagcgtttatagcaccggtccgatgatgcgccacggtgcgttcgtgccttcctcggcgctgtccggctgctcgttttcgttgttgcccaacgattcgtagatattgccgttccagatcaccttgtcgccttgcttgtacagtacgtctggctcccacgtggggtaggcctgctgcgaggaattccagctggcattgtcgaagtcgacgagcgtgcccggcgtgcctcggaatcctgaccccaatgtggtggcgaattcgccgtccgtctgtttcatgccgctgcagaacgttttgagcgtgttggtgttcgtatagttttcgccgcattgctggtcgcggttcagcgaccacatgcttaagtggcccaggcttgtttccagtgcgaacgtgttgatttcgcgcgcattgtcgagcgtgaaatactcgtttttggtatcgttctggccgatgagcacggtggctcccaacagctcccagatctgatggtcgctgaagagtttgccgcgactgtacagcaacgttttgtattgcgcgtgggccgcgttcagcgaacttttgatcagcatggattgcgtgatcgacgtggacgccacgttgaaatccatggtcatgagattcacggtggatagcgtcacgccggcatccagaaacgcgttcacggtttgcattccttgcgttgtaagacctttcgcgtcggccggaagcgtcaaactgatgatcagatcgtgactggtatcgtctttccctttgtttttggctttttcgttggcgatgagttttgccacggcttgcgctcgccgggttgcggtttcgctgtacccgtcgagattcgagttttcgatgtcgaagtcgagcgaggtgatgtgatagcggtcgatcacctgctggtatgcgtcggcaagggaatcgacgtcggaacatgcactggcaagttcggtgccgttctgcccgccgaagctgacggttaccgtgcgatcggttttgtaggtttgcgcgatacggctgtcgagatcgagcgtggaggccgcttcgtcgagcgtgtagtagccgccccagcttggctggcagccgtcgccggcggtgacgaatccgagaatcacattccggtagacgttgcctaccttggattcgaactcgtatgagggtgttgcggtcacgtccacatagccgccgaaccagggttccggcaatttcttagccgccgttcgcgtgaacgtgatccacgaccatgtgccggccgcgacgagcgcgatgcacagtatcgctatgaacagtcggaggaaggaaaatcgtcttcctggaaacaggggtttcatcattccctttcgaaatcgtcaggtcaccaatgctgatggggacattggggcgtctagcaggctgtgtcccgctgggcttcagtgcatatgcgggggattttacgggggattaagctttcctctcgtgcgctgtttttcttatatctcgcttacagttagggagtgtagtctgtggctagtacgacgatttcaacagtgatgtatggtttatgcaggtgaggcagcgctgataaggcaaaggggtatatggtggcaaaaataggggattttgacggcgatgaccgcaggcaccagtggggtgctgaaacctccacgcaaccgcttgcgatcatgcatgccaagccttcgccaacgcgcgttgtgcgtggttacgttgccatcatctgcacggttgtttcatggctgatctacatgatcacgatgattctgtcgttgttcgtcaacaatccttcactcacgttacgtttcgtggttgaaggcgtgctgtacatgacgattgtgaccacgctgattttcagcgcgctcgtctacttgaccacacggcaaggggcgctataccgtttcatccggcatgaacgcgtgcctcgggcgatgctcgacgaccatttcgcacacaactacgataagggaatcacagtgctgattccttcgtacgtggaacagccgaaagtcgtcgaaaaaacgatctggtcggcggcattgcaggaatttcccgaccttgcagtcgtactcctaatcgacgatcctccgcatcctaacaatgacgaagcgcgagcgattctcaaagcaagccgcgaactcatgccgaaagtattggccgaattggcggcacctgcggaacgtttcaccaaagcgcgcgacgaaaccgttgcggcgctcgccgatcagatggacgcaaggcgtagtgtggtcgcacgctgtgcggaagactatcgtgcggccgcgcaatggttggagcataaggccgacacatggctggtcgaagatcataccgacgatttcttctgcgaccaggtattgcgcggtcttgcacgcgacctgcgtttgacggaacaggcgttgaacgaatcgatcaccctgcagcagcatgtcgacgcgaatcgcattctgcaactgtacgaacgtttggtacgcattttcaccgcaaaaggatggtcgttcgaacgcaagctgtatgcgtcgacctcccgtgaaggcaacaaagccatgaatctgaattcgttcatcggattgatggggcactcgctcaagcgcgtggaaacgtcggacggggtgattctgcgtgacgtgcgcgagggagaatctcccgatttcgtgatgcgcaattccgaatacgtgctgacgttggacgccgattccatgctgttgcgcgactactgcctgcgcttggtgtaccagatggaacagcccggcaatgagcgcgtggccgtgatccaaaccccgtattcctcgtatcgtggcgcgccgacgcgaatcgaacgcatcgcggccgccaccaccgacattcagcacatgctgcatcagggcatgacctactatgacgccacgttctgggtaggtgcgaacgcggtgatccgcaaggccgcgctcgacgatatctgcgtggtgtcgactgagggcacgcgcacggtgaaaacgtatattcaggatcgcacggtgatcgaagacaccgaatccagtatcgatttgggttatttcggctggcatttggtcaactatccggagcggttgagctatagtgccaccccgcctgatttcggttcgttggtggtgcagcggcggcgttgggcgaatggcggtctgctgatcatcggcaaattcttccgtattgtgcacgcgcggcatcagcagggcaatgatgtgaagctgggtgagtgggcgctgcgcgtgaactatatggcgtccatcgcatggtcgagtttcggcctgatgttcctcttggcatatccgttcgaccagcggttgctgagcccgtgggtggtgctcgcgtcgctgccgtattttgccaccatgtcgagcgatttgaaacgcaacgggtataaacgttccgatattttccgtatttacggcttcaacatcgtgctgttgacggtgaatctttccggcacgctcaagtcgattcagcagggcatgacgaacacgaagattccgttcgcgcgtacgccgaaagtcaataatcgtaccgcttctccggcattgtatgtgacgatgccgtgggtgatcatcatttactcgtgcatggtgttctacgccgatacgctttcgcacaattggggcaacgcggtgttcgccggtttcaatgcgatcgtgacgttctgggcgttgaccgcgtatatcggcatctggcattccgtgcaagacatggtggttggtctggtccgttggttcttcgtgccgatcaaggagcctcagcaggaggcggcccgcaagaaggcctcttggcgtgacgccctctacttcggcgaccgccaaatgatctacgagtcccgcccgctgtagccttgagacttctctagcccgtgtgtacgtgtacgggcggcggttgtagatgcctccattcttatgcaacttgcgtttccgtctgcacgtcctagtgtttggggaggatggccgcacgtttttggcttgctgacctcacgatttgggaaaaagcggaaaataaaatcgtaaggtcgaaaccaaatcgcaatcgtgcgacgggactcaagattgcaacggtcggtacatcaaaatcatgatatgaaggaacggggtcgcagcatcctggtgtccatcatttcgaggaatgacgggtaggtgtgtcgaaacgtttgacaaagctgagttgctggcttacgattagtgaaacgtttcgacgaaacgattcgataaaatacgagcgtgattctgcggaagaaattccggaaggctcggcggatggctttgttgaacgatggacgagagctgcggtacgcatgacgtgtaacgcaaatgacttggagagccgaaggaggcggaagatgacgggcatcaaagatgtggctcggggggcgggggtgtcagtcagcaccgtttcgtacgtactttccggcaagcgttccatctccgccaaaaccaccgataaggtgatggccgccgttgaacgacttggatatactccggatgccagcgcccgtaaaatgcgtggtatgcgtaatcatatttttgcgctcagcgcgccgattcgcggtgatatcaatcaggccaaatacaacgcttactttctgcagaccgcatggcagacaaagaaccgtggctacgatgtgctgttgcttaccggcgaggacgcggtggccgacattcggcgcgtgacgcaaagcaacttggttgatggcgtggtgctgctcgacattgaggaacatgacgagcgtaccgcccaggctggctcatattccaaaccctgtgtggccatcggttaccctgcagagcatgaaggctgtgcctgtgtcgatatcgattttgccacggctggtcgtatggctgtggattgcctgtattccaaggggcatcggagcgctatgtttttgcgtgacaatgagaccgattacgatcgcggttcgggctatgtgctgctgttccgcaaggctttgctggaacgtgccgaagagttgggcatgacgattcatgaatcctccaagcatcgtgacgatcgctttgatgccgcggaattcgtgcgtgagcttcgttctttggatgagcgccccacggcgattgtcaaccaggcgaacgccaatgtgctgaagttggtattgcagcaattacaggcttcgggattgcgggtgccagatgatatttcggtattgtcgtgcggcacgtatttcgagggagagctgatgccgcagccgattaccgagatgccggtcatgccgcaggaattatgttctaaggctgtggatctgctggtcgacgccatcgatgagcatcgcgacatcaagggattggtggagctgtccgctccggtcatgcatagtcgaggttccgttaccaaagttggtgacgtgtgaaaagaaggttgtaggagtatgtccgtgaaaggcggacggattcccgtatccataatcgaaacgattcgaaagtaagtgaaggcgttgtagccgaagcgaagatggtgattgccgaattgaaaagcgccaatccgcggccatcgtcgaaacgtttcgaaaaaaggaggcgacacatatcaatcttcataactgaaaaacaacttgagacataactcaacaacacaaccaccaataacaaaggagaaccatgaagatcacacgaggcatcgcacttgcggccgcggcggcaatgtcgctgaccacgctcgctgcatgcggcagcgacaccgcgcaagacgaggaaacgccagacagcctgtcgttctggtattacgaggaagacgacgctggccagacccaggcatggcgtcgcgccgcggaagccttcgaaaaggaaacgggtgtcaaaatcaatttcgaacgcaagtcgttcacgcagatcgcgcagaacggcagccaattcctcaattccgatgaggcgccggatcttatggaatccaatcgcggcaacggttcggccggcgtgctctccaccatggggctgctcaccgatttgggtgattacgtcgatcaatacggttgggacaagaaggtgaccggcgccaatgcggccgtggccaagtatgatgaaaacggcatcatggatggtgacacctggtacggcatgaccagttacgcggaattccagcgcgtctactacaacaaggatctgttcgccaagtacgggctggagattccgaccacctatgacgagttcgtggacgtctgccagaaattcgtggatgccggagtgacgccgatcgccgccgacgcgcaggaatacggcgtgatgtggctgtggtggcagctggtttccaaggaggccgacgccaaattcatcgacaactggcagctctacaagggcgatgtcgactggaactccaagattctcaccaattccgtgagcaccatcaacgactggctcgacaagggcttcatctcccacaacgccaccggtatgaaggccgaagacaccacgcaggcattcatcaagggggagtatccgatctatcagaccggcacctggaatcagggacgtttcgtcaagcagatcaccactttcgattgggacgccgcggtgatgccggaatcgaatttcgcgattggctgcgcaggcaatctgctggtgattccggaacgctctcaccacaaggatctcgctgcgaagttcattgactacgtgctttccgacgatgtgcagaactacctcggcaacgccggcggaattccggtggcgggcgacgccagcaagatcaacgacgagaagagcaaggccatgatcgaggaatacgcctcctacgccaatgatggcaagctcagctactacccggattacgccgcttccaaccttaccgatgctgttccggcggaattccaggaactggtgaacggcaccaagaagccggccgacgtgctcaagggtatccacgagaagtacgacgtcggtgtggaagacatgggcgtcaagaccaactgatcgtatatctgatctcatatccgacatcgcacgggattattccggttttgctcagtatcaatcatgaataatcccgtgcggtatcgcaaattacaacttgcgaaccaatatcgcaatcgtaaatattcacaggcaacgcagcgcaaccaaaggaaaagccaaaatgtcaaagaagaccaaaaacgggggagtctcaatgtcaaggcttcccggaaaccgttccgcaaaattcgtaccatatcttgttcccggactggtaggtctgctcgttatcgtcgttattccattcgtgtggaacatttacttgagtttcactcgatggcgtggagtcggcccggttaaattcgttggattgcagaattggaaacgtctgttcgctgattccacgttctggatttcattcgctaattcattctggattattgtggctatcgtagttattcctacgattcttggactatttatttcgtcactgctgactgacgttattcagaagaaattcggcggcaagacggcttccttcctgcgagccatgttctacctgccgcagttgctgccggttgctgtcgcggccatcatcatgggctggatcttccgtccggaagatggcgcggtgaacgcgctgctcgtcaagctcggcctgggatcgttgcagcataactggctcggcagccctgatagcgcgcttccggtgctgatgttcattctggtgtggatccagttgggctatccgatcgtgatcttcatgtccggtctgcagcgcgtggatcctgaactttacgaggcggccggtcttgacggagccaactggtggcagaaattccgtgtggtcacgctgccgtccatcattcccgagctgctggtggtcatcctcaccgccaccatcggcgcgctgaaaaccttcgcaccggtctatctgctcaccaaaggcgggccgggaacggcaaccaccgtgccatcatactattcctacaattcattcttccaagtgcaacaagtcggctacggcgcggccatctccacagcgctcaccgtggtcatcatcgtgttctccatcgtgttcaccatggtgcagaagcacgtcgaaaaggaactggtctgaacggttcaaaccgcaactgacccgtaacatgtaagactcgcaagacttcgaaagtcgaggaaacaaccatgacgcaaaccatgaccgcatcggcagcgcggaaagcatccaagaaaacccaacatgtgcgctcgaccggcgactggatcaccctcatcgtgctcatcgcagccgcactgctcgtgcttttcccgttgctcgtgctcaccgtcaacgcgttcaaaacacccgccgattacaatgcaacaggcccgctttcgctgccgaagcatttcaccatggacggcatcatctccttctggaccaccaccaagttcccgctgaaattctggaacagcttggttatttcgctggtagtggctgtggccgccgtcgtgctttccgtgctgaactccttcgcgctcggcatcggcagggtcaaaggcaacacttggattgtgctcgccatcatgcttgccaatatgatgccgcaggaagcgctgctctacccgctgtacaccatgttcaagcaggtcggactgtacaacaccaaactggcgatcatcatcatcttcaccatcattcaaagtgcgtatggcacgtatctgctgtcgtccgtatacggtacgttcccgcaggccattctcgaagcggcagccattgacggcgcctcgcgctggcagattctgcgtaaggtggtgctgccgatttcctggccgaccatcagcgtgctgttcgtgttcttcttcgtgtggacgtggaacgaatacatgattccgatggcattcctgatgggcgacgacgtgcagaccattccgctggcgctcgccacattgcagggccaacgcacgatggatgcgaccacacttgcttcggcttcgctgctgagcattgtgccgactattattttcttcattattttccagcgcaagttgtcgcagggcattaccgctggtgccgtaaagtagcgggaaaaggggtttcttatgactcgagataacgattggagcaccatgcaaaacagctcacgtcacgatatgcaggttgattcgttgggtgcgttcgccgcgcgcagtccgctggacttgcttgcggttgcggcaccagggcgcacacgttgcgtgaacgccgagaatcccacgggcggcaagggcgctgcggccactgcagccagtgcacttggcccgtcgcgcaagggcagtccgtgcatccagaccgtgaaagcgggggagagcgtcactttgatggatgtggacggtccgggcgtgatccgccatatttggatgacggtcaccgaccgcacgtcgtctaccggtccgaacgtgcttcgcaacctgatcctggaattctattgggatggcgaggagaccccgtccgtgcaatgcccggtcggcgacttcttctgctgcggccacgcgcaggcctgccgagtcaattcgatgccggtggtggtcgtgcccaatcgcggtttcaactgctacttctccatgccgttcgaacatgcgcgcatcgtgctccgcaacgatcacaatgaagacgttcccgcgttcttctaccagatcgactacaccgaatatgacgcgcttccggccggcaccatgcgttttcatgcgcagtggcgtcgcgagcgcgtcaccgaactggcccgcgactatgtggtgctcgacggcgtgcatggtcgtggcgcgtatatcggcacgtatctggcgctcaccgcgttggaaagccgctggtggggcgagggtgaagtcaagatgtacatcgatggggacgaccagtatcccacgtggtgcagcaccggtgccgaggattatttcggtggcgcgtggagtttcgccgatttcgacgagcatgggcgtatgcatgagcagacgttctgtgcgccgtacgtcggtttcccgttctattcgcagcgtctcgcctcgcatcgcgagagcgcgtattgggatgtgaatacgccggtgacccgcggattgtatcgctggcacattcccgatccgatttatttcgaacatgatttgcgtgtggaatggcagcagatcggtactgaggagggcggcaatttcgagcgtcaggacgacgtcgcttccgtcgcgtactggtatcagctcgagccgcatacaccgttcgatccgattggcgatcgtcgcttccgtcagccccgctgatttttgcccccgagcttacgattttcggtctatccggtcggttcgggggtgttgtgctgtctgcgcgacttgcgttctgcgtctgcacaacccgggtttttaacccgattttatgggttgtgcagatgcagggtgcgggttgcgcaggcgggaaacgtgactagatggggttagatgtcacggcgtctgctgcgctgattatcgtgcgaacgttctgcgcatccaagagacagccagctgcggccagatctggatactcggttcaatgccgttgacgccctgccatgcggtttccgcagtgcccaacgacagtccatgcccgccttgcgggaataggtgcgcttcgatgctgactccggctttcttgcaagcgtcgatcagcatcagtgtgttttcgtatggcacggtttcgtcgggaacggtatgccatgcgaaaaccggcggtgttttggcgtcgatatgacgttcgatcgacacggattcaagcgcttgtgaatcgttgcggcgttcaccaagcagtgaatcgaaactgccgcgatgggcgagcgggccagacgtgatcaccggataggcgagcatcaaaccattcggacgcaccgcatccggatcgtaaccatgagcgacaagaacatcgtcgctggtggaggtggcgagattcgcagcaagatgaccacctgcggaaaagccaatcacggcaatcgcatccggatcgacatgccactcggcggcatgctcacgaatcatcgtcatcgcatcggcagcttccaacagcgcaactggaaaaacggaaggcttcaccgaatatcgcagcacaaaagcgttgaaaccggccgcaagaaactgcatcgcaatcggctccgcctcacgatccgacgtcatttcgtaaccgccgcccggaatcacaagcacagacggacgcacacggtcgggaacgacttcttcgctgttatcaaggcaatatccgacgaatttcgctgcgctgccgtcgatgccggagatttcatattcgaaatgtttcatatatccatcataggtggaacacggcgcacgttatgcaggaactatttggtcccgctatttttcgtaccttgtgatccgtggacgcaaattgtgcagtcgggagagtgtgtcctactcgagcagccagtcgaggatgttgcggtgtcgaatgtcttggtagtcgccgagcccgatggtatccaaggtgagctgtgtgacgtagaggagacctccatatgtgagataccggtcgaacagcgcattgtcatttgctgtcggttgcaatgcatttcggtattccgagaaagacaacggcagcatcttgagctcgacatatcgtccggtgaaatggatgattttgcgttttttcagaatcgtccagtgaaatggatgatttttgcggagtgggtgagtgatatagacgtgcgattgggcaaatcggaagtaatgttgcgatcattcgacggaattcacgaatgtgtatggccgctcacatgtctgatacatttttctcagctaattggcaggaacacgtatcattcctccaagactcgggcgcttatatagaacatgtcagcagttacggcggctggcgaggttcctgaagaaccccataactgaacccttcttctctcttctctctcagccggcggcccttctctccgccggctttcttcttttctgaacacgatgcatgcgattcgtgcgattcgcgatttatgtttcgcgattttgccgaaaagagttgcaagacaaacggccgaccatgcgtgagtaatgcatggtcggccgtttgtgatgctggtgattatgcgtggtcgcgtgcaggcattcgtgattcagcagcgctcgtacgagaacctgcgcaggcgttcgaagcattccacgctttcgtcaagccatggcatgccgatcacgaacacgtggccgagcgtttcgtggcggcgtggcttcgggtcgaacagttcgaaatcggctcccttgcgggccagtgcggcagcaagcgccagattgtcggcctcgaggaaatcgtcgccgcaggtcacgatgaacagtggcggcaggttgacgttgaacgccaggccttcggcggtgaggaacttcgggtcggcggcttcgatgccgtcgaagaattcgacgcccagcatctgttcgagtccggtgcggcgattcggatcgtagcctacggtcagttcgcttcccatggtttccaacgatgcggaactgtaggcaccgcacaccggagcggcaccggcgaaaccaatgcccgaaggctcatccacgccgaatgcggccgcggcttcggcattgttttcaatcgccaacgtcagcatggtcaacgcgccgcctgccgaatcgccggtgaggaacacggcgttcggattaaccggataatcagtcaaatgcgccttgatccaacgcaatgccgcctgaacgtccgccagctgacccctcaaatcggtttgcggggccggtcggtagttcagtgagaatacggcgaagcccgtttcggccagatgcacgttgaagttgcggttcaattccttatatccgtaagtgaaaccgccgccgtgtatatcgatgtacaccggcagcgtatgcccgcagcgcagcaccgcatcgtgcggtagatacaggtcgagcaaatgccctctgcactgtccggcttccgtatcgtagccaccgtcaggcaggtatggaatatcttcgatcacgtcgattgtgtcaggcgtgtgccacagttcggaacgcggggtgtcaaccgcgatcgcgccgaaacgcatgtcgagaatgccgcggacgcgctcttcggaaaggccttcgagatcgccgtcggtttccgtccaacgttccgcatgggcgatcatctcacgggtgatgccatattttgccgcgtattgtgcgctgagttcctcaatggtctgtgtgctcgtcatcgacgccgtcctttcatgatgttcatgcgattgcggccgttccgtcatcggaatgccgcacctcgatatatcgtaccggttcgatatagaaagcgctactgcgatcacccatattcctttacgtccagagcgaatttatgtaacggtacatgcgttgattttattgcgattgcgacacgccgaaatcactcacgttgcatcaaaaaacggttcgcatagaataagtcgcgtttgcgaatccgaacaggggtttcgaccgagagagacggcaacgggacgctcgacaaacgacggacgtgaatcgtaacggcaacgaatggccgtaaaagcaacgcaaaaacgcaaaaccaacccacgaaaacccagacaaccagcaaacaatccgaaggaacgctacgtatgtacgtcgatccgaatcgtaatacagaagcaggcaaccttaaatggatcctgccatactgcaaacccgacctgccacgagtggccggcgcgatagtgctgttctgcgtcaacaacaccatggcgctcatcattccgctattgtcaggcctcatcgtggaccgtgtcatcgtgcaaggccaagtcgacgaactgacgcgactgtgcatcatgatgatcgtgttcaccatcgtgcgcgtcgcctcgcgctacggctaccaaatgtggatggaacgcttcgggcagaactccgtattccgtctcgtcagcgacgaatacgagaaactgcacgaactcgacttcacctatttcaaccacacgcgtaccggcgacatcatgagccgcatgacctccgacaccgatgccatacgccacgcgctgagctgggtgagctaccaggtgcttgactgcgtggtcatgttcattggcgcgctcgccatgatgttcaccatcgactggcggctcgcgctcgcgctcgcatgcgtcacgccgttcattttcatccttacgcgcggactctccacgcacgcaagaccactgttcttcgccatccgcaactcgcttgccgaaatgaactcaatggtcgaagaaaacatcgaaggcaaccgcgtggtcaaagcgttcgtgcgcgaaccgtatgaaaccgaaaaattcgacaaacacaacgacgattacatgcaacgcaacatggaccaggcctacaacagccgcaaatacatgccatggctcgacggtctcggcttctcactgcagctgatcacgcttggattcggcggattcctggtcatcaccgggcgcatgaccctcggcaatctcgtggcgttcaactcctacctgtggatgatcgacgggccggtacgccaatccggatggctgatcaacgactggcagcgattcaacgcatcctgcatcaaaatccgcaaactgctcaccgctcagtcacgtattacggaaaagccggaaaatacggaaaaaccgggagacagcgccgacgcgaatcacgccagcacagcggctgcaaccgctgcaacaaccaacacaacccgcatcgcaggcagcatcgacttccagcatgtcagcttcgccttccccgacgaaccagacaccctcgtgctcgaagacgtcgacttccatgttccggcaggcgccaaactcggcattctcggcgaaaccggcgcgggcaaatccaccctcgtcaacctcatctcccgcttctacgaccccaccgaaggccatgtgctcatcgacggcgtcgacgcgcgagactggccgctcgccacactgcgctcgcaagtgtgcgtcgtggcgcaagacacgttcctgttctccgacaccatcggcggcaacatcagcttcggcgcaggcgaacaacgcgaatacgacgaacagtacattcgccgcatggccaccatcgccggcgcggacggcttcatccgcagcatgccggaaggctacgataccgtggtcggagagcgtggcgtcggcctttccggcggccaaaaacagcgcctgagcctcgcacgcgcgctcgccgacaatccgtcgatcctcatcatggacgatacgaccagcgccgtcgacatggaaacggaagcggaaatccagcgccatctgcgcgaactggacgaacagaaaaccatcgtcaccatcgcacaccgtatttcatcggtgaaagattccgatctgatcctcgtgcttgagcatggccgcattgtggagcgcggcacgcatgacgaactggtggccgcgcacggccgatattgggagatctactacaggcagctcggcttgcaggcgggtcgttcgcaaggtttcgaagcgtaggcgcgggaaagcaggaaagggggaaaacccatggcaaaacgtaacacataccgcgaagatgaagagctggaagaacagatcaacctgcatgatattctgcgcatcggcgtctatgtaaagccgtatatgtcacgaatcatacgcattcttgccgtcgtcgtcatgatgagctgcattgcggtagtcgtgccatatttgacgaaaatcatgattgacagcgcgattccttcgaaaaatctcaccttacttggtgaattaacggggttgatggccgtacttattgtgatgtatgagtttggattgcgttatcgtaccgtcgaaattactcgcgtcggtcagctcatgttgaaagacatgcgccgcgatattttcacgcatattcagacgctgccgttcagctatttcgattcgcgtccgcacggcaaaatcctgattcgcgtggtcaattatgtgaacacgctttccgacacgttgagttccggcctgatcaatgtgatttccgacgtgttcaccttcctgatcacgctggtggtcatgttcgtggtcgattggcggcttgcgctgttcagcctggtgctcttcccgttcctgatcgcgtgggtgctggtattgcagcatttccagcgccgcgcgtatcaggtgttgtcgaacaagcagagcaatctcaacgcgttcattcacgagtcgatcaccggcgtgaaaaccacgcagaccttcgcccaggaggcggcgcagttcaaaaccttccaagagcagcaagacgacgtgcgcacctcgtggatgaaggccgtgcatatccagttcctcatgtggccgggcattcaaaccatttccgtcatgacgatcgcattcatctactatgtgggcgtcacgggcttcggcgcggtgaacgtttccaccggcgtgctgatcgcgttcgttggctatgcgaataatttctggaatccggtgatcagcatcggcaatttctacaatcagctgatcacttgttccgcatatcttgagcgtattttcgaaacgcttgacgtgcagccggagattcgtaacgcgcctgacgcgactgaactgccgcaaatcgaaggacgcgtcgatttcaacgatgtagttttccgttacgagcctgacggtcgcaatattctcaatctggttgatctgcatgttgagccaggcagcaccgttgcgttggttggtccgaccggtgccggcaaaaccacgattatcaatctgctgtcgcgtttttacgacgttgcagaaggttcggtcacaattgatggtcatgatgtgcgttctgtcacattggaatcgttgcgtcggcagatgggcgtcatgctgcaggatacgttcattttctccggcaatgtgcgcgagaacatccgttacggcaagttggatgcgaccgatgctgagatcgaagcggccgcgaaggcggtgcatgcgcacgagttcattatggatttgccgaacggatacgacacggtggtggaggagcgcggttccacgctttccgctggtcaacgtcagctgattgcattcgcccgcgtgctgctggccgatccgcgcattctgattctcgacgaggccacgtcgaatatcgatacgcgtaccgaagaggcacttcaggccggattgaaccacctgctgaagggacgcacgagcttcatcatcgcgcaccgactgtccaccatagagaacgcggacatgatctgctacatcgatcatgggcagatcatggagcaaggcaaccacgccgagctgctcgccaagcgtggcgcctactatcgcctctacgactcccaatacgccatgatcaaggtctaaatgggctgattagggcttggactgattggcttgaaatcagccttcctgctagccgcttgtcgtttttcggccggcggctagccgcaaattatcaggtacgaggcggaagatagggaagtcagaaagcaacgcatgttgctgcgcatgaagatgacgcgtgaatgcgtcgatgaaacaacgcgggaaggtttggtatggcagtagagaagccagttctcacccaggagcagcaagatgcggtcgcagcgctcgcatccaccaacgtgtatgcgaagcaatcgaaattcaaaaccttccgcgagctgccgccgaaagacaagtggccgtacttcaagcagaactttctgaccgatgtgctgatcattatcgcagtggtcggcttggtacttgctttcgtcatctcgtatgtgaccaaaggtcccgaggccgagctgagtcttgaaggtgtcgatatggcggaatattccgaacagattgatgcgttgggcgctgattttgtgaagacgcaaggtattgaagacgagcgtctcgtgcggacggatgcctccattgcgattagcgagaatgccgcgcaagatggttccgcatcgttgacggctcgcgtttcggcaggtcagatcaacatgattgttgccgaaaccgatattttcgccgaagtcaatgatcgcggcgacatcaccaaacccgcggaagtgatgagtgccgccgatcttgagcaggtcaaggatgcgctggtcgacgccaaaggcaatccggtttccgatgtgaacgacgctgtcggattcgacttgtcccattcgaaaacatggacttccatgaagggactgccgaaagaaggggttattctcggattcagcaatatcacggaatccaaggatatgccgattcaattcgtggaatatctgcaattcgagtaggtatttgctggtcttcgaacggtcattccagttgctgaatatttgctgaatgtgcgtagacacgcacatcgcggttgccccgttttccgcttaagctagtgagggtacgtcaaacgatgcacgtcaacggataggcggcattcggaattcgaaggagatggcaatggagaacggcaatatgactccccttgttcctcggcaggatgggcgccttgaatggggcaatggtgtggcctccatgctgtttgacattgccgccgattcccccgttcgcctctgcaacgttgtagggcgcaacatggttccgatcgatggtcgcttgtctgacgatggaaagccagtggttgaaaaggatccgcgtccgattgttgaggtgtgtgccgccaataccggttcgcaagacaaccgactgacgttgattgccacagttgccggcagccaattgcgattcgtttccgcgcttgcttccgaacctgaaccaggttccgccgatccgttccgtttggagatcacgcagttcgcgccgtatgccgatcttgaaccgaaaggtcgtgaattcgagccgacggcaagcgaacgtgacgcagccgatttcgccgcgaattccgcgtccgaggcggtttccgccgattccaatgcaggcttggtggtcacttccgtattcgaggcgttcccgaatctttccgcagtgcgcacctacacgcgtctgcagtccgccaggcaactgccgattgaagcggtgtcatcgttgaatctgaccgttccgatgcgcgtcaactgcggcaaggtgcatcgttcgaatattttctggggcgatgccgcttgggctgtggaaaacgattggcgtgttcgtccgctgcgtgacactcaggtgcgtaaccgcaaccagaaaatcaatcctggtcagtctagttcgcgttttgccatgagctcgacttctacatggagctcgggagagcatgagccggccggcattctgcaggtggaaggttcggtacgccgcgcccgcgatttttccgtaatgtggcagatcgagcataacggtccgtgggagtgggaagtcggcgaggacgatcccggtctgcacgtcactgcgttcggtccggaatataaggatcatggttggttcaccaatcttggtgaaggcaatgatttcgagtccgttcctgtgtcgtttgccattgccgcaggcgattggcagcaggctgttgccgaaatgacgttgcagcgtcgtgcgctgcgcattgccaaggctcgtgagttggggcgcgtcgatcagttcgagcatacgcagggtcttgtgatctacaacgattacatgaatacgctgttcggtgaccctcgtattgagaaggaactgccgctgattgaaggtgcggcaagcgttggcgcggatgttttctgcattgacgccggctggtacgacagcaccgacggcggctggtgggacatggtcggcgaatggcaggcctccaccaaccgtttcggcgacgccggtctgcgcggtcttgccgacacgattcgtgctcatggcatgggcttgggactgtggctcgaacctgaagtgatcggcgtgaaatcgccgcttgcgagcatgttgccggattccgcgttcttccagcgtcatggtgttcgcgtgtgcgattcgggtcgttatctgcttgatttccgttctcccgaagcgcgagagcatgttacgcgtactgttgatcgtttgattgacgatttcggtgcggtgttcttcaagttcgactacaacaccattcccggcgtcggcactgatttgaatgccgagtccgttggcgatggcctgctcgagcattgccgcgcatatgtggattggcttgacgatctgcgtcgccgtcatccggatgtgatgatcgaaaactgcggttccggtgccatgcgcgccgattacgcgcagttgtcccgcttggatttgcagtccacttccgaccagtgcgatcctctgatttatgctgcgattgcggctggtgcaggtatgacgattctgccggaacagcagggtaattggggttacgctcagcaagagatggatgatgagactgctgtgttcacgcttgctacgggtgtgctcggcaggctgtatctgtctggtttcatcgatcgcatgacggagccgcgtctttcactcgttcgcgacgctatcgccttacatcgttgtgtacttgccgaccagcagcatatggtgccgttctggccgtccggacttcccgacttcgacggcgattggcttgccgtcggcttgcgtcatgtcgaaacggatatgggtgacgcgtatgtgtacggcgaatccgcttggaatgagcaggctgccgagcagaacgatcagcaacctcagccggaagataagcccgactacatcatcgtgtggcgtcgcggcggcacaccgtccgtgaacatgccgttggatgcggatcaaaccatcgaacaggtgttcccgaatcctgccgaaccggaccatgcgcccaatgccaaaccgtggactatcgaacgcatggatccggaaacggttcgcctgaacgccgccacctccaagcaaccctccgcccgcatctttgccattcgccgccgcgactgatcggggctgagccaaccaatcgctgaaatgccgtatttccggctatcgtgcgttccgctgcaatcgggcgcggaacgcacgatagctatatgatcgcggtcgtggattcacgttcgaccaactgatatccgatggttgcgcggctcggcggcagcaccgtgcctgcatcattggaatttccggcattgctggaattatcattcacttcgccgcgttcgatccgttcgacaatcatatcgaccgcgaatttggcaagctggtcgagatccacttggatggtgctcagcgaaggggtggcgtaggttccggaagtcacgccgtcgaatccgatcaccttcacgtcttgcggcacatggatgccatagtcggcgaggccgcgaatcacgccgaatgcggcgaaatcattggcgcagcacactccgtcgaacgcgattgcgggaatcttgtcggtcgtttcgatcgatctgcccgtaatcttgccgcttgcatcgttgaaatcggcggttccggccgtgcctgtttcgcggtctccagcacccgcgccggctccgcagcccgtccttcgcgccgccatgatccgttcggcgatcgcgtgcccggcggtaatgccttcgtcggagcgaccgccttcgaacaccatggtttcgtcatatggcaatcctgcgtccagcaacgccgcgcacgctcctcgaagtcgcaatgcaaatgcgttctgcgcatgcgccaactcggcgcgcggcacgaacgtatgcccgacaatcgcaatattccggcatccttgggcgatcagatactgcatcgcagcgcgttcgccctcctcgttgggaaaattcacggcatccacggttggcgtttcctcgcatgcgtcgagcagtacgagagggcgcccgccgttgagtttggcgagcggtagattcgtgcccaatccggtggcgtgcagaatctcaccgtcgaagagctgccctgagaacggattgctggtcagcgcatgttcggccacgtccggcgaatactgggtttgctcgatgaacggcgtgagtccgcgtgaggtgatctcgcggctcaatgtttgcgtcagcttcgaatagaacggcgaatcgaattcgttgacgatgatgtgaataatgttgctgcgacctgatttgagcatgctggctgtcagattgatgcgatagtcgagttttttcgctgctgccagcactttggcccgcgtcgattccttgacgccggctttgccgtgcagcgcattcgatgcggtcatgggggagacgccggcttccgccgccacgtcgcgcaatgtcggtttgccgtttgccatgcaccgctccttacagccaagtttttctgtaacgatattatatatgatgattttctggtaatcgttgaaatttcaaagaatcaccgatatcctatcatgattgtgatttctgaaatatgctataaaatatgtaacggtacatatctgaagttttccaagatgatgaagtcgaacaagtaagtcaaggatgacgtcagatactgtaaacggcacgcttttctaacgttgtacaaggagaaggcaatggcgactaccgaggatctgccaaaagcatggcgaccgccaatgggctggaacagctgggattcctacggcaccaccgtcaccgatcgggaggtcctggccaacgcgcgcttcatggccgaccacctcaaggacgccggctgagacaccctagtcatcgatgcgggttggttcgatcccaacgcccatgcgcacggctactccgacggcaccccgctgtgcatcgatgcgtacggtcgccagattcccgatgagcggcgcttccccgagcgcggccggcggtcgaccgatggcgaaacggtgccagacagacgtcgaatcgcaaccaatcgcacgtaccgcaacaccatccaacccaacaaacaaccaacaccatccaaggacacaccatgaccgacaaactcatcgcaaccctcaacaaggcgggcgtgcgcaacatcagcaccgacctgtggggcatcttctacgaagacatcagctactccggcgacggcggactcaacgccgacctcgtacagaacggcgcattcgaatacaatcgcgccgactcctccgactggagcaactacagcttctggcgcaaaatcgtgcccgccggctccttcgcagccttcgacgtgctcaccgacaatccggtagccgaagaaaacccgcactatgcgtccgtcgaagtcgaacaggcgccggcttcgcttgaaaatatcggctgggacggcatggtcttccgtgccggcgaaacctacgatttctccgcatggatgcgtatttccagcaattgcgaagcttccgcacttcccgtcaccgtcgctctgattgacgacgatggaaatgcgattgcagaacaagatatcaccgtcgattccaacgattggcgtaagcaagaggtttcgctgacggtttccggtgaaagcaatgccatcgttgtacatgaaggcgctttgcgactcaccttcaccacggaaggtaccgtcgatcttgatttcgttaccctcgaaccacgcaccacctacaacgggctcaagcatttccgtcccgatttggtcaaggcgctcgccgacctgcagccgcgcttcatgcgcttcccgggcggctgcatcacccacggtcttggcatggataacatgtaccactgggatcgcaccatcggtgatgttgagcatcggccgcacaatttcaacctgtggggctaccaccagtcgttccgtatcggctactacgaatacttgtgcctgtgtgaaaccattggcgcgaagccgctgccggtgctgcccgccgccgtgagctgccagaacaccagtcagggcccggtgccgatcgcgcagaaagacatgccggcatacatcgatgaagtgctgcatttggtcgaattctgcaatggcgatgccgcgaccaccgaatggggtgccaagcgtgccgccatgggtcatccggaaccgttcaaccttgaatatttgggcatcggcaacgaagatctcatcgatgacgtgttcaggaaccgcttccagcagatcttcgacgcggtcaaggccacctacccggatattgttgtggttggcacggtcggtccggctccgagcggtcccgactacgaggctggttggcagtatgcgcgtgaagccggcgttcccatcgttgacgagcattcctatcagtcctccagctggtggttccacaatctcgaccactacgacaccacggatcgtgagggcccgaaggtgtacttgggcgagtatggttcgtggaacacgcagctgatcaacggtctttccgaagcggcgttcatgggtcgcatggaattgaacggcgatgccgtggtcatgtcttcgtatgcgccgctgtttgccaagaacgggcatcacagctggaatcctgatctgatctacttcgacaacgaacgtacctacctgccgtacagctactgggtgcagcagatgtatgccaccaccacgtccgataccgcatggccggtcgcggtggaaggcaagaccacgctgcgtcgcgaactgccaccaaccgttggcctgcgcttggaaggtgccgctcacgccgacatcaccaacttcagcgttgacaccgctgatggccgccatgtcgatcttgaggactgccattacgcaggcaatggtccgatgaacacgagcctcaacattgactctgacgcctacaccatcaacgccaccatcacctactatcagggtcgttggggcttgcagctggtccacggcgacatcaacggcaagaaccacaacatcacctccttcggtcgtgctttcgaaatcaaggtggtgcgcgacggtaccgcctacaatcttgacggcaccgaatggtccatggacgaagtgttccccggaaccgtgtggcaggtgcgcatcgaagtggccgatcgcggcgaaagcatgaagctgtatatcgatggagagcttgttgcgcagggtgttgagaagccggaagagccccgccgtaccgtcaccgtggctcgcaatgatgctgaaggcgtcacctacgtgcgtatcgtcaacgcgctcgacgctgaagccgagattgatctgaaccaagtgcttgaagagcttggtgtttccgcggaatcccgcgcttcggcaaccgccaccgtgctcgccggaaccgacccgtacgccggtgaaatcggcaaggcttcgccaaccgttccggttgaaaccgcaatcgacctaaccagcggcgcctacaccgccccctcctggtccttcaccaccctcaccctccatgactaatcgcggaaagcgtttcagcgctacgccgcaaaacatatggaggtgcgttggttaatcccactgccatcgatgaataacgcggcttccgaagcaagactgccatcgagcgtaggctggaggcatgagcaaacaccatcgtgaccgcagctgggcgccagcaccgcaaccacttcccgagaacgcgcacgtcatcgacaaccacacgcatgtggcgtccgtcgtgccgttctcgcgggccatgagccacgaagcgcaagaaaaaggacagccggaagtccccgtatacagcgtcgacgaactgctgaaccaagcgcaacaagtcggagtcgaaggcgtcatcgactgcggatgcgaactgccgaacctcatgacggccatcgacatggcacgcgaacacccccaaaccgtgcatgcggccatcgccatacaccccaacgaatccgtgctccacggtcaccgcggggtgccgggcccagacgggttgccgctcaaataccagccatggcacgacaccagcttcgaagacgccatggccgaagtgcaccgcctcgccaccgcctaccccaaccaggttgtggccatcggcgagacgggcatggacctcttccgcaccggagaagccgccaaagaactgcagcgagaagccttccgcgcgcacatcgcgctcgcgaaagaactgaacctgcccatgcagatccatgatcgcgattcacataaggaagtcatcgaaacgctgctggcggacggcgctcccgaacggaccgtgttccacagctattccggtgatgccgaaataggtgagatcgcacgtgaaaacggttggtatctcagcctttcgggcacatccagctataagggcaacgatggtattcgcgagtcggcgcgcattgtcggattgagccatgtcatggtcgaaacagatgccccctacctaagtccgatgccgtatcggggccgcaccaacgcgccatacatgatcccctacaccctgcagtcgttggcgaattatctcgataaaccgctgacggaagtcgcgcaggcaacgcgaaagaccacgcgcgaagtgtacggaatctgaacaaattccgaaaatcgacaggacggaaacgatttatccgaaaataagagagagtaagagaaagacaagaggtaaaataagaaaaaaacccacaggaagtttacttcgtgcgagatcaagaatcgcaagaaacaatgtgaagatttgacaagacttcgtaaggctcctaacgtgcctttttgcgtttattttggggagtgggttggaaggcccgccacttggaggtagcgttatggctaacgagccaaacgaggatgagccgctgtttcacgcagccacatacacgcaggcgccgaaggtttcgcacaaggtgctgactaaggaagagcgacaggtgctgatcaagcagcacgaggagaaacagcaggaggccgccaaacttgaccaggtggccagcaagggtcccgtcggtcgttggtggagccgtctgcaatccggtccaaacagaatcacgcccgccatggcgatcgtggcgttgggcgtggtatatggcgatatcggcacctcgccgctgtacaccatgcagacgttcctcaacgggcagggcggacttgcgcatgccgaccgcgaagccgtgctcggcgtgctttcgttggtgttctggtcaatcacgcttatcaccaccgtcaaatacgtgctgattgccatgcgtatcgacaacaagggcgaaggcggcattttcgcgctgtactcgttggttcgaaagtacggtgcatggcttgcgattcctgccatgctcggcggcgccgcgttcctcgccgattccgtactcaccccggctgtgtccatcagctcggcagtggaaggcttggagacgctaccagcttttgaaaaactttttactgaaaacaagcagctgaccctgatgatcaccgcggccatcattctgatgctgttctctgtgcagtcgcgtggcaccgagcgtatcggcaaggcgttcggttcggtcgtgcttgtctggttctcgttcctggcggttgtcggcttggcgaacctcagtcagtattggagcgtgttcgcggcgctcaaccccgtgtacggtgtcagattcctgttcagcagccataatgccgccgggcttgccatcatgggtacggtgttcctgtcaaccaccggtgccgaagcgctttattccgacatgggtcatgttggccgtggcaacatctatttcacgtggccgttcatcaaaatcgcgcttgtgctctgttatttcgggcaaggcgcatggatgctcaatcattgggatgattcggcttacatccgcacgcacggtttgaacccgttcttcgaaatgatgacgcccagcgtgcgttacgtggccgtcgtgctttccgtggtcgcgggcgttatcgcatcgcaggcgttgatcaccggcgcgttcacgatggtgtctgaagccacccatctgaactggatgccgcatcttcaggtccgttacccggcccgtacccgcggtcagctgtacattcctgtggtcaatgcggtgctttgcgtttccacgctgttggttttggcgctattccgtgattccgagcatatttccgcggcgtatggtctggcgttgaccatcaccatgatcactaccaccattctgcttgccgtctacatctggcattcggggcgtcgtatcggagcggtcgtattcaccgtgctgttccttgcgatccaattcatgttcttcttcgcttccatggcgaagttcctgcatggtggttggttcacgatgctgcttaccttcgcgattctgctggttatgtacacgtggaacgaaggcacgaagctggaacgtgcgcagcgtcgccatatgcagcccgccgaatgcctaccggtgctgaagcggttgcatgatgacgatacgattccgtattttgccgacaatatcgtctatctcacgtcggatccggaaacgaagcgtatcgataccgatatcttcttctcgattttcgccgaccatccaaaacgtgcccgcgcttggtgggctgtttccgtcgagactgccgatgagccgttcacccgcgagtattcggttgagaatttcggtacggattatatgttccgtgttcgcattcggcttggtttcaaggtttctcagtcgattccagcttacattcatcagatcatgaacgatttgtcgaagtcgggggatctgccgaggcaggaaagccgctatccgaagcttgatgctgatccgaatatcggtccgattcgatatgtgctgatacacaaggcgcttatgcctgagtcgaaggtgtcgcagcgtggcgcgatttctttggaagtcaagtatgcgattcgtcattttgcgggatctccggtcaaatggttcggccttgcgccttacaatccgctgattgagatacagccgctgttcctcgcgactcagcgtcctccgcggctaaagcgtgtgtgaaacaagccgtgaaacgggctgcgtgatgatggcgatcgtatctgccatcgtcgcgcagcccgttttcgtagggcattttgtaggtttttgcatggtcttatctcgaagaatcgttggaatcacgctgtttttcgcacgctataagcaatgtcgatagccatatgcgcgcgttgcattacaagccctgtagagtaatcaaccatgtgcagattacttggattcgcggcagccggaagcaacaccagtctcaatggcgtgctcggcatgcaggccgtacgcgatttccggaatctgagcgaaatccacaacgatggctggggctccgcgctggtcaccgtgccgagcgagtcgccgtacctgcgtgacggtggcgctcccaccccggaaaccggcaccgccgtctacaagaacacgatcgcagcccgacatgatccgattttcgacgagcttgcgaacactccggctcgtggaggcctgtggcacctgcgtttggccagctcgaacctgccgctgattctcgaaaaccagcagccgttctacgccaacggattgagcttcatccacaatggcgatatttccgacgatcagggtcgcaacatcatcaccaaccgcgcgttcccggtcgatcccaacatcgtgcagtccactggcggacgttccgattccgccattttcttcgcagtgatcctgcagtacatcggttttggtttcgcactcgacgaggcggtcgcgcaggcggtgcgtgaactgcgcaaaagctatccgaagtccagctacaactgcatgatccagagccaagaccaattcatcgctctgtgcgcggccggtcgtgaggtcacgtccaagcgcattgtggaaatctatgaccagtacggccgtggcgaccaggcgcatgactatcgtgtgatgcgctatcgtacgctcggtgaatccgaagcggatcaggctgcaggccagccgaagggcgtggttgtggccagctccggtttcgatcagtgtgccgaagatggctggactcgtttggaaaacaatcagatgatcgttgcttccaaccgtaccggcgcattccgtgtgcgttccatctgaaatccgtaatctgaaatccgtatttcggaatttttcggctgaaactttcatcggggatttccagtttttttcgaccggattcagcatgcggcaatcgtcatacagcgcctaagataggcggtatgacaaccggatatattcctacactcgcccaagttgacgaactgcatcgaaaaatcgcgcaatcgcaagccgcatacgatttgattcacggacattgcgtagtcgtcgccgacatcgcacgtcgcatggcacgcaggcagaatgcactgttcacccgccgctgcacactaccggacgatgcccctgaaaaagcgggcgatttcggccttaggcttacgcaagacggcaatggaagcgaatcgttcggtatgcttcgcatcccctccattccatcatcggacgggcttacgggcgggaccgttccgccgaggctgatcgacgagcatctggtggtgatcggtggtctgctgcatgatatcggcacgtattttctgctcaagcaagacggttccgacggtggaccgctgaaattcgacggtccgaattacgtgcggcatgggcttaaaggctacgaatatttgttgaatgagggtgttgacgagtctatcgcgcagttcgcgcgcaaccacaccggtgtgggactcaccaaagaagcggtggaatcgcaaggattgccattgcctccggccgactatgtgcccatgaatcttgagcaggaagtggtgatggtggccgacaagtacaacagcaagtcgattccgccgaagttcctgacggccgaagcctatgcgcgcaaggcggcccgtttcggcgaaagtaacaggcgcgaatggctgcggctgctcgaacgatacggcgtgcttgacgtcacgccgctcgccgagcagtaccacatgcgtatcgtcgagtagggcagaccgttttcagaacacgcaagccctttggaatttggctaaaaccagaattccaaagggcttacctatgggcgcacgaaagagtctatgttcgtgcgcccgttgcactaggcggctagtcgagttccacgctgtgctccatcgcatcggcgatctccggattggtggtcaccacgatgatggcgcgcttgcggtcggcatcgcgcttgaacttcttcaacagatccaacaccacggccgcatcgtcggcatccaatccagcggtcggctcgtcggcgatgatcacttcagcctcgcagctcagcgcacgagcgatggccacgcggcgctggttcagttcgcttacttcgccgactgccaggccggacgtcacttcgtcgaagcccacgcgcttgagcagttcgcgggcgatcacaggcttcggcttgaggaagttgcggttcgacgcatccatggcgtacagtacattgctttccgcgtcgaggtcggggcggaaagcgaaacgttgcggaatgaatccgatgcggtgtcccaacatttcgaccggttcgacgtcgctcaggttggtgcttttgtgcatcacgttgccgcggtccgtgcgtaccatgccgaccatggtggccagcaacgcctgatgctgttcgcgatcctccgcgtccacgagcaccgcatgcgtggcgcccgcatggaacgacagcgataggtcgtcgagaatattgcggccggtcttgcgattgatcacggtcacatgatcgagtgcgaacgtcggattcgctttgaagaaaaacgcatccttcttgcgatgatgcttgatttcgcggtcgagctgtgaggagacgctggttgcggaatcggctttcaccatttcatgtgattccagcacggtcggttcgtcggaagaacgcaaggcaagcgtttccctcacctgattcgcattgttggcgaccacatccgaaccatccgcagtatcagcagcagttgcagcgtcatctgcaacttcagtggtatctgcattatctgcagataccacagcatcgccgtcggcagctactgcagtatcgccatcgtttacatcgtcggaaatttccgcgccgtcagttgcggcaatttcgatatctgcattgtcatcgtcgtataccaccgcaaaatcgatggattcaatggaatcagcggaagatgcgtcagctgcaatatcgtcagtcgcaacatcatcgacggtctcgtttgatgcggtctcggcagtctcgtcgaccacggtctcgtcgaccacggtctcgtcgaggttctcgttcttatcattcatgttgtcgctcatgccttcacctccgagcgttcctcaaacagttggttcaggttgaagcaggccacgcgcgcgaatgccacgatgccaagcaccaggcatgcgcccaagccgtaccagatcacgttccacaccgaagcggacgtcatcgacacagcctgcccgccggcccatgcggtgccgatcggcttcgccaacagcgcgcccgcaaccaaaccgacaatccaacccggaaccgtcatcatgaacgtttccagcatgaactgccatcccaaacggcccttggtcacacctgtgatcatcgccatgccgatctcatcgcggcggccgccaatcgcagcacatgcaatcaatgccagcaaagcgatgccaccgacaatcgtcacggcaatcagcatgatgcgcgctgccgaagcggcggaatcaagcggctcgatcgacttcttgtaagcggtaagcgacggcgaggtgatctcgtacgtcttcgtgtccaacttggccttcttcaccaagcgcacgaacgtgttgtaggtggaaggattcgccagcgagaagatgatattcagattcggaatggcccatcccgtggcctccgtcgtgtcaagcccgttcttggcgaagttgatatacgtcgtgtagatcacgttctcacgattgtcctttgcgtatttcgcgtcggatccgttgccttccggcacgtcgctgtcgtattcgtaaatgccgcgcacggtgaacgtgtatgtgtcggaagccttcgacggattgccgaccgtcactttgtcgccgaccttgagattgttcttatcggccagcgcctgcgaaatgagtacgccgtcgctctgcgtcttatagctcagatgcttgcctttgactaccttgtagtagccgtagtcgttgattttcgcggcgtccaacgtgtagaacgcctgcagagtcaggttgccgccggtcttgtcttcgctggtgtcgtttttcgcggcgatcgcctgcaacgacttgctttcgcgcaccggcaccgatgttgccaacgtgtaattgaaggtcacgttgttgctctgtgcggccgttgcatacgtgctgtacttttcccacgtcaaatacttgtcggtatagctggaatcggcaccgtcgcgcttggcttgtgtttgcgcgttcggacgaatcaccgccgtggctttttgcgactggtatgtttcattattggcggtgtcgtcggctcgaatcactgccaagtccacggcagccgagaaagacaccagtagtgcgagtagggcgatcagcgcggtgcgccatttgacgcgaccaagcgccgcccatgcgttcttgagaacgaacatgcggtacttctccagttctctgttatagcgcgccggcgcatgccgacgtcagcgttggccgggacgcgcgctccgcagcaaggcaggcccgtagcgcatgatgcgtcccgtgcaatcatcttgggcttccaacgtgattgttttcttgcgcaacactgttatacccctgcatgaagtctgaatgattcctgaaaagtgattccagagaataagcgttgagcatggttgcggcactcgctacgatggaatcgatgacttccgaacagattacgaataccggttccgtgtcgggcgattgtggctcggctcaggctcgtgcgcgaactcatgtgcaggcttatgtgcagactcaggctcggcagaatggctcggccaaggatggttcggctacgaatggtccagccaggaatgattcagccaagggcggtccgtccgggcagaaacatggcctgcagcggtgccacgcgatgctgcgtcctgcatcgcgtcacgcgttattgccgtggcttacgtcgattatcggcgtcgcgtccgcactatgcctggtgattgcgtggttcccctccacggtgtggaatacgccgatcgtcagcagcgatgcccccgcgcattactatttcattcaccgtctgcttgacgagggattgggggcggctctgcatttgtggccgcatgattcgttttatccgccgttgtttcacgtctgtgcttaccttgtgattaagatcgcggcgctgttcggcgtgcaatgttcgatctacgcggcattcaatatcacgtggatcattgcttcgggcgtgattttccctgccggaatgctggtattatgcaggtatttcctgcaacgttggaatcgcggtaatccaatttccaatccaatttcacgtatttctcaagcatcgtctacgcctgaatcgtcgtccgtatctgaatcgtcgaatgtttcaaatcagcaggtatcgtcagctgtgaatcggcaatataacgtcactttcgacgctactttcgttctgcagaatctgattggactgttcgtgcccgtgcttgccgtcagctcggtgtgccacccgtacggactgctgaatgccggtccgctgatcgcattcggtttcgccacgtcgctgctgccgttcctcatcgccgccacattgcgcttgttcgatgcgatcgccgcgcgcgagcatatagcaaaatggcttgcgatcgctgctgtcgcaggcgtggtttgcctcgttgcgcacccgcgtatcgcattcacgtatgctctgattctggtgccgttcattgtgctgcgcttgccgtggaagctgattcttggcgcgttcattgccatgtgcgtcggtgcggtggcgtttgtggcgttgatgctgacgtcgttcaaatcggaccgttgggcgaatcccgattcctggttccatagccatcagccgtccaagaatttgtgggagtcgatttcgttctgtctcacggatgggcttgacggttttcctgcgattctgttcgcactgttgctgattgcgggaactgcggccgctttcgtttgcgcttcccgccgcgcggctgcgcgtgcttcggattcgttttcgtcggctgcttccactgtggttcccgtggcttctgctgatgtcgatgttgatgcttcgacttctgatattgcggtttccgccgctgattccccggtttccgtttcctgtccgccacctgcgtcgcactccaacgccactgatgccgcgtccgcgtcgtccgaatcatctcgacttcgtcgcaacgatcgcctgcgtgacgtgattgcgttgacggccgcattcctgctggtcgcgctggtgtatgtgtgcacggtcacgctggtcggcgcgttgccgaatatcatcagcgctccgtggtatcgcgatgaaaaccgtattatgaccatgcttccgctggtcgcgctgccgctgcttgtcattggaatcaacgctcttgccgaatgcgtttccgcgtgcgccgcatccgcttctttcgctccttctgcatcgtccttttccacgaagaatagtgcttcttccgttccttccctttcttctgcgtctgctgtttcttccgtgaagaacgcttctttcgcttccaattggatcgtcctaatcgccgtattccttgtgattgcgatacttgcggtttccgcgcagatcgtatgcccatcgcgttccgcggctcgcgacacgatcatcgcgcattccagtctgaaccaaagcgaccccaacgagcagctcaccgagcaaaagatcgctgtgctgcgcaaggtcacggaacgtacgggcacccaggccaccatcatttccgatccgttgaacggttcgatgtatgcggagacgctgttcaacgcgaacatgctgtatccgatcatcaatgcgcgcaccgatgtgccatccgctccgttcggcaaagtggagaccgcgtttgcttccggcgatgcgcagcaggtgctcggcacggtatgtccgctgaccgacgctccggaatacttccttacgatgggcgaccaggcgcagagtctgcagtcattcccgtatcgcgcccagtacgattccttccacaatgaggaattgattgatacgtatgtggatggcggcacgttggtgaaggttgccgattattcgcaatacggccagggttgggccctctaccgtttcggttgcaccgattaatcgatttttggctgcgctgccttgttctgccgtcgcttgcacgcgcatatgcaaaaccgcactttcgatcagttgggatctgaatgtgttcaggacaacgatcggcggtgtggtttcgtttatctgctttcttctgtttctcctatttcagctttcggctgggaggttttctcggatgggttggcttgggggatgggccgtaaacggatagtgtggttgcgacacgcccggatgttgacctgtagcgaggtatgttgaggtttttccagcgggattgtgctgtgaaatggtgctcatcactcgattttcccgcgatttcgacacgccgagagatacgttatttttcaacggtttacacggtgtttacggaaggtcgatttgcgtggatcggcaaggacgtgtaagtttacatctcgctgctcagcacggcggttccgctcctgaggttcgggacggtctgctggtgtggtggtggtttgagaactcaagagcgtatttgtactacttctttatagtcaatgattgccagttcatcgtccgctcgttgaggaaggccaaggacgacaacagattggacgccgagctcaagtcgataggcagggccgggctggtcatcatcgacgagctcggctacctgcccatcgacatcgacggggccaggcttctgttccaggttatcgcggacagctacgagacccgcagcgtcatcttcacctcgaacctcgagttcagcagatggggcgacgtgttcggcgacggggacatggccgccgcggtcatcgaccgcatcgtccaccacggcaggatcctccgcttccacggcgaatcctaccggaacaaacactccctcatgaaataaaccaaacaaacaacaaaacaaggaaccaaccgccgacggtgttcaagttgaacgccgacggtgtccagattaagtgccgaacacgtccacctcaatttgacgaaatacagggcgggccgagagccgcatggcgacgttgggccggggcgaggagttcgccgacttcgcgaggatcgaggaggcgaccggcgcggtcttctacttcgcgctgccgcaccatccctggcagcgcggcaccaacgagaacaccaacggcctggtccgcgagtacttccccaagggcaccgacttcgacgcggccggcgacgaacgggttcgtgaggtgtatgatgcgatcagccacaggccgcgcaagcgccatggcttcaggacgccctacgaggtccaccattcgcagacgttgcacttgctctgaaaattcaagccccataaagcctaaaaagagtctcgaagattgagatctgctgagtttctcgtgtaccgtaccatcacggcagaaaaccgggagtggaatgaatgctgctcaacttacggaacgtgcccaacatttttcgcaaggtatttggaccgtgccattccctagctttctgatagcgcgatagcctatggccgccagagatccttgccgatcggaagacaaggcggaaggtgtgttgcctctgaaacgaagagaacaatctatttttttcttaaaaacgtaactgatttacgaataatctaacaatttccattgttggcgtgtaataatatgtaagaaaggaaggagagccatgattcgccttacgtcacttgagcttaggaactttaagaacataagggaaggcaatatcgtcctttcctcatggagtacaaagcgttcccttcccggttcggacattattggaatctacgggcagaacggttccggcaaaacctcggtgattcaggcgctcgctgtgctgaagaatattttctatggaggcgacatttcgcgatctgccgccgattgtgtttccaagaagttcggcgatgagaaagccgaagatgcaaggatatgcgttaagggcgttaaattcgatgaggattctcagtccgcagtgtatgaattctcctataccgttgctatcgctgaagcaggttcgcgtattgcggaaaccgatgaggggcctgtaatcacagctgaggaaattaccatcaagaaattcagtggcaaggagtcaaagcgcaccttgatggcatataacggaggagatgattcgtgggattacgagatcaggcccaaaacagcttggaaaaacatattcgcagcgaatgagaaaatccgaaccgaactggtcgtggagcaacgtctcgcccttaagaaccatagttcgctgatcttttccaatgatttctttacgttgctttggaaagtttgccaacaagacgatgcgtccggtggcgatgcgacgcggggaaagacagacaacatcggtcaactttacgaattgattgcatccataaagatatttgcaatatccgacttcgcaatcgttgataccacccgatacgcgatttcgataatgaatcatctgaagatgtcaactcatgaaggcgaatacggggtttttgccgatgcttcgttcgatgtgaacctgctggagcccaatgatctgaatccaaggcaactcgatgcactgaacagcacgctgaagaagatgaaccctgttctgacggcgctggtcccgggactctccttaagcctgtataggttcggtcagagcctgggggatgacggcaagcctgtcgaacgtgtgcaaatcacatgcgtgcgcgacggaatcgcattgccgctgcgatgcgaatccgagggaatcaaaaaacttgtatctattttgatgctgctgattgacgtctatgcgaagccaagtgcttgcgttgccgtggatgagcttgattcaggcattttcgagttcctgctaggagaacttctgcaggtgctgaaagagcatgggcgcggtcagctgatttttaccgcgcataatcttcgtccattggaaattctggacaaaggttcgctttatttcacgacgacgaatccagataatcgatacatcaaattccgcggaagcagagaaaaaaataatctccgtaatcagtatctacgcgcaatcaatcttggtgggcaaccggaaaccgtatatgagccgacgaattccttcgacatcgacggcgccttctacgatgtcgggttccccgaggaggactgagctatggcgattgccaaacaggtgatgatattcatcgtggaaggccccaccgaggaaacagccctcgctcagattctcagccgtatcttctcaaccggccagatcaaattcgagatcgtgcatggcgatatcacgaccgaacgcagattaaaccctagagaacgtgttcgtggcctcgtactccaatccctgaaactcaacggataccgttggaaggatatcgctcggattgttcagatcagcgacaccgacggtgccttcattccagatgaatgcgtgagggaatcagacgacggtgaaatccattatggcgaagacgggatctgcgctgggaatgtcgatgtgctgcgtgaacgtaacgctcgaaaaaaacgtgcgatgagggaactcgctggtatctccacaatcacatatcaaggaaccggcataccgtactccatgtatttcttctctcgaaacatggaacatgcgctacacaacgtatctgaagaactctcggataataagaaggtgcaactggctcaacaattccgtcgccgatatgcgacgcacatcgacgaattcaagaaattcattgcaagcgcaaacgtggcaatcgacggggactaccgggaaacctggcaacgcataggcagcggaactgcctccctgcacaggggatcgaatttgcacttgctcattgccaatagcccagcaccgtcgccagaatcggcgaccggcgcaaacgagaattgagccatataaccatgtctctccggcaacaaggggacgcgtgtggtcagcacagctgagtattcaaaatggtgcggatccgaggtgtcgccaatcaaatgcgctacggggttgcttgggctttcagggagttcggaaagccggcagcgggacaagggtgtcgttgtcggcttgagctgaagcaaccggtgcttgaggcgatcagtatttgttggcgccttctccaatgaagttgacggtgaatccgcagtggtaatgcaggaacatgtcggtaccgtagcggtcgacggggcggtgggtgaacagcatgcggatggcgaatgcggtctgcgcgtcatccggcagattcatgaacttcttgtgggcgtcccgatacggatgcatggtgatggccgcgtccggcacgtaggcgtatccgtagcagtcctcgttcacatagcccatgaacggtagatcccaagcgtcatgatcggtgagctcctgcttgaaatcctctaccttggcgagtgcttcatcgctgatgcccaggtttttcgccaccttgttggcttcggctgttttggcgtcggcgtccttgtcgaacatgtcgagattcacggtgatgacggttttctcgtttgccatgggtaatgcctttctataagccacgcataatgtgcattatgcatgttcgtttgtaatcgcaaatgaacattatgtatgactggtttgtgttgtgtggggtgaacgcttgctgtgttcgctattgatgctatcacgcatatagaaggtgaaatggttgaaaaatgaactttttgtgtattgtggttttgtgaatcgttgtcatagctgggtttacggcaagtgtcatgcggttttaaaaaagataacattaagcgtgttgtctttttatggtattccgtgttctgtcatgttcgaatgaacatttgaagccgtgaatcgttgtggcaatatcatccgttgcgcggtgaaatcaatgggtgcatatagtgcaatgtcgagtaaggtggttgcggaaaggggcgcgtgtgattcgaccgaacaatagtgaatgcgaagtggccgccaaggccaaggctggcgtcgcaattgatgatgccgctgcacaggcgcaagcgagtggcagacaatcggcggggcgcgccgtttcctatcgcccaatgctgcgattcctggcgacgcaggatcgaaacgtcatctggctgttgccgggcatcgcgcttctcccggtggacggcaccacgctcggcctgtacgcgccgttctggtcaccgatcagtcccgtgctattcgccgtctactgcctgtgcaactggcggcagctgcatatcgtagccgtgaagtatctgcccttgttcctgctgccggtcgtctgcatcatcctgtccattcccgggtggctgcgtttcggcattcatttcaacgccgcattcatgagcctcaccgggctgttcggcatgcttgccacgttgggtgcgcttgtcatcgccttccatatcaaatgcatcccctggaacatgccgatccggctgcttatcgcggcctactggtgctccttcgccgtgggcgtcgtgcaatggttctccatccatctgcggttcgagccgctcgtcaactatttctcgcatctcatgtaccgccagtacatcaccgatagttcggtgtggggcggcggtcggtcgcaattcctgttcgcggaacccagctatatcggcatgcacctgttcggcatactgctgcccctcatgtggctgatgcgaggtcgcgacagcatctatgccaaacggctgcgtgacctcatcgtcgtctacgcgatcggcgcgatgctgatgcaggccggcaccagaatcgtcatcgactccgttgtggcgctgctggttgccatcatcgtgcacaacacgtggcatgatcggaagcaacggctgcgtggcatggcgcagtttgccggagcatgcctgcttggactgatgggcgtgcttgccgactccaggctgacttccattgccgaaaacggcgcgcagggggatggttcgttctttgcaagaatctaccaaagtctcgatccgctctgcggcctgctcacccacccatggaccatgttcaccggttatggtgcgggcaacatcatcaatgcggtgtgggctggcgcatccaaggccgagcagctactaaatggtcttggcatgaacggcggcgcagccacaggatttgcggccggcatgaatgcggacaccgtatggacgatgtgtgggtataccagcgtcgtcgccgaatacggattgatcggcctggttctgctggtcatcgcttccatagtttccatgacgcgtgtcttcgatactgcagctgccgagcatggtgtttggagcaagactgttatctgctggcttgtcctgatcgtgtacctgtatatccagtgcgagaactacgcgttcgccgcgctgccattgtttatcttcgcggcaagcaagctgcgtgagtaaccgtatttgacggggggagtatgtcttcttctcgataacgtacagttggagaagccgctatcgcaagtattctttaacctgttcacaaggcggctgacattagcaatcatttgggtaggtatgttcgactgttcagttttttgagccttgccgctctggagctgccataagcgaaatgagacgtgtttcgttgcttagggtgcagtggtcacggcctgttcggaccgcagctcctcgatacttatatgcaagacggcagtcgatggccgtctatgctgggtgaagtgatctgaagtgatttacaagctgcggatttgcgagccgaacggccatagcgctaatttggccatcttgaacgactggataccgaacggaataccgatgatggtgacgcagttcagcaggccggcaagtatgtagccaatcgccatccacaaaccggccagtacgaaccagatgatgttgatcagcacggatcccacgccgccgccatactccacggtcttaccgaacggggtcaacgtgagccccgccatcttgaacgcctgaatgcccagtggaatgcccacaatggtgatgcacaacaccaaaccgataatggcccagctggcggcgagcaacagtccacccagaattagccacagaatattgccaataagtcgcatacgcacatgatactgacatgccgtgccgatgccgataagtggcaacggataacaacaaaagatacaaaaagcagcaaagccatgtgggaaggatgtattttgcttcgccataagcaaaaatggcgaggcagatttatcgaaccttaatcgaaccaagttttaatacggttgcattgcttggcgatgcctacgaatatattggtcaaacttttattttgctttccgaggtgttgctggcagcagcgtattgaatggatttttgcagtcacttaattgatgcggctgcaaaagcgatcggtattttctggctgaattctttgagtgcggagcggcagaaaacagaatctttgataagtgccatgtaaaactgctcaacatctgtttgattgaaattgttggagcgcatgcgtcggatgatatcctgcgcggaaaggccaccctctgattggtatttttcttagtgaaatgtgctgttgcctgtcaaaaatattcttgatgaattcggaccacggtggagcagccattgatattgaccctcttgtgattccaacgcgcactcgccaatgcaggcgttttgtcaaaaacacggaaggaggtttgggttgcgggaatgcttgcccgcgttgtcttcctgaggatgccgattcgcatcgagttgagtgaatacgtcggacgcaaacggtcggccggcagtgtcttctctctgttcgacaggcgccgcgggttggcacccgggtctttttctgcgtgcctccaccacctcccgcatcaacgcgttcctcggctccagttcctcgatgcgccggcgcaacgcctccgcgtcatcgttgccgtccccggcattccggcttcgccgcggcgcgggtttgttggtctggctggcgttcctgttcctgggtcgcagcgcggccatgccgccttcccggtacgccatgacccagttgtggaccgctccgacgcctgcgccgagccgttcggcggcccgcttggtttgctgtccatcgccctgatgggcctactggtgcgtggacttggcctattgcttctaggactggcctcaacagcaggtcagctaattggttctatgcttatcgattggctggttccggctcttggcacgcaagtctatctggtaacggtgcttggcgcattcgtcgcattggcgggtgcggtcattgctgcgatcccatcggctaaaaacgaatccgatgcggcggcgtcacagtccattgcgtaggaacgcccaatggtccgcgacactggaatgtatctccatcgcggctgcaggatgcatttcacctcaatcgaaaggtttatcatgtgcacgggaatagagataataagcaatcaaggaaaaccttattggggtcgcacccaggacttcgagcagcattttgaatatgctggaatgaaaatcccggcaggaacaaagattgaatccacgtacaccccctttatggcagaaatcgccactatgggaatcgcccgggcaacagacgtccatgcccatccggtgattcttgacggcattaacgaacaaggcatatgtgggggatcattctacttcgaccattggtaccgctacgcttccgatgaggagatacaagcccagggcaaggtgccattgcgaggagaagagcttgttacttggattcttacgcattattgttcactggacgaggtcaagcagcgtctgaatagcgaagttggaatcgtggatgcgccaggcccgatgatggggcgatccgttccacagcacagcgtattccaagacgaatcgggacgctccatcgtagtcgaaccgtcctccaccaacggtttcgcaatttacgagaacaaggtcggcgtcttcgccaatgctcccacctttgattggcatgtcaccaatcttaagatgcatctggagcgttcaactcatcgtcactattcatacgacattaatgagccaatcgagtctatcgagctcgacgaatggacgagcggattgatggaataccttctgactataagccggacacacgctttctgcgggcggcatataccaagctcatgtcccttcctgtcgatgatgattccgccatcaacgaggtgttccagctgctgactgctgtcaataatccaaagggagttctgcgccctgtgggaaacggacaggtgctagtcccatggacccaatacactgcagcatacgacatcaggaaccgtgtcctttatgcgcatacctacgataaccgcaacgtacgcatgctggaattcggaaatccgcgtgagtgggacaaaatacactatttcagttttatctcccgacaaacctacgagccatttgccgaagaaaactgatgggtgacgggcatcctatgtagagtctagtcggctagatatgcaattccttgggttgtgcctccggctgtcacagcagtcggaggcacaactttttgtacaaaataatctagcctttcgctgtttggtgtgggtgaattctgtcaggtatgatggttcgtaggtcgtgtttgccgcaggtcagatagatcatcgtgctggaatagcccatgtccctgaagccccttgcgcgggttttcacattctagatgacgcttcccggacccctgaggaccgcgtggtagtgcccgaaagattgcgtactttgggtcatggccgcccgtggcacgatgatcagtccgcttcctccagcgtgacgccaagccgggacatgtcgaggtagcggcgcgagctccactcgttcgcggtcacgtaccgtatgcgcgcgcatacgagcatcagcgcgctgtcgccgtccgggaagcaaccgacgacgcgcgtgcggcggcggatctccctgttcagccgttcaatcatgttgttcgtgcggatccttctgcggtgctcggcggggaactcgggcaggaggtaggtcgtggcctcgcctatgccctcgcgcaggcacctggcggccgccccgagcctccgcccctccatctccgcgggcgacccgcttggctttggcggtgagcccgagccagtaacggcccgcgcggtatgccttccgtccgccggaacgctcgtacatggacggtcctggcggatttcgttggctttggcgtcgagcatcgcgttgagtacctcggacgccttctgcgtgacgagccggtcgagtctggccccgacatgtgccggtcgatccgtatgatgttctcgggcatggttccgtctcctggtttccaatcgcggtttttcgttttggcgaatgaagaaatcgtgcacaggacgcggggccatgcctttcacgtcaggcctgaaaacccaaagtgcgcaagaattcggacgttatcctcaaagtgcgtaaaatctggacattatcacattctagcaatcgtagttctgaggtagacgagttagaactggagaaattagatttagattcgtcgtgagtggcgtaaaaatgaagtctttgtgtagcagaagtgtgcactatcatgagtagaaaagtgtaattataagtggaggcaatatgcgacttgaaatccggaacataggtaaggttcggcatgccgacattgccattgatggaataacagtgattgcagctgccaataataccggcaagagcactttggggaaagcgttatattccctgctgtcaccgttccataattatgattccaatgtgcgcgataggctagtgcggtccgtttttcgggcgatgtctcagatggctcctattgcgataaaagattcacgttcctctaccggtgtgtttttggaggaaacggtgagtagccgaactatgagggtgcttgccgaaaaaatagttcaagaggttcaatatggttcggaaaggagcgaagaggacgtttctgcgggtttcttaaacattgctacacaagatgatggcgagtgcaaaaaagaatcactttcgcaagagagatggcttagatgggatgatttagagacaattagctctgccgctaagcattttggcgaggatgagaaatatattgtcattcgtcagcgtattgcagaattgctcagcgtttcggatgaacagaatgctcaaataattacgcaaagaacatttgaaacccaatttggggaacagattaagggactgtttccttcttcaggtgatgagtccgagatcgtattttcagatgatcagaacagaagtcaagttcattgacaatagatgcgtttcaagtctccctgcaacgaacgaaagacgaaatatctacatccttgatgatccttctctgatcgataacatctcagttgcgcacagaagaagactatcctcgtcatgggggcctaaatacagagatgaacttatcgaggcgatgcttaatcgaatggaagatcttcggtcggatatatatgacgatttggctgggtcggtagttgcgcaagaaaaaatgcaggaagtattgtcggtgttcgataatgcgtttcacgctgttctcgcgccatctccgtctggcttggtaatcaatactgacgagaaagtaaaaaatccgattcaggccggcaatgcttctatgggggtgaaagcatttgctattatccgtttccttatcgagaatggaatcgtttcagatgatgacatactcgttctggatgaaccggaaatccacttgcatcctgaatggcaggtcacgtacgcgcacgcattggtgcttacggccaaaacactgaatgtgaaaatgctcattactacgcacagcccgtacttcttgcaagccttggtggactatgcgtacattctcgactatttggatcagacgtcggtttacactgctgagtcgcaggatgatggctcttcgacatttgttcaacttgacgatgcaggtattgctgatactttcgatagaatggctcgtccattcttgacgcttcagaaagcggtcgctgagaaggatatgaaagggtgaagcaaaatgctgacgccagatgaatgtctttctttcctgaagatgcagatggataggttcttggagactgatccagataagcaagatgaatttggcgatcccgttgaaacgattgctcggttgtccttcgacgtgagcaggggagaatcgcttgtagagaaagatgtacggcaaatcaacttcgacttatatgcggagacattccgtgaaaaccatactgtgtcgtcttctccatcgtgtgatggacagaacgaatcagttgacggtgaacagcatgaaatactacggccctcatcatgtgacggtctaagcaaatcaaatatcagtgataattttttctgttttgttgaatataaaaacggtaatatcgttgcttatgatcaaaaaactggcgtttatacaattaaacagaagccggctcaggaaatagaaagaaaactgaatgattctgcttatatgctggagtgcgatggggtgataagtgccgaagttcttggtcgacattttggcgtgatcgtcgttgtccgggatgaaagggtgcaacgccagaaggattgtatggtttctgttggaccaaatcctttgcttatgcatatacaagattcagttcgtgaatttaaattgcataaaggaatcagcgcctccgagtctcgttatagttgggttaaaataatgactgtttcccaatttactgaggtttaccttccatttcttgaggatgctcgtaaaagcgtgaattgagaagcgtgatttgtttttcgaatgtgatagaagtccatcgtgttgtgtctgtttactcgtgagggtttcaataaagcacgaaggtcgtctttctgtaaagaagaacgacctccgcaaactggacactgcccaactttatcgtgaataaaagtacatgtaaccgcataaaaaagtacattcagttttgctgtctgcacaagtccggaaaagcggcgttgcggtaggttgtgtagacgcgaaaactacatgaaggtcacgcgaatgcgtcatgaatgtcccagacgaattcaggtgggcggtgctgtggtcgaaatagctgcgtaagaagaaagattgtatcatcctcccgatttgatgcattaaacggaagcggaaaggacaaatttttctggaggactctgacctataaccacaaacactaccgattgttttgttaattttatggttcacgtctgagtttgcatatgtccgatcaccacggacttgcacgcttttgggcactacccagctgaaatcagtgtgcccgtctgcctgtgttctagtgggactatgtttttccgtcgaatggtcgctgcgatattccttgcgcatcaatagcgactaccagtagtatgacgagaaaaaatgtgctggtggttaagactgacttgttccgaacttgcttaactctgtaatgggcatacttttccttggttgtgttatgcatagcatgcgattcgcatatccgacactaagcttaaaatcaggatatgcgaatcacatgctgttacctatcttttacaaataaagaaaaaataggtgttatactaccttttaaagggtagagataatcacaattgtgagaatcatgataacgatcagatccttcattattgctcctcctttcgataaagaagatgccagcgatgatttagaacgttgacgttggcatcttgttttattttgtcagtccgttagcgtcgttctgcgtactgaaggtctgacaggaatttttctctctccgccagaagctgttgcttggcgttgatttcctcttttaaagtgtcgacttcttctttgactgtcgagattaactgagcaactgtaagtatgcgagactgtggctcagtctcaagcggttgaattattccgcgcttgagagcaaaatcttccacatcactccttttgaagaaaagcttattaccttttttttgtgatgcgagtttcccttccgtggcaaaacgtgcgacactgcggcgagtcacatgcaaaaattcagcggcttccgtcgaagacatctcagatttggcgatgggagcttcaggcttggtttccatggttcctccttacttagttaaggataactggatgtggcgacatatgagacattggagaatgcgacgtcctttcgagctgctgggacaatactgtcgactaaatcagaaaaatgataacatagctcaagaacaaatgaagcggtgagacgctggcgatctcgatatttagttctgatcggacgtagtgaaggaatcttgcttgcatgtccgtctccggatcctcaatgcgctggtggcaccactagcagatcgccttgatccgccgcgctagggacaggccgcggtggtggcgcagcatgtctcggatgcgcgcgctccacgactcgatgagtttgctcgaggacgggatcggctccgcgaacccgtccggcgggtcgaggaacgtgaatggctgcccatccctgatccgtccgtgcaccatccggcgggtcttggccaggtgcatgtgctggtccgcgatgatgccgtcctcccaacggctcttctggtcgaggaatccggcgaagttccgctctcactggttgtacgacgccatccactcggcggctgttctgacgtccgagacgcgcgacgatgtggtggcgcgatcctagacagcagcgacgaccaggccgagcacgtctcactcctcgccacgtgccatccgactacgtggccgccggagaccgcgatgagcacaaccgtgtcgcggtgcaggtggatgccgtcgaggtgcatcacgtcgtgcgtggattggctacaatgtgttagacagtccaatgagggacgaatgacgtgggattggaggccgatgatggccggcccgaaacatccccgccactacgacggggcgttcaaacggcagatcgtgcagtcgtgcgagagcggcaagccatcccgggagatcggggccgagtacgacatcgcgcgatcgaccctgcggcgctgggtccaagacatccgcgaccggcggttggagatggaggcggacgtttcagaacaagcggcgccggtattcacacgaaggcaggcgtgatacgggccaatgccgcccgatatcgtcgcgatgcgggatgctgggcgtccccgatccacctgttactggatgaccgggcatctcgggacggagcgtgtggatccgatcgccggcgacgtgcgcgcggtccggcgcgacagccgcggacgctacggcgccaggaagatcaaggccgccttggaaaggaagggcgtcaccgcgtccaggaggcgcatcggcggcatcatgcacgaacagggcatgacgagcgcgtacacgcgcagacgattcaaaccgcacgggacgcgggtcaacgaggcgaagctcgcgaacctgctggaccgcgagttcgacggctacgccccgcacgcgcatctggcgagcgatcttacctatgtccgcgtcggcggacaggctgctgaagaaggagctcgtgtaccggaaccactacaccacgatcgagcagccgaggcatgaccccgacgactgcgtgtggtggtccgacgaccagcggctccactccgccctcggataccggagtccgaaggaattcaccgaacagggactcgtcctctaaggacccgtccaacacaccgttgccaatccagggtgtatgatttgtcgcggaatgtcgagcggagcaatgaggctggtttggagaaagaggggtcggtcatggaggagtgcgaagttagaggtgtcactgatatgacggattctcaagaagtgaagaatgtctcagaacagcaggacgcccttgaactgaatccgctgtatccggaatatcaggcggaacatcatagtgaatatgtcgatgctctcaaaagtgccataggaagtgataagaagggcaagctaagaaatatagcgatatctggaacgtatggttcgggaaagagcagcatcctcgagaaagtggtcgaagactttgaaggggtaaaaccgtgtagcacaaagaacatttcgcttgctccgctggcatcctgttgcggtaatgctgaacggcgatctgataataatgaaaataggcatggctctaagggccctacagatgatttttcgacagacactccgacgaatcggattcagcgggagattgtgaagcaactgttgtacggtgtcgatccgaaagatgtcccgctctctagatttcatcggattcatgagaagggcaaatgggagaagatagggttttccttgatgacgagtgtattcctgacgatgttgttgggggcatttttcggtgatgatttaggtaaattcgggcaatcattgttgtcttctttgccgtttgtcgataaatgggcgataagtccatcagggaagtttttgctaggctatgtagtcttgctagtgcttcttttcgcggcgtcatggatgatctgttcttatcttctaaaaagcaatctgaaaatcgggcaagttaatgtgagtggtgcctcgttgaaattggatcagggagttgactcatactttgaccagtatcttgacgaaattgtatacctattcgaaaaatcaaagatcgaaaccgtgattttcgaagatctcgaccgatttgaaagccctgaaatcttcgattcattacgtgaattaaatcagattctgaatgacgatccagttattactggggaaagatctcgtcgagatggaagaactatccgttttatttatgcaataagtgacgccgtgtttgatgatcaatgtatcaaggcctcggaagaaacattaagtgaagaaaggcgaataggagctttctctcgtgcgaaattcttcgatcttattatttcagtagttccgtttgtcagttcaaataattcccatcaaacggcacgaaacgctctaggcgatgaaatcactcgaatagacaaagtcggagatctacttgaagacgtcgccggttttattccagaccagcgtacttggataacgatccgcaacgatttcatcatgtacagcagaagactgcatgttaacctagatgataagaaagatgaggagaatactcttggactatccgccgcgcatcttctcgcatttttgatttataaaaactgttaccttgcggatgcggaaaagatgagagaaggcaacagcaagatcgacaaaatatattcgactgcacggagcatttccacagatagcatttataggctatcccaacggcgcaaaagcgcgcaagaagatttggaaatggctttagactctatggaggcggatagaattgcctcccagttggcgcagcggacgaaagcgtggattgcggaactcagcggcggaaaagtcgatgatgatgacattaatatctctggatatagcggctctaaattgagcgaagcacacacctgggaagagctttcagcaaagcgaaaggattctacaattaagattaccgcttctttctatggcgaatctggttggcgtccgattgaaatcacaccttcaaaacaaacttttgaaaaataccttggcacgacaattgatattagtcagctgacattgaatgctgtcaatcagaggatctgtaaaattgaaaaccgcattgaaaatctgaggacaggtgattggaaatatcttctgaatgataaagcctgcgagatagatttcgagggtcccgacatgttcgatgattcagaccgccagacattgtctcagtttatccaagacgatctgcatgaacagggtacgttgctatcaagtttgattgccggtggttggatcgctcaagattacaagctgtattccacgatttattcagatgaaggcatgtcgaggaatgccctaaattttgtaatacacaatattaacgagaacaaatctgatttctctttccatctcaacgatgcggatgtacagaatgtgctgaaacgcgtgcgacatcgagataattctctcttcggacaagcgtggatgctaaatatcagtattctcaactacctggtgaagtcaaaagcagatgaagataaaaagacgctacgcatggttatctcgtatctatccaacttgaagggtgtggcaaaggatttcttgcttgcgtttctcagcgatgaggaaaacaaaacagctgaagttcttgaactgcttgcggcggacacatgctcggagatactggagttcttggcggacgatgttgctacgttagctgacactacaactttgtgtgatttcctagacgttgtactgcgtcatttgaataaaaatgttcaatacgaagtttccgatgccttcaataatttcattcaacaacattgggaattcattcccgtattcagcgatgattctttagatgaagaagtggcaaagcaactcgacaaggtgctgcttgactctcattactccgctccagatctgtcttgtttgagtgaaccattgcgcagactcctcgttgaacatgatgggtatgatttcaccagaagcaatcttctttgtgcgattaacgatttgcaaggcacgtttgcaaagcatgaaatgctcgctctgaaccagatcagaagcatttccacccccgtctaccaatacgtcattaagaatgtcgacaagtatcttgacttcctgaaggaatctgaatatgcgctcgacttcgttgatgggactgttgcctcggatgtcgattcagatattgttgcagtgttgggcgactccgtccactcgatatttgacactcgcaaatcagaagataaatgggtggagcttgagcaagttgttagcggaataatcaagaagcattcacatactgctcgaatgcttcattttgagtcggacgaattaaagaacagactttcttcgggaattgacgatgaaacacggaaacgaatcagcgtttcttatgtcaatgagttactgcggaatgatgcgatttggtttactccgatgaatctgcagaccgtgttggagtctgttggggatgtcgaggaggcggatgcgtgtggtgagtggctaaagctgcattcttcctttgaatcaaccaaggaagacccagaatttgacaggggaaatcttgcggtcaaactgttgaacctgcctcttgatgtttgcaatgcgaagaaaaaggaatcgctggttcgctcgttgcagctcgaatcaccactttcggatgagcaggtttccaatattaaagtgggtgattccagagtattcgatcttaaacgtgagcccgatgtctatgcgcgattgttggatgataaatcgattattggcgacactgaaaccgcctttggaatgattcctaatatttgttgggaagcacgtcgaacgtggctgctgcgatctgcaaaatttattacttacttatcgccgaatcttcttggaccgaatgaggcatgtaggatcatcgccgatgaagatactcgtcttgaacctgtgctgcagaagatagtcgaggatatgtctgtttatattcaagatgcagatttcgattatcttttggaagcggcaaaggcgtggatgagtcattccggcaaaactgtagacaaggatagaaccgaattgttcgacgagctggccaccaaggatgaacgactacatggagtaaaggaattgtgggaactcggactcgaatcgaatctatgcgtaagaatgattaatcgagcgtttgacgaacaaggtattgacgatgccaatattggcgtggctcgagagatcatccagcatctcgatgtgccctatagacagttattcaatgataaaaatcgtaccttgaatactgacgatgaaaactttgtctcgttgattgcaaaactgaatcaatacgctaaacgaagtggtattaccccagaagacatatggagaaatcctcaggaaaaagatggatttaccaaatataccgtggccttttcttctgtagaaaaacttaatgaaaagattgatttactgcaaaaccaatcagcaattaataattgagcctcgttcgtctttgcatgcgttgttttgttatggagcgtgcctcgcctgcattttgctcatatttcgcttatgtatggcagattcggaggcctgaccggagacatctcacttacatatggcagacacatgcggcgaaaacctcaaaaacgtacccccgaagtggctgttttcgcaggcgacgtgccatatataagcgagatgtttccgtacgaaaagcaaaatctgccatacataacgcagatagaccggttggtgtggggtattacgcgaagtgatttcacgcgagtacacgctgcggcctacagcaggggagcggtgcgtggttttgcggttgagtttcgtacttgcaactgcacggggaatgtctcgaatggttcctcgatgggttgtccttcgatgagcgccagagccttttgtgccgcatcgacggccatgtcgtatgggcgctgtcgaacggtggttagctcagcttctttggcgaaggtgctgtcgtcaaatccggttacggaaatatctccaggcacggaaaggccgctgcgttgaaggcggaagaacaatggaattgcctgtgagtcctgatggaaacacaatgcggtgggtgggttgtcttgcgccatgatttcggaaattgccgcatctagaatgctgtcgcctttttgcactgccagtgtgcgggcggtcagtccgtcaactgcatcgcaggcttcctggaatccggaaatacggttaaatgagctgaatcccaatgtggaggaaaagctttcatataaatacagcaggttacgatgtcccagcttggcgagatgtcgaacgatgagtttgatgccttctttgtcgttgataccgacagttgcatcgaatccttcgctggtggtattgataccgataatcggaatttttgcggttccgagacgtttgacctcgtcggggctgatgccaaatgaggaaacgaatacggcatcggcgttgctgcgtacgggaagttcctcgaagaatgcgtcacgcgcctccgacccctcgatggggtagatgaccagatcgtacccggcgtcacgcaaaacatcgttaagtccggcaatgatttcggcggtgaaccattcgatgacgccgctgccgaccaataatgctatgcgataggttctaccggatttaagaattcctgccgatctggaaacgctgaaattcaacgcatcagctgcggcctgcactttcaaccgtgttgcctctgacacctgttcagggtgtgcgaaagtgcgtgagactgtagcgttcgatacgcctgccttcagtgccacatcgccgatgctcgctttcatggtgcctccgaaagtttttcactgtttgtttcagcctaccatcattaccgtcctcatggctacagagttgaaagatgaatgaaaagggttgcgatacgacacgccgtatgaaaaacaatgtgtgcacgctcacagcggtgagatgaaacgggtttcaaatgaaaccgtttacattttaaaaaaccttgaattgccaatatgaaacccttgtcgtatgctattgcttgtccgcaaggggcggatgaaggcttacgaggacgtaaggagagatatgaaaatcaacaaaggtatcgcagtggcagtggcggccttgagcatcgtcggcttggctgcgtgcgggaacagcaatgccgcgtccggcacaaccgatacgaaagccgacaaagggcttgacgttatcggcaacaccatcacctacgaccccaatcatctcgtgaacgacggcaagccaatccagctcgagtactggagctggggcagcaagggcacggatcctgtctacaagatgattgagtcctacacgaagacgtatccgaacgtcaccatcaaaacggtgaatgtttcatgggatgattattggaccaagctgccgttggctctgaaaggcaaaaacggtccggccgttttcaacatccacaactcttacgatgcgttgattcgtccatacgcagcggattacgatatcgacaccaagtctttggaatccgactactccaccgcatccgtacatgaagatgagaacggcaaagtcaagtacatcgactccgtgatcaacaccggcaacatctactacaacaagacattgtggagcgaagcgggcctcaccgacgccgacattccgaccacatgggacgaattcatccaggtcgcccaaaagctcaccaaaaccgacggcagcaagatgacgcaggccggcttcaacttcaacggcgacgcctacagcgccatctatcaaggtctgaattatcagaagggtgaactgctcttcagcgaagatggcaagaaagccaactacaacaacgatgtgaccaaagaaaacatgcagttcctcaaggatttgtatgacaagtacaaggtcggatccgttgacttcggcaacgattacacccaaagcttcggtaacggccagtctgcgatgatctacgcttggggccacatggaaggcacgctgaaagaaaagtatccagatattgactacggcgtgttcgccaccccaaccttctccgaagacactccgtttgcatacgaccgttacaacggcgaatccactccgggcgtcaacaagaaccagagcaaagaacagcaggccgttgcccaggacttcatcaagtacctgctcgccaacgatgattacattcgtgaagcggtatccgaactgaactccttcccagccaagacctcgctgcagaacgacaaggacattctctccaagccggtcatggccgccatccagccacgcgtagaccgactgatctggccgggaccggcaccatccaccgttgaatccagcggcaccactgctttccagaacgtcttccagaacggcatgtccatcgataaggctctcaaggaggcccagaatcagatggataccgacatgaagagctctgacttcacgtcaatggaaagcaagtacgcttacttcgacgaacataagtaataccgatatatcctttccaatcccttttccaatccgggcagtcgcggtacgattcttcttccgcgccgcgactgcctttttatctacgagatacgttcaatcttcttattcgattcgatctgacattccgtattgcgtaacaaaacggtcgaatcggctcacagagaggcgagattcaatgaaaaacaaaaatggtgaatctctggtatcgagaattttcaccctacgcaacatggctgttgtcttcttggtggtctatttcgccattttcctggcctacccaatttttaaagccttcgcgggcagtttgcataactggaatcctctgattggcacttatgattgggtcggactcgacaacttcaaacagatcctcacagacaaacttttctggacttccatggggaacacggcggtattcgcaggtgtttccacactcttccgcattgtgcttggtctcggcttggccctgctgctcagcgccaaactcgtcaaatgcaaagacaccctccgaggtctgttctacatgccgaccatcactccgctcgtggcagtttctttcgtgtggatgtggatgttcgacccgcagttcggcatggtaaacaaaatcacaggactcgacatcaactggctgcacgacaccaaatgggccatgccggcagtcatcatcatgaccatttggaaggatttcggctacgcgaccgttctatatttggccggtctcatgaatcttcctcgagacgtgtacgaggcggccgccatcgacggtgccaactcagtgcagattttcttcaaaatcaccctgccgttgcttaaatcaaccaccttgttcattgtcatcacgtcactgatcagctacctgcaggcatacgtgcagattctcgtcatgaccgaaggcggtccgggcacgtcaacctacaccatcagctatctcatctttgatcaggcattccagaaatacaacttcggcgtcgcgtcagctcaggcagttgtgctcttcctgttcactggtgtgctcaccctcatcatgttcaaggtttctggagattcggaggaactggcatgaaatcacgtaaaattggcggcatcattcttacgattctgctcttcatcgccgccatcatcaccattgttccatttgtttggatgttcatttcatcattcgcgccaaatagcgaaatcgtcaaagtgaccggaggattattccctaagccatccacgattgacaattatgtgagcatccaagaaaagttcaatttcttgcgattgttcgcaaactcgctgatcgtagcagtactgaaaaccggtattgcaatctacacaagtgcggtgcttggttacgtgttctctaaaatgcgattccgtggtcgcaacctgcttttcggcatcgttatgagcaccatgatgattccttgggcagtgaccatcattccgcaatacgaaatgttcaccaactggggtctgcaagacacctacacgtcgctcgtgcttcctggcatgatcagcgcattcggtatcttcctgttccgccaatccatctcgggaatttctgacgaactcattgaagcggcgaaactcgatggcgcatccgaaaccagaatcttccatagcatcattctgccaatgagccataacaccatcgcggcgctcgccatcttcaccttcctgtggaattgggaagactacctgtggccattcttgatgatcaccgacgaacacaagcagctgctcgctgtcggtctgaaggccttcaacggacaatacggcaccgattacggcggattgttcgcagcgacttcgttggcaattgttccagtgatcattgtgtatatgattttccagaagcagttcattgcaggtattgcgacgggcagtggcaagtaaggcaggagtagtatggcaaacaacgcattagataacgcaaccggcacggtattcgtcgactatgtgcgcaaggcacgtccgaaaatgcgagaatcgtcggttttacaaggggatcattggaggattggcattctaacggaatcgctgatccgtttcgaatggtctgattccggcgaatttgaggacaatctcacgcaaatggtggtcaaccgcgatttcggtgccgatacgcagttcacggtgacgcatcgcgacggactgctcattgttgacacccccgcgctgtatgtgacgtacgatggcaagccattcagcaaagaaggcttgagcgtagtcgtcaagggcgtggccgacacccagttcaatacgtggcattacggcgacgaaccgaagcataatcttaaaggcaccgcgcgcacgctcgacgaggcgaacggcgaaattcctctggacgatggtgtgatttcgcgagacggatgggcggtgctcgacgattccgccgcgaacgtgatcgtggaagcatacgaagtgaacggcaaaccgaatccgctgggggcttgggttatgccacgcgatcacgcggaaaccgacttctacttcttcggctatggccgccgctacaccgaagcggtgcaagacttctacaagctggccggaccaacgcctctgctgccgcgcttcgcactcggcaactggtggagccgctactaccgctacacgcaagacgaatacctgcagctcatggaccggttcaagcgcgaaggcattccattcaccacatccgtgatcgacatggactggcaccgcgtggacgatgtcgatccgaaatacggttccggttggaccggctattcgtgggataagcagctgtttcccgatcatgaggcgttcttgcgcgacttgcacgagcgcggcctgaaagccacgttgaacgtgcatccgcgagacggcgtgcgcgcgttcgaagacgactatgaggcggtggccaagcgcgtcggcattgatcccgcaaccgaagaggcagtggaattcgacctcacgaatccggatttcgtaagcgcctacttcgacatgcatcatcgtatggaagccgaaggcgttgacttctggtggctcgactggcagcagggcggcgtgacccgccagcccggacttgacccgctgtgggtgctcaaccacttgcactacctggattccgggcgctacgagacttcttccgaacgcaatgtaaatgagaactgcgaatgcgaaaagtgcgccgagccgggcgctcgcgatgagcatgaaatgcatgtcgagcaatccaaacgtaacgtgagttgcacggaacgcaacaaccgttggccgctcaccttctcgcggtatgctggcccgggttcgcaccgctacccggttggcttctcgggagacaccattgttacgtgggaatccttgcagttccagccgtatttcactgctaccgcgtcgaatatcggctacggatggtggagtcacgatattggcggtcatatgtgtggctatcgtaacgaacatctggaagcccgttggtaccagcttggcacgttcagcccgatcaatcgcctacattccagcaattcgcagttcatgggcaaggagccgtggaacttctccgcggaagtgcgcgattccatggtgggttcgctgcgactgcgccatatgatgctgccgtacctgtacaccatgaactatcgtgccgcgttcgagggtatgccattggtggaaccgatgtattgggcggagccgaataatccgcaggcgtacgaggtgccggatgaattccgtttcggcactgagctgctggttgcaccaattgtttctgacaatgacgattccgcgcagctgggtagcacggaagcatggctgccgcaaggtgaatggtatgacttcttcgatggtcgccgttacgtttcggcaggagagtccgggcgtcgtttggaagtgtggcgtgcgatcgaccgtatgccggtgtttgccaaggctggcggtatcgtgccgttgcagcagcttggcgagggcaataaggtgaatgatctgggcaatccggagtccctgcaggtgctggtgttccccggtgcgaacggttcgttcacactcaaggaagacgatggttctgtggcctctgctgcttccggttctgcatctgccgagtcttgcgatggccaaactcatgttgccgatacgcgcatgagccttgactggaagaatacggacaatgccacgcagttcaccatcagtccggtggaaggctgtgctgaagccattccggcacagcgtaactgggagattgtgttccgtggagttgcacagccagacacgcagaacgttcgtatcgaaattggcggtaaagcttgcaatactgcagaaattacatacgatcagcagacgttgagtctgtcggtcgttgtgcgcgacgtgccgtctactgcatgcttgaacgttacgattgcagacggactgcagattgctgagaattcagtcgaacaggacgtgcttgacgtgctcttgcatgcgcaaatgccgtacatttccaaagagcatgcgatgcaggcgattcgtgagcaaggagtgcgtgcgctcggggctctgcgcaccttcgataccgcgccccgtttcagcaacgagctgtttgtcacctccggcatgcccgatgcggtgatcggcgccttggaggagatcctcctccgcagctgatgcgaagttgcgggccagccggctgaaggcaaaaaatttgggcatggaaaaggggttgcagcgaatcttaacgatttgctgcaaccccttttcggttacttagactggtttccgactcgcgatagagggcggaaaccctgaagcccagcagcttagttgtgcttggacttcttgcggctgttcttatgagcgtgcttgctcttcttgccatcctcgtcgtaatagtagtaatagtagtaattgccgttcgtggaagacttgcgttccttttcgaggttgaatacgaagcccaccaccggcacattgaggttgtcaagctgcacggcgatgtctttcagatcgcgcttcatggtcacgtcgcgaccggaaacgagcacgataccgtcgctcttcgagccgaagacagtggcatcattggccaccaccatcggggaagtgtcgatgatcacgtaatcgtaggtctgcaaagccgcgtcgagcaattcggtcatggtcttcgagttcagcagcatggaagcgttcggcggcttcggaccagccggcagaatatgcaggttcggcttccaatagcgctgcaccacatccttcacggtggcctggccggaaagcacgtgcgttaggccggcgccgccttccaggctaagtcgttcggctacggacgggtgacgcaaatcggcgtcgatcagcagcactttggcgccgttttcggcaagggcggccgccacgttcacggaaacagtggtcttaccttcggaaggtccgacggaggagatgacgatcatgcgcgcatcgctgccttcaaccttcgatgtgaaggaaaggttggtgcgaatacggcggaattcctcagcgatacggccggccgggttcgacacgatgatcggcttgttgctctgcaggctttcgtcggtggggatgcggcccatgatcggcgcgttgataatgtcttgcagatcgctggcttcctccacgcgggttgccataagatcgcggatcagggtggcgaacacgccgagaatcaggcctgccaccaagccgacggccaagtacaatgccaccttcggggagctgggggagatcggctccgcagcgcgctgcaccacggaaagcttcaccggcgactccttgccggaggcatacagcgacttctccaccacattgctcagggattccgccacgctgttggcaatgtcggaagcctgcttcgcgtctcccgtttcggcggtgatgttcacgaacgcggtgttcgtcgggttcgtgacggtcagctgcccggccagattcgcgacggtggtgtcgaggccaagatcgtcgataaccggcttcagcacggattccgtggtggccagcgtcggatacgactgaatctggttggtgatatacgtgctggcgctgttgatgttggaaatattgttgtcttgcaccgacgaatcactgtaggtggcgaacacctgcgcggtcgcggaatacttcgggggtgccaggaatgtgtatgcgcacaccgctgcgaaaaccaccacgaacgtgatgatgcccaccagaagatgcttatggactatacggaacaaatccatcaaggtgatgccgtcgtcttccgtatcattggattcgacgaccacctgattggttgctggcacgttgctttctgctgcagccatgtttcccctcgacatttgtcacatcatattgatcaggttccatactagcaaagagcacccccatggagggaggtgggcaccctttctagcttggttcgttgatatttcaacgttttcaggcagtggcgcttgctatggtctgcaaagccttgcagatttcgttgtacgctgcctgatatacggcgaagtccttgccgatcggatcctccacattgttggtatcggggatcatcggtcggatcatgcttgcgttgtcgattaccgattcgagtttttcctgccgggtattaccccccatgtacccctgttccttgcagtagacgcacatgttggcgaaatcgttgatgaggaaggttttgcgggccgcggttggtgcaatcaccgcgatttccttgcgctgctcgtgttcgaagcagaggatgagatcgctgccctgcgcgatttgcggggtgactcgtttcgcgcggaagctgctggaatcgatgccatgctggtcgagcagccttttgctgttcggtgcgatttcgtgcgaaacgagcccgcgtgtgcccgcactgtcggattcaagatcgggcatgaattgggggaggagcagttctcccataggagagcggcagatattaccggtgcagataaacaggactttcatgatctcttcctgaaaaaagaaaacaatcggttttacgatgcttgttttcgaataaatgaagggacttgggaaaacccaagccccttcatgaaacatagatatggtgtgtatctacttggttattgttcagcgagcagagctcttgcgaacggcaaccagggagatgccagcggcagccagcagcacgacggccacaacgtacggagcgatagcagcaccggtggaagcggtctcgttcttcttggcggtgccttcgccggtagcggcgacggtcacggaggcggaagcgagagcggcaccggtcggattgcctgccccatcgactgcgtagatggaagatgcgatggtgccagcaaagccagacttgaaggtgtaggtggcggtcagggtgccgtcctcgtgtgcctctttaacgttggagtacttggtggcagccagggtgacgttctcgacggtggtgtcatcgtaggacaccacgtagcgctggcccggagtcagtcccgtaaacgtgaaggtggcgacgttgccggaaacggtgccggtcgcgccataagccatagcggtgttagcggcaaagccaaagccgaacacggcggcgatggtggcgagaattgcgacgatcttcttcttcataatcgtgattcctctctaaataaaacgtacatttcagcggtttgccgtagtggtttcccgctacgaccttgactatacgcccccgttgagaaccgcgctctcgggggatgtgaggtgaatcgcacatatgtgacggcgttgtcacaccatgtgacgacgttcgcacatgcccccgaatatgaaaaatggcgatttttcgttggaaaatcgccattttgataagaatttacaaacgcaacacgccgaagcgtcactcttcgtcgtcaaaactgaacaggtcttcaaccgtggtatcaagcgcttttgcaagatccatggcaaggcgtagcgacgggcaatactgcccctgttcgaggcgtcctatcgtctcgcggcgcacgttcaccaagtcggcaagatcggcctgtttcaagccgcgttccatacgtttgaacttcaaactagtcttcatcggtgtccccgccctcatgctcaagccacaggtagcgggcgtcggcgatggccagcgccagcatgcccaacgtcggcaacgccatggcgggaacggtgaacggcgcatgcctgaacagtgtgacgatcatgcccgcgaagcccaacaccaccagcgccaccacaagcacgaagaacgtgaaacggatggccgttgcctgatgctcgtcggacagctcgtcgcggcggggatgcgcgcggttgtacaccgtgctcagccagatctcgcctatggcccacaccagcgcgaacacgcccatggtgatgatgcccggccacgtgtgatgctggaacatttggatggcgcaggcgatggctcccacaaattcaacgaccatgcggaagaggatgtagcggttgaaggtcacgggtctgtcctttcctaccgtgtttcttcgtgttttccgacgatttcgtattgtacccgttgccctgaagaggggtgaagaagcgggggaaaggctgttgacgggtgcatgcggtgaaacgattttcagaaacgtttgcatgtggctgtttcgaggcatgtcgtatatatttgtatgcttgcgacagtcgattgccggggagacaaggggttgttgttgctttgagatggttttgagacgaaccatgcgaatcgtatcgaattttctggttttacataagcgaaatcggcattatgtttttcgtattacgttgtgttcttgaaaatatgaatatattccccgaaattcgattcgttttattcttaacaatgaggtacagtatttcacgtagttatttacaataaaggaaggatttacatgtccgttcttgatggtttcaaagaagttggcgaaagaactggtggcaagttgaccatgacggtcatgcttgaatccgttcgtttttccaagggtgtttccgaagttctcggacgtcctgaatacgtcaagctgctggtgaattacgagcgcggcaagttcgcaatccaggtatgcgatgagaatgacgatttcgctcttcagttcaatgctccgaacgccgatacgccgtcttccgtcaccacccgcaaccttgacctgctcgttgcgacgcagaagttcttcaccttcccggaagtgcctgcagacaagatcgccttcttcgctctggacggcgaatatcacagcgatgagcgcgtgatcatcttcgatgccaagaacggggtccgcagcggcaccgtcggcaagcgtggtccgaaggccggtcacggcggccgcaggcgcaggaagatcgatgacgtcaaggaagccacggtgatcggttccaacaatgccctgtgaaatcggcgatatcccagtgatatttaagatcgtaatatagtttgagctccgtaatatcttcgaatattacggagctcaaactatatcatcatcgaatcaatcaatgatgatcaatcgcgatttaatagcagtgattggccagccagtacgtgtaggctccctgaatggaaccataacgctgcgcgcaataaccccagaaccacttgagctgagtctgataattggtggcccaatcggcgcccgcgctcaccatcttgctgccaggcaacgcctggggcagaccataggcgcccgaactcggattcgttgcggtgacgctccagccggactcgtgggtgatgatgtatacggtggcggtgaaatcggcttcggtgtagccgttcgacagcagataatcgtgagcccactgctgcatttcgcccgccggcacagtggtgccgatcgacgcggaagcgctggaggacgacgacgaagtggagccggtgccgacgagaatgaccttgtcgaccggagccttcttcacatacgagctgatcatattggaggagaccacggtgtcgccggacttggttacgaggttcgtggtttccatcacgccctcttcgccttccgtctcaaccttctcctggccttccggcaggcttgaggtttccttcttgacgacattgaaaccgatggcggtgtcggaaacctcaacgcttgcgccggcacgctgaatggtgattacggtcttctcatccaccttggtggtgagcgaaggggagaccgtgtcttccggttcgagcgtgatgtctcccgcgtcgagcacggacttcacgtcggtgaaattggtaccgggcaccacgcgcgacttgccgttgatcttcacggtgacgtacgaggtgtctccattgagcagctcacgggcgttgccacgggatgcttcggcggaatcggtgacggagaaggccgtgacctgattggccgtgttctgctccgcggaggtgtaaagattgcgcgacacaatgccgccggtagccaacaggcccaccgccgcgaccgttgcggcgatcttcaccagcgaggacttgctcggcatggcgaaggtagacgatcgggcgtgcttgctgtggttagccattctgctcctaaacgcgcgttcagatcctcgacgaattcacacatgcacggcatgcggtgcgccgccacttcaggcttcgccggaaagcgcatatccaacgcgacattctactccatgccatggaatccgggcgagcgcatatgtaacaggcaggcaaagcgggcatgcaaaacaagcgtgcaaagcaaaaaggtgccgttgatgtttcgccatcgaacggcacctttgcgatcctttgatattcgccttattgcgcctgttccgtagcctcttcggcagcggccgcattgacgtccagctccttggcctgggcgatcagatcgtccagatccgacgcgcgcaacgcgccagcctgctggaatacgatctgctggttcttgatcaccatcaaggtcggcacggcctgcactttggcggcggaggcgagatccggattctggtcgatatcgaccttcgcgaaataaatgtcaggattcgcttcgcttgccttttcgaacgtcgggccgaacgcacggcacggaccgcaccaggttgcccagaaatccacgaataccagatcgttggattcgacgacctgattgaaatcctgcgaagtgaccgcatgcgttgccatgattgctccttgctgttcgttccatcgacgcgcgtgacgggctacgcccctcgtatgcgattgctttggagtatataaccgcgtcccaacccgccgcattcccggcatatgcaatatccgctgtcagaagaatcgtctttcggcgcattcttttccagccaattcacacaagatgcgtgataatgggactatgccagtgatgaatgatgaagtgcccgacgagggcgatttcgatgcaggccgtcgtcgcggagaattcgacgacattacgccggaggatttcattcgcggaataggtaatcctccaggatggcttgcttccggcgaaatcaaccgtatgcgcggcgaaatgccgattccatacgtgcttgtggtgccggtgcgcaccgatgatctggggcgtgtttcacaggtcggatcgttgcttcgcgtgtctgacgacggcagtatcgagcgaacgctgattgccgggcgcgtgctctatcacgaatcgttgcgtgaggccgtggcgcgtaatgtcgccaaggatttgggcgatatcgcgttgccgcagctgccggtgagtctgcagccgttcaccgtggccgagtttttcccgacgccgggactatccgattatttcgattcccgccagcatgcgatcgcattgtgctacgtggtgccgatcgcgggcgactgcaagccgcaggatgagacgcttgacgtggaatgggtcaacacgaacagcgagatcctcgacactttcataaaccagatgagcaacggatatggcacgattgtgcgtcaggcgatcgcttgggccggcaggtagccgacaggcttatggttgacgtcgaaaccggtcggccgtgggcgccaggaaagcgcgtggcagcttgcgaatgcaggcagcgcaagcgatagatacataggcaatataggggagaggaacggagtgagacgatgacgatcgaattacataataacgtgtattgcgagggcgaggggcttcccgtggtgctggtgcacgggttccccgtggaccaccgcatgtgggacgaatgtgcggaggcgttggaggcggccgctgtggaacatggtgtgaaacggttcccgatctggggtcccgacatgcccggtgcgggagaagggccgattccttccgatgagatcagtggcggcaaagacgcggacggcgctttcccgaacggtttggaccatatggccgacgcctatgtcgcgatgttgcatgcggccggttacgacaaggcgatttgggcgggcctttcgatgggcggctatctggttctcgacattcagcgtctgcaccccgaagctgttgccgcgttggcattgtgcgacacgaaggccgcggcggattccgcgcagatgcgcgcgaagcgcatcgcgatcgccgaagcatgtgaatcgacgggcacgcatgagccggtgatgggatttgcggcatccacacctgaggattccaccatcaaacagtcggccgcctaccgtgaacagttcacgacgtggatcaacgaacagcctgccgaaggcatcgcatggcgtgagcgcatggcggctgggcgcccggatctgaacgatgtgttgcctgcgattacagcaccggttgcggtgatctgcggcgacaaggatccgtcgagccctccgagcgtgatgacgccgatcgccgatgcgatgacaggcacgagcgcggatatgacggtgatattcgattgcgggcatttcagcgcatacgagcatccgcaggcggttgccgacgcgctgctcgcgctggtgcgcagggtgcagtagccggtattttccgccgctgccgtcaatatcgcaatcagaaatacaaaaaagatataaaaaaatagaaaagaaaatacggaatagagaaaaaatatccgctctatcaatcgtattcaaggaaagaagcaagcgatgagcgtgttctcaccattggcgctgactcaggcactgccgttcctgccacttgcgcaaggtgacatcgactatgaggtttcgagacgcggcgaacccgacctgttcgacacggcgctgctggagccggccacgaaggtcgttctcgtcaaagacggcatggtggcggtgccgcgcggacagggagccatcgcggactacgccaacgtgcatatgcgtctcgcgcaattgcccggcgcctacgtggcggcggaactgcacacgcatccgacggcgctcgccatattccttggatcgtatggcggcaaacgcgacgaacacgtggtcgccgttgacgtgtctcgcgtgaaagccgcggagacggtggccgcaagcagcgagcatatgggcgcggacgatgcgttcggcgaacagcacgaaccggaagcgaaaacgtcgaaatcgttgctggaaagcgctgcggaacgattcgactgggtcgatctgcgcggattcgcaccgcatgccagcgcgcgcgaggcaggccaggccacgacggcgatctcgctgggcgtatggcatgcgcgccaacgtcattgccccacatgcggcgctccgaccgaaccggcgttgggaggatgggcgcaacgctgcaccagcgaagcggacggcaagcgactgctgttccccagagtggaaccggccgtcatcacggcgatcgtggaccatgaggaccgtctgctgctgcaacacaacagcgcatggcgcaacaccggactgtactccgtatcggccggcttcgtggaagccggagaaaacctggagcatgcctgccggcgcgaagccaaagaggaagtcggcatagacatcggcgaactcaaatacttgggatcgcagccatggccgttccccgcatcgctcatgatggcgttcaaaggcgtggccaacaccaccgacgtgcgcgtggacggcgacgagaccctgcaggcgcgttgggtgacccgcgacgaatacatgaacgagttggtggcagggcgtatggaagctcccggaaaggccaccatcgcccgctacatgatcgaagaatggctcggccacgacctcccgtaacaagtttcggcactgctctagggaaatacatacgattgacgtagaatgagctttcatgagcgaagaaaacgataacaagccgaatctggatgtgcctgagcatcttgaatattccgacgagcatgtgtgggtggatgcttccaccgagccggccatggtgggtatcaccgaatatgcggccgaccagcttggcgaactcgtgtacatcgatctgccggaagtcggcaccgaagtgcaggcgggcgacgaggtggcggaactggaatcctccaaggcggtcacgccgctggtcactccggtggccggcgtgattcgctatgtgaacaacgaggccgccgacgatccaagcatcgtaacgggtgacccgtatggcgaaggctggattttcaaaatcgaacttgaggatgacgagccgggactgctttcctccgaggaatacgccaacatcgtggctcagtgaacggcacgattcgggaaattggatgggaaatcatcggtattccctgaaaaatccctgattttcacgctggggtaccaggtaattcaataatcgcctttatagtggggttatgaccgaaccgcagccgttgccccagcgtgaaccggattccatatccgaagatgacatgccgaccgtgcccattcccgcacgcaaggtggtcaccaccttcgacgcggcttcgaaacacgaacgcatcgaagtcaagcctccgctgacacgactgttccgccgcaccattaccagagcgttcaacaagtgggtgacgttctcaacaagcatggtgctcaatctcaactggtatccgcgcgtggaaccatatgtcggctacggcaccgaacattactctcgactgatctgccgaaccgtgtacgggcccttcaaacgtcaggcgggccgtctgacccgtggcatccgtgccatgctcaccatcccctcgccgcatacgaaggtgcgcatcgccatcgacggcgtgcccctcgaaaccgtgcaggtgggcgcgtccgaagtgcacgacgaagtggacgcgcagcgcaatgtctccagtgaattcgcagcctccgattccgcaggatatctcgatctcgtggccgaacattcgctcgaaccgggcgtgcacgacgtgtcatacaaggtacgcagccgcaaaccggtcacagccaacctgttcaccatccccagcggtacgaaagtcggcgtgatctccgacgtggacgacaccatcatggtcacgcaggcgccaagcctgatgaaagccgcctacaatctgctgctgctcgatccaaagaagaaaatgccggttgcgggcatgaacctgctgttcaaccgcattgcggacatgttcccggacgcgccgttcttctacctgtcgacatcgccatggaatgtggaaagctcgatccggcatttcatcgccaaccatggttttccggaaggtccgctgctattgcgcgacctcgatcctcgcccgaaaacgttcattccttccggagtgcagcacaaactcgagtatgccgaacaattgatggctgattttcctgatatgaagttcattctgatcggcgatgacgggcagagggatccgaccacgtacgccacgatcgcacgccgatacccagggcgtgtgctggcgatcggcatccggcagttgtctccacgcgaagtcgccggcaatctcggcaccgttgcggggcgtgcggtcacgcagccgatcccggtcaccgatgtcccggtattcacgggaacgaccggttcgaatctgatgaaaaccatgctgccgttcctgaaacaacagatgggcgtctgactttttcgtacgcccggagcagggggtgcgtgccgcgtgggattgggaatgcaatgccggtataatcgcgtgcatgactgattttcggggtgaacagggcgcaacgggcgcgcgagaaagcgacgaaagcgtgcaagacaaatgcgggatgccgatcgcgaagcgtgtgccgaaggagcgcgtattccacggcgacaccttcatcgacgagtacgaatggctgcgcgacaaggaatcgcatgacgtgcaggattacgtcgccgcgcagaaccggtattgcgagcagcgcatggaaccgttgaaaaccctacgctccacactgttcgacgagctcaagtcgcacgttcaggaaaacgacatgtccgtgccgacacgcatggatggctactggtatttcgtacgcacccaggagggccagcagtatgcggtgcaatgccgtgtgcctattcgaggcgcagacgattgggatccgccaaccattgaaatcggcgtgcccatcgacggcgaacaagtggtgttcgacaccaatgccgaagcgcaaggccatgatttcttccgtatcggcggcatggatatttccaaagacggacgttggatgctgtacggcaccgacaccagcggcgacgaacgttacgatttccgcatccgcagcttggaaaccggcaaggaactgccggaagtgttcaagggcatcggtggcgcctgcttcacaccggacgcgcaatgggtgttctatgtgaagctcgacgacgcgtggcgtccatacgcggtgatgaggcaccgcgtcggcactcccatcgtcgacgatgtggaggtgtaccgcgaacaggacgaacgattctgggttggcatcggcctgtcgttcgacgaacgcaatctggtgatcggcaccgggtcgaagactaccaccgaagtgctgctgctttccaccgacgatccggaaggcgaattccgcgcgttcattccgcgcgagcaggacgtggaatacgacgtgagtttcagccgtttcgaaggtgccggcgaacgcggtgaggatattccgctcgccgtggtctatcacaatgcgttgaacccgaatttcgaaatcgatgtgatcgacatgcgctcccatgagcccccgtaccgtttgggtgagggcgtgcgtgtggccgtcggttcgccgtacggatgcgagcacggcgacgaggtcgaaccgggcgcttctgagatgccgatcggcacaccgtattccaatccctgcaatccagccattttgcagggcgcgcatggtcttggcattgaggggatctcgattcaccggcattatgtggcgctgcagtaccgggcggaaagcctgacgcatattgcggtgatgacgaaggatgccgctgcggaggattttcttgcggggcgtccatggaagttcaccgagctggttccccacgcgttggaagacgattgggatgtcgacgagtcggtggacgagatcaacgaggaacgtgccgaagtgtggggcgcgctcgaccaattggccgccgcgcaaggcgaggggtcggccgtgcatggggtttcccgcaaggcgatgacctcatcggatggtgcgaccgccgatgcgatgccgggggagacccggcgcttgtattcgattggtgtgggaggcaatccttcgtatgatgcgccccgcatgcgctactcgttctccagttacacgcgtcccggcgaactgcatgatatcgatccggcgaccggcgaggatcgcctgttgaggcgtgccacggtgcttggtggatttgaaccgcgcgaatacatggagcgcagggtgtgggtcaccgcccgcgatggcgagcgcattcctgtttccttggtgtggcgcagggatgtgcctgcgtgtgattcggcgatgttcgttaccgggtatggcgcgtatgagatcagttcggatccgggattctcggtgtctcgcatcagcatgcttgatcgtggtgtgctttatgcggtgccgcacattcgcggcggcggtgagatgggtcgtgcttggtatgagcaggggcatttgctcaataagaagcattcgtttgaggatttcgttgatgccgtgcgtgcgttgcagtgtgccggtttggcgtcgcctgctcgcacggtggccgatggcggttccgccggtggcctgttgatgggtgccgtggcgaatatggctcccgaatgtttcgcgggcgttgaggcggatgtgccttttgtggatgcgttgacgtcgattcttgatccgtcgttgccgttgacggttacggagtgggatgagtggggcgatccgctgcataatgcggacgtgtatcggtatatgaaggaatatacgccgtatgagaatgcgccgtctgatgcaaatgatgcgcgggttgcggtttttcccaagattttcattaccacgtcgatgaatgacactcgtgtgctgtatgtggagccgatgaaatggttggcccgactgcagcgtgcaggcgtggatgccgtggcgaagattgaggttgaggctggtcatgggggtacgtctggaaggtacaagcagtgggaggagatctcctatgagaatgcttggtgtcttggcgtgatgggtattaccagctgattaggctgtgcgatttgtgagattcgtatgattcatgcttttcgtgtgtttcgtacaggaaagcggcatggagtgtccattagttgagcgttttaagtccacgtgctgattcgttgactagagtcgcgtgctatgagtgattctgcaaagaagtacaccatcgccgtcattccgggcgatggcattggcaaggaagtgactccgtgggctcagaaggctctggagaaggcggccgagggcgttgccgaattcgattacgagaatttcgatcttggcgccgaacgttacctgcgtgacggtgcgattcttccggaagaggaagaggaacgcatcaagaagaccgacgcgatcctgttgggcgcagtcggcgatccgcgtatcaaggccggcattctcgaacgtggcctgctgctcaagctccgtttcgatctcgaccagtacgtcaacctgcgtccgtccaagctgtacaagggcgtgacctccccgctcgccaacccgggtgatatcgacttcgtcgtggtgcgtgaaggcaccgaaggcctgtactgcggcgccggcggagcggttcgccgcggcaccccgaacgaggtggccaccgaagtttccatcaacaccgcctacggcgtggaacgtgtggtgcgttacgccttccagctggccatgaagcgcaggaagcatgtgaccctcgtgcacaagaagaacgtgctcgtcaacgccggagacatgtggcagcgcatcgtcgataaggtcgccgaggaatatccggaagtttcccacgactatctgcatatcgacgcgaccaccattttcatggtgtcgaatccgtcccgcttcgacgtgatcctcactgacaacctgttcggcgacatcatcaccgacgaggcaggtgccgtggtcggcggtgtcggatactccgcttccggatgcatcaacgcttccaacgaatacccgtccatgttcgagccgattcacggttccgcaccggatatcgcaggccagaacaaggccaatccgaccgccgcgatcctttccgcggccatgctgctgcgccacctcggtttcgacgacgccgcggccaagatcgatgcggccgtcgaagcggacatcgaagagctgggatccgctacccgctccaccgacgaggtcggacgcgacattctggcacgcatgtgacatatgatccggaacgcatgattgcgccggatatgttcgcctgttgagacgcctgtcgaaatcgagttcatgcttgaattcgacaggcgtctcgcatattcagggggatttcagggattgctttcagggtggatgaaagcaacaaggcaaattatgggatattgttgaaaccatgagtgacaacaatgccgattacaacggttccggccaagacgagtatttcgcgacgaacgattcaactcaagccgattacaggcagtcgcaggatggctacaatcagcctgcatcacagccgcacaatcccgacccgtacgcatcgcagcagcccgtgcagggatatgccccgggtacgcagggcaacaacatccccggcggtacgtacggcaatggtcagccatatggtcagtcggctgcctacggttcgtccgtccccgcatatggctcggccgctcccgcttacgggcagccgactcagcctgcgcaacctgcacagcccatctacggccagccgacgtacggacctacgaattacgcacaatcggcgcagaccccctattatcaggagccgactcagccccaatacacgcagtccgcatacaatcagccaccaacctacgcgcagcagacctactatcaggcgacccaacagcagcccggctatggctacgcgcagaagtcgaagatcgtcgccggcctgctcggcctgttcctcggcaccctcggcgtgcacaacttctatctgggatacaccggcaaggccgtggcccagctgttgctgaccctgatcggatggatcatcctcatcggaccgatcatttccggaatctgggctctgatcgaagcagtcctcatcctgtgctccagctacgggtccaactggcaccgcgatgggcgcggccaagaacttcaagattgatgggcagagggctgtataagcagccgggcggcaaactcgtaggggtttccgtccggctttctgatgacattccagcatatttccgcgaatgtgcaagttccatccaatccgtggaacaatgtcggatcgacggcgatttctttcttgacggcgatgacaaggattcccgccgactattgcaggattgggaaaacttgctgcaaagccagcgaggcgcgcccacacgcgacattacgcgacgattgcaagcgattacctcgaactatccgaacgtgcgattggtgggtatgacggcagaaggcattgccatcgcttttctccgcgcaatcacaggcagtgaatcgcgtaatgcggaagatgcaacgggcaacggaaatatcgcgaggtccacgaaacaatattccggggaacaaccgggaatgcataatgcgctgacacaagaggaatatctggaacgctggcgggacctgaaaccgaccgtcatccacgacaagccgcgcgacccgaacgaacaaatggaaaccgacatcgcatgggcgcgcgaagtggcggcaggcaaacgcgaacccacgctgcgtatctgggaatgggccgctccggccgtggtcatcggcaaattccagtcgctcgaagacgaagtcaatacggcggtcgcgcagaaggaaggattcaccgtggtccgacgttgcaccggcggcggggcgatgttcatcgaaccgggcaataccatcacctactcgttgtacgcgccgttcgatttcacccaaggcataagcatcgaggaatcataccggctctgcgatttctggctggtgcgcgcgcttaaggaactcgggctcgacgtacgattcgccggactcaacgacatcgccacgcaatacggcaaactcggcggagccgcacaacgccgattcacaccagtagagggagggcctggcgccatactgcaccacgtgaccctcgcctacgatatcgacgcggaaaaaatggggcgggtattgaacacctcacgtgagaaaatgtcggacaaagcggtgaaatcagcggtaaaacgagtcgatccaatgcgctcgcagacgggcatgagtcgtgaagacgtggttgaacggctgctcgacgccgccaggcgagttacaatgtagcccgatggtcgaagccgcccctgatatcaagggcaatgagaacgttacgaaagcttggtgttccgtgagggcatgtggaatcgcaacaagctttcgaagccgcggcagcgcgcccggcaacacgcctggcggcgtgcccagaggatgtgcctatgaacggaggtgtgacaaatggctacgccaaacgagaccaatagtggacccagtggcgaaagcgcgacgttgctgcacaccgcgttgttcaagcaggtttcttccgaagaggcggaggaactgctgccgcatctgcagcatgccgaatacagcaagggcgactatattttccgcgaaggcgacaccgatcaccgcatgtatctgctggaacgcgggcgcgtcaaactgatccggcaatcgtccgacagacgtgtgcagttgttgagcattcatgcgtacggcgaagtgctgggtgagattccggtgttcgatccgcatggtggaccgcgcaccgcgtccgccgtggccatgaccagtgacacgaaagtcgtatggcttgagcatgacgccctgttcgcatggcttgacgagcatccgcgcgtggccgtcgacatgcttcaggtgctcgcgcatcgcatgcgtgacaacaacgagcgcatttcggagcttgtgttcatggacgtgccgggacgtttggcgaaaacgctgctgaatctggcgtcacgcttcggcgagccggtcgaggcggggttgaaggtgccgcacgatctgacgcaggaggaaatggcgcagctggtcggttcgtcgcgcgagacggtgaacaaggcgctgatggatttcgccaaccgtggatggattgcgcgtgagggccgttccatcatcatctaccagcctggcatgcttattcgacgatcgagacgataattttcgactgttttccagtgtttttcaagttttacggttgtttgtgagaaacccgtgatggctgcgatcggccggttgattagtagacccaccactttagaatgggcaccatgcccgaaaagaagactttgaccgttcaacgtgtgctcgcactcgtgattgcctacatcacgctgagtgtgggtggcggcgtggccgccagtttgttcctcctaccggcggttttcggcgcgaacagcgtcgccaaggcggttattccgtcgctgtcggtcgaaggtattgattttgatgtgaccagcctgccgcagaagtcgaccatgtacgcttccgatggcaccacgaaaatcaccgaattctgggatcagaatcgtgaagtcgtgccgttgaagaagatttccaaatacatgcagcaggccgtggtagcgcgtgaagacagacgattcttcactcacggcggcgttgatgtgcagggtgtgttccgcgcgttcgtccaaacatatatgaagggcgaccatcagggcggttcctcccttacccagcagtatgtcaaaaacgtgctgatcctgcaggcgcagcaggatgacgatccgatcgcacaataccatgcgtcggaagataccatcgcacgaaaaatgagggaaatgctgatttccgtgcaaatggaaaagcagtattccaagcctgaaattttgcagggatatctcaatatcgcacagtttggcggcaatagcctctatggcgtgcaggcggctgcgaagcggtatttcaacaccaccgcagatcagctgaacatcgtgcagtccgccaccatcgcggcaatcaccaagaatccgaacgcttacgatccttccgtcgaatcgaaccagccggaatccgagaagcaacgcaatatcgtgctgcagctgatgaacgagcagggctatatttcggatgcggaatatcaagaggcggtcaatactccgctcgcagatacgcttgatgtccagcctatttccaccggttgcatggccgcggactatgatgcgggctatttctgcgattacgtggtgcataagattttgaattccaaggaattcggcaagaccagcgaggacagggaaagactgctgaaagagggtggtctgaagatcgtcaccacgttggatatcgatgccaacaccttgttgaacgaaaccgcgcgcaacaccatcccaccggaagattcctccggcatggaaatcgtgatggcgtccgtcaaaccgggtaccggagaagtgctgggcttcggtctgaatcgaacgtatgatgccaccgaagcggcgcagaacgaccagaccagggattccatgaactatgccgtggatcgagaagacggcggcggcatgggcttctccatcggctcgtcgtggaagcctgtcaatctggtggcatggatggaagcgggacattccgtcaacgagaacctgcagacgtccacgaggtattcgacctcgttgttcgcatgcgatcgttataccggcggcactgatacgtggaacgtcaccaacgcaataaccaatggaacggtgaacccggaaacgccggcattggctttggcaaggtctcataacaccacgcaggcttccatgggatccatcatcggcttgtgcaagattgccgataccgcaactgaacttggctatcatgatgcgaataccggtgagacgctcgacaagacctcatcattcgtgcctgccatgatggtcggcaacgtcaacgtgtccccgctgacgatggcaagcatcttcgctgtatatgcgtccaatggcgtgcagtgcgatccgatcgcgctgaagcaggtgactgatgtggacggcaatgatattaaggtgccttccgcgaactgccatcaggcggtcgatccggaaatcatccaaacgcttgcttgggccatgaatcaaggcgttgtccgtcctgacggcgcaggcggtgtggcacagctagccaatggacgtaagaccttcgccaagaccggtacccacgaggatcagctagttacgacaggtggtttcattccgaaccagatcgccacattcgtgctcgtcggtgacgtgcagaacccggttggccacccgattgcgaatatcgctatcaacggccagtaccacagctactgggatggttccaccatcgcggccccggcatggcgtgactttatgaatgcttatgcggaacgcaaacagctgccgattgacaacgattatgggcagcctgcggccaagtattccgcaacatccagcacggtcaccaagatcggcggtggaaagcagaatgccacccagcagcaaagcacaatcattcagcagcagaaccagtcgcttcagcagcaaagccagcagaacgaccagcaggatgatcaggatcagcagcagaccgaagatgagtgacgcttccgcaattcagcgaatggaagtgaacaatcaatgaacgcccgccacgctcggcgggcgttctgcgtagaatgcaaatagtgccggttttatggcacgaaatctccagagaagctcaaggggaatacaagaagaaggttcagccgatcggcaaggagccagtaggtgcgaccggaggggagctactacgatgagcgaagacgaaaagaaggcgaagcggtcgaagaaggctacaaccaatggcacggttggcctgttcgatcctatgactttgcgtggcatgaccgtgcgcaaccgcatctggctgccgccaatggatacgtattccgcgttggcccaggatggcctgcccacgccattccactaccagcattatgtgtcacgtgccatgggcggtttcggcatggttatcgtggaagccaccgcagtgacgccggagggtcgtatttcgccgtgcgacttgggattgtgggccgacgagcagatggacgcatggcgttggatcgttgccgatgcgaaggccgccggcgcgacgatggcggtgcagctcaaccatgccggacgcaaggcttccaccggctgcttctccatcggatacgagcatgagagcgtgccggaagagcagggcggatggcagaccgtggggccaagcgccaacgcgttcgggccgttggacaagcctcgcgaactcaccgttgacgaaatccatgccatcgtcgaccagttccgcgacgccgcttggcgtgcttatgatatcggcttcgacgcggtggaaattcatgcggcccacggctatctgctgtcgcaattcctcgatccgctgatcaacgagcgcgaggatgaatacggcggatcgttcgacaaccgtatccgcatactggtcgaagtcgtggacgccgtgcgttccgtcatccccgacaccatgccggtgctggtgcgcgtttccgcgaccgattgggccgccggaggctgggatctcgatcagaccgtcaaccttgccaaagtcctgaagaagcacggtgtcgatctgatggacgtctccaccggaggcatgattccgggcgtgaccattcccgtcaaacccgattatcaggttccattcgccgaacaggtgcgctcgcgtgccgaaattccaaccacggccgtcggattgatcaccaagccgaagcaggccaagaagattttgaaatccggtgccgccgacgccatcgaaatcggacgtgcggcgcttcgtgatccgaattggcctcttcgcgccgcccacaagctcggtattccgaccgaagatgcgccctaccagccgcagtatgtgcgtggcgcatactaaacgcaaccaataaaccaaggtaatatcgaacaacaatcgaacaacaataatgcgccctgcaccgcgttggcggtcgcagggcgcattattatttggtgctcgctgccgattgaaataatcggtatcaggcgtcgatgccgacagcctggctcacatggtcgaatccgtcgcgcttgagcagttcggcaaggccgcgcttcaacacggtgatctgctgcggtccgcgatacatcagcgagctgatgaacatgaccaacgacgagccggaacgaatcttcgcatacgcctgctgcggagtgaacacgccgccgatgccggcaatcgcaaaacggtcgccatactcgcggtacacctgcttgatgcgttcgttgctggcctcatagcatggcgaacctgacagtccgccctcccaatcgcgaggaatctccatgccggcgcggtccttctgcagattcgcaatcgacaagccctgcacattgtgttcggcaagcacgtcaagcagatccttgaactcttcccaggacttattcaacggcatcttcaccagcgtgggctgtggacgttcgatcttgtcgagttcggtgaacagcttgtcgagcgcttcagggctctgattgaacggttcgccggccatcgtgttcgggcaggagatgttcacttcgaccatggcggtgcgaccggccgtgcggcgcatcgaaatgcagtaatcctcgatgccttcgtccaaatcgccggtcttatcatcattcgtacgcgcgatcgacacggaaatctgcatgtcgcgcgccttcgtccaagcctgttccgcgcgcggaacaacgatttccgaaccctcattggcaagaccgacatgcaccatcatcgaatcatattcgggcagacggtggaaccacggcttcggattgccggggcacggacgagacgtggtggatccgaccgtttcgaagccgaagccggcgttgtcgagcagcaccggcatctcgcagttcttgtcgaggccggcggaaaggccgaacggattgacgaagtcgacgcccatcacgctggtttccagcacggggtcggaatagttgagcatttcacggcacgcccacatcagcggcggaatgttcttggtgatcttgcagaactgaatcatctggtcgtgcgccacatcgggcgtctgattgaacacgaaatgcggcttgatgatgtgcttgtagccgaaggtgaagagatctgtggtggctttgttcaccgcatcgtgccagaaattctcagaaacatacgtcatggttcactattctcgcaccgtttgtcgcaggaaagcaacacgtcgattgatttcgctgacgggatgtcgacgttcgtttttgttcgatttgaacgattacaggagtgccaagtatattttttcgtgaggaaaacgcgcgaaacgctcatctcagtttttattttgagtgaacatgtgcgataatgttcgaatgatatcgtcacaacgtcagcatttgattttgagcaggttgcgtacccgcggtgcggtgcgtatcaccgcattgtccaaggaattgggcgtttccgccatgaccatccgacgcgatatcgccgatctggccgacaagggtctgctgaagcgtgtgcacggcggcgccgtcaccaccagcacgctgctgagtgagccgctgttctccgtaaagtcgcagatggacatcggattgaaggacgccatcgcacaggaagccatcaaatatgtggcacccggcgacgtgatcgccatcggcggcggcaccaccgcatacgtattcgcgcaacatctgttggaatcacagcagtcgtcggggatcaccatcctcaccaactccattccggtggcggaactggtgcaggcgctggaatcgaaagacgtggaagtcatcgtgaccggcggcgtgaccacccgatccaactcgctcgtaggcccgatcgcagacaaagtggtggcctccctgcgcgtcaacacagtcttcctgggcacgcattccgtgtccattccgcgcggcttcctcatgccgaactcgcttgaggccgcaaccgatatggcaatgatggacattgccgatcgcaccataattttgaccgatcacaccaagtggagctgcacatcattgtcgcttttcgcacgcttcgaccaggtggacacggtcattaccgatgatggactagaccccgattcggttgggaaaacaagggatttggttaaagagctcgtgctggcacaccagagcgagcctattcaggaaggtgaataaccataatgagtgaattcgcaaactacactcccggagagtacgcgaaggagcacattcgcatcacgccgaccacgctcgccgatggccgcgctttcttctacctcgacgatgatccggaatacgtttccggcgcgaagacgcgcgaactgaacgatcctcgtcagctggcataccgtttctccaatcagctcaacgcggccggtgaggaagtgccgtacgctgctccggaaatgcgtcgcgatccactgaccggcgactggattcctatggcgaccgcacgcatgaaccgtccgatcaccgcgggccctggcgccaccgccaaaggcaacccgctggccgcacgcaagccgggcgacccgtaccaagacggcgaagtgccggacaccgactacaacgtggtcgtgttcgaaaaccgcttcccgtcgatggttcgcgtgccgggccgttccgaagccgtggaatacgtcaacggcaacccgctgtgggagaagaagcttgctgcaggccgctgcgaagtgatctgcttcgacccggatgaagacggtctgccggcagacctgccggtctcccgtctgcgcaccgtcgtggaagcgtgggcgttccgtaccgccgaaatctccaagatggaaggcctcgaacagatcttcccgttcgaaaaccacggacaggaaatcggcgtctccctggcgcaccctcacggacaggtctactgctacccgttcatcgcgccgaagatggaagccgaactcaagcagaccgaagcctaccatgagaagaccggcggcaacctgctcaaggatctcatgaactccgaaatcgaggccggggagcgtgtcgtcatgcgcaaccacagctgggtggcctacgtgccagccgcagcccgctggcccctcgaggtgcatgtggccccggtgcgcgacgtgctcaccctcgacgagctcaacgaccaggaacgttgggatttggccgtcatgtactccaccctgctcaagcgcggcaacgcgttcttcgacaagggtgacggcaagggcatggacctgccgtacatcgcagcatggcatcaggctccgatccacgacgcacgccgtgaaaactaccgcctgaacctgcagttcttctcgttccgccgcgcagccaacaagatcaagtatctggccggatccgaatccggcatggccgcatgggtttccgacaccacgccggaactcatcgccaagcgcttccacgagctcggaccaatcgatatcgaaggctgaaagccaataaaacccaaaggacaaaacaccaatgactgctgttgaattcattgagccgctctcgcacgacgagggtgtgaagaacgcgaccgatctgttccgtgccacctacggtgaggagccggctggcgtatgggccgcaccgggccgtgtgaacctgatcggcgaacacaccgactacaacgcgggcctgtgcctgccgatcgcactgccgcaccgcacgttcatcgcgctcaagccgcgtgaagacaccaaggtgcgcgtggtttccgacgttgactccgaaaacgtcaccgaagccgacctcgacggcctgcaggccggtggcgtggaaggctgggccgcctacccggtaggcgttgcctgggcattgcgcgaagccggcttcgatgcggtgcagggcttcgatgcggcattctcctcctgcgtgccgctcggatccggtctgagctcctccgcagccatgacctgctccaccgccttggcgttggatgacgtgtacggtttgggttatggcgcatccgatgccggtcgtgtgacgctgatcaacgccgccatcaagtcggaaaacgacatggcgggcgcgtccaccggtgggctcgatcagaacgcatccatgcgctgcactttcggccatgcgttgcgtcttgattgccgtccagagctgagcccgctggagaacgtctcccagcaggaattcgatctcgacaagtacggtctggaactgctggtgcttgacactcaggctccgcaccagctcaacgacggacagtatgcccagcgtcgcgccacttgcgagaaggccgccgaaatcctcggcgtggccaacctgcgtgtggtcgccgacagcatcgccaagtccgacgatccgttccaggcgctcaaggaaacgctcgacaagctggaagacgacacgatgaagaagcgcgtgcgccacgtcatcaccgaaatcgcccgtgtcaactccttcgtgcgtgccttcgccaacggcaagatcgacgaggccggccgactgttcaacgcgtctcatgattcgctcgctgcggattatgaagtgactgtgcccgagttggatattgccgtggacgtggcccgtgccaacggtgcgtatggtgcgcgtatgaccggcggcggctttggtggctccatcatcgccctggtggataagggccaggggcacgagatcgcacagaagattgctgaccgcttcgaaaaggaaggtttcaacgcacctcgcgccttgccggcgttcgctgcggcttccgcgagccgcgaggcctgatcgcagacgctgatgcaaaaacgcgcgttggcgcacgtccatgaaaaggacgtgcgccaacgcgcgtttttcatgattcacttgtgggccagatgggtgcacagctatctcacgacgatggccagcaggcacgatgccgtagaccagatacggctagcttgatgagatgccgaagctgcggctccaccattcttaacaccatgcagcaggtgttcggcgcgattggcacgtccatcgccacctgcctgctgtcgatgggctccggcgccaccgatgcggaaggcttcgttgcgggatcccgctacggctatgtgttcggcttggtgctgatcgtcatcgtgctggtcttctccttcttcctgaaagaagacaagatcagcgaaaagtgaatcgcatgacatattgtaaaaagcgcttgccgaaatcgtatttccaaacgatcggcaggcgcttttcttttatgaaatccgatttcacgtcgaaaacagatattccaaaaaacgactttccgcaacttttgaaaccggtttgacggaagaaatcgtctcacaatgtaatgcgattgccgaaaaaacgacttttttgacatctgccttttctatacttaaggcacgtccggcattttgccgagacggtaactggatattcgcacctaacgtttagggagttccatgaacaaggcaatcatcaccgtcgtcggtcaggatactgtcggcatcatcgcacgcgtctgcacatacctttccgagcatcaggtcaacgtgcttgacatttcccagaccatcatcgacggtttcttcaacatgatgatgattgtggactattccaacaccgacaaggaattcggcgaggtcgtggacgatctcgacaagctcggcgaagagatcggcgtgcgcatccgctgccagcgtgaagagatcttcaccaagatgcaccgcgtctgatccatcagggttcatcggtaaggagcgaaggaacacatcatgctgaatatcatggaggtccacgagaccaacaagatgatcgagcaggagaagctcgacgtacgcaccatcaccatgggcatcagcctgctggactgcgcggccgacagcgtcgacgaagtctgcgacaacatctacaacaaaatcaccacgtacgccaaggatctcgtatccaccggcaaagccatcgaacgcgactacggcattccgatcgtcaacaagcgcatcactgtcaccccaatttccttggtcggcgcaagctcgtgcaaaacgtcggatgatttcgtgaaaatcgcgcatgcgcttgacaaggcggcgaagaaggtcggcgtcgatctgatcggcggctactccgctctcgtatccaagtccatgacccccgccgaagagctgctcatccgctccctgccgaaggcgctgagcgaaaccgacattgtctgctcgtccgtcaacgtgggatccactaagaccggcatcgacatgaactccgtcgaactgctcggccacatcatcaaagacatcgcacatgccaccgcagataacgattcttacggatgcgtgaaattcgtggcattctgcaatgcccccgacgacaacccgttcatggcaggtggcttccatggcgtaaccgaaggcgacgcggtcatcaacgtcggcgtttccggcccgggtgtggtctcccgtgcattggacgaggccaagggcaaggacttcgaattcctgtgcgaaaccatcaagcgcactgcgttcaagattacgcgcgtcggccagctggtggcacaggaggcatcccgtcgcctcggcattccattcggcatcatcgacctttccctcgcaccgaccccggccgtaggcgactccgtcggcgaagtgcttgagaagatcggcctcgaacaggttggtgcaccgggcaccaccgcggcgctcgccatgctcaacgatcaggtgaagaagggcggcatcatggcgtcctcctacgtcggcggactgtccggcgcgttcatccctgtctccgaagacaagaacatgatcgatgcggcaaccaatggttgcctgaagatcgaaaagcttgaagccatgacctgcgtgtgctccgtcggacttgacatgatcgccattccgggagacaccaccgcatccaccatttccggcatcattgccgatgaggccgcgatcggcatggtcaaccagaagaccacggctgtgcgcgtgattccggttgaaggcaaaggcgtaggggagatggccaacttcggcggcctgatgggctatgcgccgatcattccagtcaaccagaccagctgcgaagctttcgtgacccgaggcggtcgcatccccgccccaatccacagcttcaaaaactagcccctctcttccctacgcatctttcgcagtggttgcgttggttgcggaaggtcgcggggagccggcatattctattcccgacacgctccgggccgctcaggccaagtctttacggtctgaaacagaacatgccggctccccgcttatgttgcgcttcacatcagattaggttgacgcttgctttttgtttgcaacacgttggtttgtgtgccatagcaagcagtagggcgggatattccgttcgggaccgtaggcttggccgaacggccttgagtgtgtcacgaatggaatatcccgccctactgcgtccccaatatccataaggtaatgaattgaaacgaaagttggcaggcgggggagggatcactggccgccggcgaagcctagttggcgccaggcttcgtagatggcgatggatgcgcaattggtgaggttcagggaacgcaggctcgggcgcattggcaatcgcacctgttcggccacgtgcggaccggccataatatccatcggatcgggaatattgcccggctccgggccgaacagcagaatgtcagtcggcttgtattcgatgtcggtatacagtttggtggcgtgcgcggtgaacgcgatgatgcgcgaattcggcatggattccaccagattctcaaaattcgggtgcaataccacgtgggccatgtcgtggtagtccagtccggcacggcgcagtttcgtatcgcgcagattgaatccgagcggctccaccaaatgcaggatcgtgccggtcaccgcgcacaggcggattgccgaaccggtattgcccggaatgcggggggagtagtagcacaagtggggcgtggaggtttcggctttggccgcgtcttcggctgacagcatcgcgtcgaccacggaaatcggattgccgtgcgcgtcggtcacgagttcgtccggcccataattcgacttgcggtagccgtattcgaacattttctcgactttggcttcctctgcggttgcgccttgcgcgtcattggtatgctcttcgttcgtcatgaatgcaagaataggtacgatgaacgacacgaacgagcctaataccgaaattgaaaatgctgaagctgtggcggacgcgcttgccgaatggtggcatgcttcggcgcgtgacctgccatggcgtttcggccgcactactacgtggggcgtgcttgtctccgaagtgatgagccagcagacgcagatgagccgtgtggtaccgtattggaacgattggatggaacgctggcctgatgcggtcgcgcttgccgatgccgcgaaagcggatgtgatcacggcttggggcaggctcggctatccgagacgcgccttgcgattgcaggaatgcgcccgcgtggtcgcttccgattacgataacaagctgccgcgtacgtacgatgagttgctggcattgccgggtatcggcgattatacggccagcgcggtgatgagtttcgcgtttggtgagcgcatcgcggtggtggatacgaatattcgcagggtgctttcgagggtttttcttggcgaggagtcgcttggcggcgccgcaagacctgcggaacgtgcgttggcgaagcagatgttgccgcaggatgatgcctcaaaatgcagacggttcgaccgtccttcagtggtgtggaatcagtccgttatggaattgggcgcgaccgtctgcacggcaaaggctccgttgtgcgaggcgtgccctgtttcgggacattgcgtgtttttgcataatggtcgtccgggattgggggaacgtcgcacgcggccgcgtcaacgtttccaaggtacggatcgtcaggtgcgtgggctggtgctgaatgcgctgcgcaatctgccggaaggtgcgaccgcccttaatcgcaagtcgcttgaacgactgtgggatgaccatatccagcttgatcggtgcatcgcatcgttggatgaggatggtcttatcgaaatcctgccgaatgcggatgtgcgtcttccggtatgaaaggaagaatgccgacgttctttggatgtgcgcacgctagactgtgaaatcatggcacagaagacgtcctcgaaatccggcaagaaacgttcgaaaaaacagcaggcgatatttcgtcgccgtcgcatcgtcgtcggcatcgctgcgatagtgctgatttcttttctggtgttttgcctgtactccctgtcgagggggattgtcgcggtgaatcgtgagattcatcatgcggacgtgtatgcgatttcccgtaaggaagtgccgtccccgactaaggagaagaaaagcggggtgccggattgcgatgcgtccaatgtcgcgctttcgttgactcctgcggcgtcaagtttcggtgtgggcgattcgatggatttcactacggacgtcaaatatgacggttccagcaaggttggttgcttggttgatgtgtcggcttccagcgtggtgttgacgatcaaatcgggcgatgatgtggtttggaagtcgaatgtgtgccccgttgacaccgactatcgtctgttggcgaagggcgacgaggtcagacagacgatcacctggccgggaacgcgtactggcagcgaatgcgtggaggatcaatccaccctgccgaaggtggatcgtggcgtgtattcggcgcagctttcgattgaagggcatcccaaagcgaagtccgatccggtcggcgtcactattgaataaaaatctataggatatgttattctcatgactttgcgtacatgcgtgtcatatagcgggcacgctgacaaggaagaagcgcccgcgtactaggcatatggtggccaatgggagcgcttccggggaaacatatcgaaacgatttagcgagcgataaggaacgtccattggctgaggctacgacgaacaccaccaccatcatcgcacgcgccgaccagcacgatattgatctgcacaaggcgtcggaccgtgtgaacttcggctccatccgcgagcccattgatgtaccctacctgttgggtgtacagactgacagcttcgactggctcatcggcaacgagcgctggcagaagcgtgtcgaggaggatctggcgaacggcaccaacaccgtgccccacacctccggtcttgatgaggtcttccaggagatctccccgatcgagaacttcgctcagaccatgagcctgaccttctccgatccgtatttcgaagaaccgcgccacaccgtgcaggagtgcaaggagaaggattacacctactccgcgccgctgtatgtgaacgctgaattcgaaaacggcgacaccggcgaaatcaagtcccagaccgtgttcatgggcgatttcccgctgcagaccccgcacggcaccttcatcatcggtggtaccgagcgagtgatcgtgtctcagctggtgcgttctccgggcgtgtacttcgaccgcagccaggatcgcacttccgacaaggaagtcttcggcgcgaagatcatcccgagccgtggcgcatggcttgagttcgagatcgacaagcgtgacgtgcttggcgtgcgcgtggatcgcaagcgcaagcagtccgccatcgtgttcctcatggccatcggcatgaccaaggatgagatcgccgatgcgttcagggattacccgctggttatggacgcgcttgccaaggagaccgtgcagacccaggacgaggctctgaccgatctgtaccgcaagatccgcccggccgacaccccgacgccggaagctggccgcaacctgctggattccttctacttcaacaccaagcgttacgatctggcccgcgttggccgttacaagatcaaccgcaagcttggtctggaaaaggatgtcaacgatcgcagcctgtctcgcgaagacatcatctccaccatcaagtacctggtcaccctgcatgccggcgacaccaagttcccgggcaagcgtgacggccaggatgtggatctgcgcgtggacgtcgacgatatcgatcatttcggcaaccgtcgtatccgccaggtcggcgaactgatccagaaccagctgcgtaccggtctgagccgtatggagcgtgtggtccgcgaacgtatgaccacccaggatccggaggccatcaccccgcagtccctgatcaacattcgtccggtgaacgccaccatcaaggagttcttcggaacttcccagctgtcgcagttcatggatcagaacaacccgttggcaggcgtcaccaacaagcgtcgtctgtccgctctgggccctggcggtctgtctcgtgaccgcgcatccatggaagtgcgagacgtgcacccgtcccacttcggccgtatgtgcccgatcgaatctcctgaaggtccgaacatcggtcttatcggttctctggcaaccttcggccgcatcaatccgttcggcttcatcgagaccccgtaccgtaaggtcatcaacggccatgtgaccgacgaggtcgaatacatgaccgcagaccgcgatgccgagcacgtgatcgcacaggccaaccaggaactcgacgagaacggcaacttcgtcaagaagcaggctcttgcccgagtcggcgaagaagaagcagtcgatgtgcccgtcagctccgttgactacatggacgtttccccgcgtcagatggtttccgtcggcgcctccctgattccgttcctggagcacgatgagggccaccgagcgctgatgggtaccaacatgcagcgtcaggcagtgccgctgatcgaatccgagcgcccgctggtgggcaccggtgccgaatggcgtgcggccgtcgattccggcgatgtcattctggctgagaagccgggtgtggtgacgtatgtttccgccgacatcatccgtgtgatgaacgacgacggcaccaccagctcctacaagctggccaagttcctgcgttccaaccagaccacctgctacaaccaggttccgctgatccacgacggcgaacgtgtggaagccggtaccgtgcttgccgatggtccggccacccagaagggcgaaatggcactgggcaagaacctgctcatcgccttcatgccgtggaacggctacaactacgaggatgctgtgatcatctcccagcgtctcgtgcaggacgacaccctgagctccatccacatcgaggaatatgagatcgacgcccgcgaaaccaagctgggtgccgaagagatcacccgcgatctgccgaacgtcggcgaggacgcggtggccaacctcgacgagcgtggcatcattcgcatcggtgccgaggtcgaagccggcgacattctggtgggcaaggtcaccccgaagggcgagaccgagctgactccggaagagcgtctgctccgcgccatcttcggcgagaagagccgcgaggtgcgtgacacctcgctgcgcgtgcctcacggcgaaaccggtacggtgatcgccgtcaaggagatcactcgcgaggatgccgaggaagacggcgacgagctgccgaacggcgtgaaccagatgatccgcgtctacatcgcgcagcatcgtaagatcacccagggcgacaagctgtctggccgccacggcaacaagggtgttatctcccgcattctgccggaagaggatatgccgttccttgccgacggtactccggtcgacatcatgttgaacccgctgggcgtgccttctcgaatgaaccttggccaggtgctggaactgcacttgggctggatcgcgcacgccggctgggacatctcccttgatccggataccgaagccgcttggaagaagtacattccgcagggcgccgaaaagggcgagccgggcactccggtggcaactccggtgttcgacggcgttcgtccggaaaccatcaagggcctgctgtcctgcacccttccggatcgcgacggcaacaagctggtcggcgacgacggcaaggctgtgctgttcgacggccgtaccggcgaaccgtatccgaagccgatctccgttggctacatgtacatgctgaagctgcaccacctggtcgacgacaagatccacgcgcgttccactggcccgtactccatgatcacccagcagccgttgggcggtaaggctcagttcggtggccagcgtttcggcgagatggaagtgtgggccctcgaggcctatggcgccgcctacacgctgcatgaaatgatgaccaccaagtccgatgacgtcgacggccgcgtgcgtgtctacggtgccatcgtgaagggcgacaacctgccgccggcaggcattccggaatccttcaaggtgctgcttaaggaaatgcagtccctgtcgctgaacgtcgaagtgctcaacgccgaaggcgtggccatcgacatgaaggacgaggacgacgatccgtctacttcctccgacgatttgggcttcaacattggcgcacgtcctgacgcggccgccaaggaagaccaggttgtggaagaacctgaattccagtgatcccaaggctggtcgcgttgcctgacagcgcggcgcgaccagcctgatgaaacgtgattaagcattaagaatcgatagacaggacaatagagtgctggacgtcaacgcatttgacaaactgaggattggcctggccaccgccgacgacatccgtaactggagccacggtgaggtcaagaagcctgaaaccatcaactaccgtaccctgaaaccggagaaagacggcctgttcggcgagcagatcttcggacctacccgcgactgggaatgcgcctgcggcaagtacaagcgcgtgcgcttcaagggcatcgtctgcgaacgctgcggtgtggaagtcaccaagagccgtgttcgtcgtgagcgcatgggccatatcgagcttgccgctccggtgacccacatctggttcttcaagggtgttccgtcccgtttgggctacctgctggacatcgctccgaaggatctggaaaaggtcatctacttcgccgcctacatggtcaccagcgtcgatgaggaacagcgtcatgaggatcttccgggtctgcaggacgagttcgacaacgatatcgccaacttggagaagcgccgcaacgcggaaatcgaagagcgtgccaagaaggtcgaagccgatctggctgaacttgaggccgaaggcgaagccaagggctccgcacgcgccaagctgcgcaacagcgccgagcgtgaaatggccgccatccgcgttcgtttcgacgagcagatccagcgtctgagcgccgtgttcgaccgcttcaagaacctgaagccgggcgacatggaaggcgacgtcgacctgtggcgtgagatggaagaccgctacggcgattacttcgaaggctgcatgggcgccgaagccattaagaagcgcctgcaggacttcgatcttgaagccgcttccaagcagctgcgcgaagagatcgacaccggtaccggccaacgcaaggcccgcgccctgaagcgtctgaaggtcgtcaacgccttcctgaccaccggcaacaagccggaggccatggtgctcgacgtgattccggtcattccgccggatctgcgcccgatggtgcagctcgacggtggccgtttcgccacttccgatctcaacgacctctaccgtcgtgtgatcaaccgtaacaaccgtctgaagcgactgatcgagctcggcgctcctgaaatcatgctcaacaacgagaagcgcatgctgcaggaagccgtcgattccctgttcgacaacggtcgtcgtggccgcccggtcaccggcgcctccaaccgtccgctgaagtccctgagcgacatgctcaagggtaagcagggtcgtttccgtcagaacctgctcggtaagcgtgtggattattccggccgttccgtgatcgtggtcggtccgtccctgcgcatgcaccagtgcggtctgccgaagccgatggccctcgagctgttcaagccgttcgtcatcaagcgccttgtcgacctcaactatgcccagaacatgaagagcgccaagcgtctcgtggaccgcggcgactccgaagtgtggggcgtgctcgaagaggtcatcgccgagcatccggtgctcctgaaccgtgcacctacgttgcaccgtctgggtattcaggcattcgagccgattctggtggaaggcaaggccatccacctgccgccgcttgcctgtgccgcattcaacgccgacttcgatggcgatcagatggcagtccacctgccgctgtccgctgaagcccaggctgaagcacgctccctgatgatggcttccgacaatattctgaagccggctgacggccacaccgtgaccatgccgagccaagatatgatcctcggtctgtactacctgaccaccgtcatcgacggtgccaagggccagggccgcgtgttctcctcgctggaagaggccgaaatggccctcgacaagcatgagatcgacatgcaggccaaggtgcttatccgccttccggaagactttgtgctgccgaagggctgggagccgagcgaaatcgaagtcgtcgatccggaaccgggcagcccggccgtggtgaaggaagagcgcttccatgatggttccgtgcttttcgcaacctcctatggccgtattctgttcaacagcacgctgccggtggattacccgttcgtgaacgatcaggctccgaagaagcgtctgagcaagatcgtcgacgacatcgcaacccgttactccaccgcacaggtggcggcaacgctggacgcgctgaaggatatgggcttcacccgcgcaccgtggtccggtgtgtccttcgcgttctccgacgttatccagccgtccgagcgcgacgagtacatcgagaagtacgaagccgaagccgacaaggtcaacgagaactacgaaatcggtatgctcaccgaagaggagcgccgtcaggaactcatcgacctgtggaccaagtgcaccagcgaggtttctgaggcggtcgaggaacacttcgactccaagaacaacctggctatcatcgtgcagtccggtgcacgaggaaacatgatgcagatcaaccagatcgcaggcatgcgaggcctcgtggctaacccgaagggcgagatcattcctcgaccggtgaagtccaactaccgtgacggcctgtccgtgctggaatacttcatctcccagcacggtgcacgtaagggtctggccgataccgcactgcgtaccgcagagtctggctacctgacccgtcgtctggtggacgtttcccaggacgtaatcgtgcgcgaagaggattgcggcaccaagcgtggcctgacgatgaaggtcggcgagcgtgatgctgaaggcaacctgcatctggtcaaggccgccgatggcggtccgtactcccgtctgctcgcaaccgacgtgatcgatcccgccgacggcgagaccgtgctgtacaaggccggtgacgcgctgtccatggacgtgctcaacgatcttgttgcccacgacgtggaagaggtcaaggcccgttccgtgcttacctgcgaatccaagcgcggcgtgtgcgccaagtgctatggctggtcgctggccaccaacaagctggtggatgtcggcgaggccgttggcatcgtggccgcacagtccatcggcgagcctggtacccagctgacgttgcgttccttccactccggtggcgttgcttccgcatccgatatcacccagggtctccctcgtgttaccgagcttttcgaagcccgtactccgaagggtgaggccccgatcgcagagttcgctggcgtggtcaaggtggaagacaccgagcgcggccgtcaggtcatcctgaagccggacgacgattccgtcgagccgatcgcctacccggtgacccgtcgcgccccgatgatggtcaaggacggcgatcatgtcgaagccggcacccagctgatcgaaggctccgtcgatcctaagaagatcctgcgcatcctcggcccgcgtgctgcccaggtgaacattgtggaggaagtgcacaccgtgtaccgctcccagggcgtggatatccacgataagcacatcgaggtcatcgtgcaccagatgctgcgtcgtatcacggtgatcgattccggcgataccgaccttcttccgggtgaactggtggatcaggcccgcttcaaggccgccaatatgaaggccgtgaaggaaggtggcaagcctgctgccggtcgtccggagctgatgggcatcaccaaggcctcgctggcaaccgattcctggctgtccgcggcttccttccaggagaccacccgcgtgcttaccgaagccgctctgagccagaaggtcgatgacctcaagggcctcaaggagaacgtcatcatcggtaagctcatcccggcaggtaccggccttgcccgttaccgtaacgccgtggtcgagcctgacaaggccattcgcgacaccatctacccgaacttcggtttgggtggcgacgagtccgatgccgccttcggcgacgccgatctgtccgaagtcgacttctcgaacatcgacttcggagatctgaagctcggcgacgacttcaatccggatgacttcctggacgacaatggcggtcagatggatttgggcgacaccctgtgatccgaaaagcgatgatggaatggcataacgtctgaaatcatctcaatacatgaatggggattggctggaaacagctgatccccattttttaatgcggaactatttttaatgcggaactgcagttgctgcgatccctacgacaacagtcagcctattgcggaaccgtacgtattgcagagcggatatcttcatcgcaaaatcgcatggcaaattacaatgaaggtatgagctttcttccatatccgcctccacctgaaccaggttggtatgacgatgatgccacagtaatgtcttctctcgttgagcccgccatggcggaggctgcgcagtcgcagccaacatcgcagccaacatacgaatcaccggaatcccaagcattccaagcattggaaaatgtgcaggaatccgcggaatcgtatgcggcgaacatacagccggtggaacaggctgccgcagcgctggaaccgtccgacgtcgaaccggtcaatgacgatgatgacatcgactgggatggcacggtgctgtcttcggcgttcaccatgaagcagccgaagctggagtatgtgctttacaacgagcagaccggccaggaagtgatcgtcgatatgggtgtgctgctggggcgcaagccttccgctgaagtgccggaaggtgcgaaattcgtgaagttggaggatccgacgcgcaccatctcacgcaatcatgcggcgatcagcttcgatcaggatggcgtattgtggatcgaggattacggttcgctcaacggcacgtacatcattcaaggcaatgaggagatcaaggtcgaacgcaagccgatgaagcttgacgcgccttgcacggtgcgtatcggagaccagttcttcactttcgaacagcgctgatttccttcgcgccgcgatacatgttgcgtcgtcaatccataaatgaggatgacggcgcaacgaacatattatggtacgaaagcttaccaatgcaagcggcttttattaggccttattaggccttgtttggcggctttcgtcgggcttttgccaagttctaccaagggttaccgtcgcagacggatggctgcgttgatggcggaatcattgagactggcaagccagttgagcagatccgggtagatatgcggattgcgcgcaaggaaggggtgcagctccggagctttgcttgcgatttcagccatcagcatctgatcttccgtggtcatggccaattccgcggtgaaaccagcattcgacgcgactggctcttgcggctgaatcggcgaaaaatcagccacttcagacaggtctgcggggttggtatatgggtcgacgtattccgtcgaagcatcgttcgccatattcgatgcaggtgttgccgcaaacggttcaggctggcattgctgggttgccggcggctggtgctgcgcctgatattgcacttccgatgattgctgcggctgctggtattgcacctgctcgcttggcatctggtattgcgcctgctcgcttggcatctggtattgcgcctgttcagaagccgtctcggcctcctgctgcatgattccgtcctgcggaaccggccaccccatcgcgaccagctgctgtcgtgcgcgctcatcgccgaattgggcgacccaacgcttcaggcctgggtacgcacgcggattggcaaccacattcgcgccgaattccggattttcgtaagcgattttcgccagaaacacgggatctgcgttcggatcctgcacggccgccaccgcggcatcgaaatcgaccatcatgatctccttatctcgtgttctgtaaatattgtattgaatacgctgatataacgtgacaaatccgattattgacgattgtcattgcgagaacatgcgcattattggacggcacgtaacgtttgcaatgtgctttcctgtaaatcgccgatatcctcgtgatcgtcgattttgctgacgttccaatcgtcatttgccgaataatccgatgatttgccgcatatatcaagcacaatcacggtgacgttgtcgttgccgcccgcgtcgagcgcggactgcaccagcatatccgcggcgacttgcggatcgccatatgaggctgccacatcggcgagcagttcccgatcgatctgcgcgtgcaggccatccgagcagatgatgaaacgtcccgtggagcgcgccgcataccagtccggctgaatgccgtcaggagcgccgacgcattgggtgatgatattgcgcggtatgcatcggttcgcctcgtccggtagcatttcgccggtgtcgatggcgttctgccgttcggaatggtcacgtgtgatccgggtcagcgactccgccatccaatggccttccgcatcggcgcgcatatggtaggtgcgtgaatctccgacattgatgacgtagcagtactcatcgatggcttgttcatgcacgctatcttcaacgcgagtcggcagcaccacgccggtgatggtggttccggcgatgccgccaagctcctggccaagttcgagcacctgttgctgcgattggctcaacgcatgttcgatggacgtacggttgcgcgacggctgttcggcaagctgcgagaaacatgccgccacctgtgcgctggcccgctcgccgcctttgccgccgcccatgccatcgcatacgacatatacgccacggctggcgagagcgttgtcttggttgttttttcttttgcacccgacattgctattcaggccggcctcgatgctacggaagatcatgagtcccgtcctttcttacgattgtgcttccgatcgctgccgttgttccgcccgctgcggttgctgcggaagtggaaaacgtcggcaagcgaaagtttggcacgccatcggcgtaacgtcggcaatgacttgagcatgtacttgcgttcctgtgcaatatcgcgccaatactgctgcacatgctcttcgttgacgaaattaccggagaaggccgcgtaatcggcttgcgcgcccaaagcgagcaaggtctcgcgggaaatatccatctgattcgcgatcgaaaccgcctgttcgctgcgtgtgcctcgaatgtcgagtccgctttgccgtgcgagcgcggcgaccgattgccagccggctgccacacgctgctgcgtgctgccgtgttttcttgatcgtgccagtgcgatcgctttgatggcgagcaggagaccgcatatgatgagcagcgtccatagagggcttccgtagatggctacttttcttgcgattctgccgaaatgctgccagaacaggttggctgaggtttcgtcggccatgcttccgccgattgaggacttgcctttggcctgggtgtcgtcacgtagcgggtcggtgagtggtaccgggggctggcgtaccagggtttgcggattcggtggggtgaggttctggttttcgtcggggactttggtttcctttggcgttggatagaatgccacccaaccgtagccgtccagtttgatttccacccatgcggtcacgtcgttgccggtgaatttcgtgatggtggttgttccttgttcttcggtgcggctttcgctgatttcaccttcgtcgtcttttggcaggaatccgagtaccacacggctgggaagacctaggctgcgtgccatcaatgccatggcggaggcgtattgttcactgtctccgaccatggccgttccggcgagcagttggtcgatgcggtagttgccgtggcctgcggttgacgggtagtcgccgcttaatccgtgtgagaaccaaccggattctttgagcttttcggctaaggcctgggccgcttcgccgcctttggattggcctccggcgatggctgtggcgagtttgtccacgcagtcgggcacatcttcggcttttggctggctgatggcggccgcgtctgttttggcgatctgtttgtcggtgggaaccgttggcatgatgccggtttccgtgtaggtgagaccttcggaggtgcgtgaggggtagatggccgacatggtgtcgctgttgtagtagaacgagtcggagttttcgctgttgtcgaatgtcacgctggatgcggctccggccatgggcagccagtagtcgctgagtcctttgtccacggtgaatgtggcggtgaatttcttgccttcggcattgttggtgatggaggtgccgacacgtcggtaattggaggagtccgatgacatggtggagtcggacagattccatacgttgccgtcgaaacggtccatgaccgctagtcgcacgcttgatccagcgggcaggttttcgacggtgaggagcacatcgtccttactgtttgtaatgtacgagcgcatgccgcttaacggactggtgtaattgtacgggctaagcggcggatcataatggtcgcgcagaatggtgcggtcctgatcgacgacgaggcatcctccaatagccaatgcgacggaaagcaccacgatcacgacggaactgagccaacgtcccaattccagtaatttccaacgtgcgctgatccaaatcaccaatatgagcgccattatggtgcctacgaacatgcggtaatagccggaagatgagccgagcagcgcgcaaatcgcaagattggcggtaacgggaataatggcgatcatggtgaatcgcccatcttcagtcactgcgaaaatgccggtcagtagcgcgaaccacaggcagatggtccatacggccagcaaacagccatcggcggtaccggtaggaggttcgaccgacagaatgaatttgaacgatccgagcatgttcatccagccttgtgtaagcgtgcgcaaggtcggaacaatatgggcgatggtggtgtcgttgaggaacagtacagggccgacaaccagctgggcgacggccatgaacagcatctgccaccagagacgaagtgccggaaccgtgcctgcgagcgccacgagagatccgatgatggtggccggaatggcggcgagcgcccaggatgtggccgatccgtagacgtcgatgaggttgctggcggcggcgagggtgagtagggctgcgacgagcaggcttgcgtattgcgaggcgcgtgtccggcgtaggtaggggagtgcctgtgatttgccgtctcgtgacatccagatgacggagtgtgtggagtcggcccatgagccggtgccggttccggtgaaggtgttgccgaatccggtggtgcggccggtgtcgccggtgttggtgttgtgggtggaaagtcctgtggtgctcattccagtacccccatgatcattgggagatcgtctaggtttcctacggtcgccagggtgaaatcggcgtatcgtttgatggcgcgtggctgtccgatggcggtttgcagtaccacgcaggttgcggatcgggggagtgcgagcgccatgtgtttgatttcgtcgatgtttttgagcctgccgacggtgatgtagtagaacgatgagtcgggggcatgggcgagggtggtttgcgccagattcggattgtcgctgatatcgggggagatggcgctgcagccgtcaaggaattccgtggagttgcgtggcatgatgtgttcggttcccgcgtgtgaggtcaccggtcggttttggagcaggcattgcacgccgatggaggcatggacggataccgccagttcgaattcgtcggagctcacatagtcgtcggggttcacgctgatggtcaatgcggtgtcggtgcgtcgggtcgcctcgtattgacggatcatcagtgcgcctgtttttgcggagctgagccagtgcacgttgcgtacgtcgtcgcctggctcgtattcacgcagtccgtagaaatcgaggtcgtcgtcgacgatttcgccgcttggctggccttcgagatctcgcggaattccggcgttgagtgtgttcagcataacggttttcgggtggatgaacacgttgatttggtcgacaagtttcttttcgtgtcgtacgagtccgaatgggtcgcctttgcgtatggacaggggaccgaccggcagtaccgcgcgggagacggcggtgaattccacggtggtttggcgtgattggccggcggcgagcatggggatggcgaatcgttcgtggctgtctccgatgggcaggtcgccgcgtgctgatgtggttggcgtgcgccctggattgtcgacgcacacatcgactttcaccgtgtctgacacggtgacgcgcctgctggacacgtctatggtggcggtgaacgacgtgttgccgagcgacagcatgatggcggcgaccatcatgcatgcgaacacgatcgccatggtcagcagttcatgccagctgaggattgtgaacgctatgagtgaggcgatggcgagtccggtcacggcccatccgagcggcgacacgtatgaggtgaccagtcgtttgatgcgatgcttgatgcgtcgcagggatcgttgcatggttctcctgcgctgcatggttttggattgtcgcatgcttgacctttcgggggtttacgaacgtttcgtgtggggtgtgcgcttcgcgtgtgccgtgtcgtacgcggctggctgcgccgtgcgtttcaggcggtggcgcccacggtcggtgaaggcacttcattgaggatctgttcgatcatctgttcgggggtggatcccgcgaatgtggcctccgcggtgagcgtgatgcggtgtgcgagcacggcgacggccagttgcttcacatcgtcgggcaccacgtatccgcgattgctggacgcggcccacacgcgggcgcatcgggtcagtgcgagcgcgcctcgcatggacgatccgacttggatgcgttcgttgtggcgcgtcgcttccaccaagcgcacgatgtattcgatgatcgcgtcgtcgagacgcacggtttcgctgatggcgcgcatgcgcagcacgtcgttgccggtgagcaccgcatgtacggtggaggcacggtcggtgacgttgacctgcttgaggatgttcacgcttacgtcatggctcggatagccgatggttgttttgatgaggaaacggtccatctgcgcctcaggcagtttgtaggtgccgagttgttcgatggggttctgagtggcgatgaccatgaacggctgcggtaccgcatgggtttcgccgtcgacggtgactttctgctcttccatgacctcgagcagtgcggactgcgtttttggcgaggctcggttgatttcgtcggcgagcacgatggatgcgaaaatcggaccttcgcggtattcgaattcgccgttcttctggtcgtagtaggttacgccgaccacgtcggacggcagcagatccggagtgaactggatacgtttgaacgacatgtcgatggagttggcgaggccgcgggccagctgcgttttgccggtccccggattgtcttcgagcagaatgtggccaccgacgatcatggcggtggcgcattggcggatcggctgttccttgccgaccacgacttgggagacgttgccgaccagttgggcgaacagttcatggaattcggtgatgtcggcctgcggcgcggacatcatggaagaagccatggccggctgcgcgggcttgacgcttggtgccgtagtctgcgggaattggcgcgttgccattacgggagccgattgcgattgtggtagcggctgttgtgttggagcggattgcgtcggttgcgcctgcatgggctgcgccattggaaccgtaggcctcgtcggcctggaaggagttgcgttatgcgtgctgagtaccgtgccctcttcgtctccgtcctgttcctgcggatgcgtcggcaggcttggagcttggaatgcggggcgtgcctgcggattgccgggctgttgcggcttgctcatatggcgcccaatggaacccagctgggtggcgtcgtcgttttcgttgctcataggtactccttggttgcttctattgatcgtattgatgattggttgtgatgttgaatttgcttatttgacggtgaatgagatgcctcgcgcctgttttcctgccaaccctgttcgtaatgagatggctgaagcattggtgtctatcgaggattgcgtctctccattatcaggggttggtcccggttccggatcgggggttttctcctcgtatcggactccggtcacgggatcagagcttttcttggtcgcattgatttctggttccccggcagtggtgatcacgcgaacctcccaatcgcatctggtaccggaaggactggtgatgtcggaaacatccagtgtgccgttagctggccaatcgtaggtatgcgagctttcccctgccggagtgatgacgatctggcctttgacacttcgcccgtgggcctcccaactaccgccattgacatgaatgatgttggcgttctgtgtatcccacgtcaatgaggatggcagtgtgatttccgctggctttttgttgccgacggtattatcggtagcgattgctgggtcgctgagatgtgaggtgtcgatgaagtactgttgcacgcttaccgtatcgcaggtgctccaatcaccggaaagcggccattcggctctgctctcatgaacatcatcatcgtaataacccttggcctttacaacgaaacctgtgacgcgtccaccttttctggaccaggtcgccacacatgtgttgttgttgagttccagcttcacattggttggaggatcgactgctgtgaaagtcgaaacggacgcttcgttgcgcaatgagccactgcgttccgtaaccacggtaatcgtcggcttaagttttctgtagtaccactcgttcttaatgtcgaattcgacggaataatccttggcgcttgtctccacggatttgtcttcgccctcgatgcttaccgtaatcgactggtatttcgagttacgtgcgtcattgatccgtcctctcaccacgatcttgtcgcctgattgatcggcggaaatagtcggattgtcaggcgtaccccaaggcgaaacggcattggatgccgtggagggctggctccagttcactttgttatgcgccttgaccgtggcggtataggatgcgccgtcggtgatcgcattgtcgtcgaatttgaacgtgatgctggtgccagtgacttcctgggccggattcgccacattcggaccgctcaacgtcacctgatacttgtcgacggcggagaaattaccctccaaagccttccatgtgacagtgatggtgttcttgctagcttcggccttcacatcggtcggcgcgtccggaagcttgtcaggcatgccttccacgccattcgactccttcgaccagccgacctcattcttggcctgcaccttgaacgagtacgtcttgccgttcttcaagccggtgatttggcaggaggtcacggatccgcacgatttctcgccggaaccgtcgccgccccacgacaccttgtattcgctgatcggactgccgttcgaagagccggccgtccaactcagattcaccgcgccatcctgcgggtctccggcgatgggggagagcagcggcgcatccggcttgtccatcaccaaaacgttgatggtgcccgtcacctcacgttccttcgtattggtggcatcgcgcacgttgacgatcaccttgttggtgctcgcgccgatatcggacgaggcgctgatcgacaccacaccgttggacgggcagtccacggtcagcttcgacgcgccatcggacgtgcatccggtcacggtcaatgcggaatcggggaacggattatacgcatcggacagcaggttcacttcctcactggatcctgccttgaccttcacggttttcgcgttgatgcgtgccaaaggcctgttggaggccgtcacacgaaccgtgacgcccgcactcaccgtgcccttcgaatattgaatcgaaatcggcacgctcaccgttgttcccggcgaagcggtcttgtcggcggacacggtcagcttgccgttcgaactcaccttggcgctcacctggtcggaatcggtgccacccgaatacgtgtactgcttctcatcgtcatacaggtcggacgccgaatgggtcaacgcggtcagatcgatggtggtggcgctttctcctgcgaccacgtcaatggtggacgaggagaacgtcggcgcgggcatgtcacgtccgatcacggtgatcggcaacgtcaacaccgccgaattgatgattttcacattatcgttcttgtcgcgtttgccatccaccgcggtgaaggtgatggacgctggaccggaataatcctttgatgcggtgaacttcaacgtctggtcgttcacatacaggtcgccgtccgcggccttcgtggcgctcaccgaatcggcgccgtccacatacgcgatcttgcctgcgcccacgcgcacataatcggcgatattgatggtgatcgtctcgcgtgcgttcaccttcaatgccggcgccttcggtcgaagggtcggcgggaacacgccgtacgcgggcacttggatgaacgcagtggacgtgatgttgtatgtcgtgttggtcacggtgtacggcacggctcgtgcctcgtccgtcaattccacgctaatggtcgtggacttgtcaccgcccttgacatgcgcatggtcggtggcggaatcatccacggccacctgcagttcgtcggcgctgccggaaggattcgcgatccattgcgaaacgtccacgtcgatggatttcttatcgatcgtcgcggaagatggcacacggtagtcgtatgctgtcggcggttcgatggtggcgttgtcgtccacgttcaccgtcaatgtcgcggtgtcggacaatcctgccttgtctttgaccgtatacaccacgtaataggtgcccgcctgctgaggagtggtgaaggcgagcgcattgtccgccacggtcacattgctgatgtcttgcgattcgacgttttcgctgacggccaggtcggtgttgtctccggagatgtcgttttgcgccacgggcacggttgctgcggtgttggggcgcaatgtgatttcgtcgtcgcgcgcgtatacgcccgagtcggtgccggatgtgaatacgcctacgcggatttgcgcttgggatcgttggccggtccagtcttcgacggcgtatgagaaggtgtccgttcctgtggagtcggcataggcttcgtataccaggtaggtggcgccgacttcgctgatgcgtccgagtgtcggcgccttgttgccgagaccgagcagctgcacgtcgtcgccgtcggcgtcgatgccggtcaaggtgatcgggatctggactttttggccggccgcgacttgcgcctcgacgtcggatggtgttggcgcagccttgttggaagcgtctttttgatgcacgttgatggtgattgtggcggatgccgcgttgccgagattgtctttgacggtgtacgttacggggaaggatccggtttggtcggatgcttggtatcgtacggtgttgcctgatacgaatacgagtcctttgaacgtgtttttgtcgtattgcaggtcgttttgcaggcttaccgtggtgccgtcggagtaggtcacgtggtcgagcacgtcgatggagacgatgccgtcagtgcgtacctgcgtggtgatgttgtcggctttcggcacggagttggaggtggtcagtgccggtggctgcagtacgatcacgccggttgacgtgcctgccgcgttggcgacgctgtatttgatctgcacgggctcggtcggtacctgtcgtgcggtgatgtagacgcgcttgttgcttacgacgccggttttgatgccgctcgccgcatcggcggtcacgctggtcacggatagcacaccacccatcgggtcgacgtcgttagacagtggttccacgattgcggtgttgtcggcgccgagcagtgccacgtcgttggctgcgatgggcttggcggagtctccggtcaccgcctgcacttcgatgcgggccaggccggtcgaggggatggatccttgtgtgatggtgtagggcacgtagtaggtgccggggttggatgcgctgaaggtgaacgacatatcggtggcgttcatggtggtggatgcgccggatggggtttccacggcggtcagctgcgcgggttcggccgaggtgccatgcacgtattgtttgagcgcgatggtggtgcgggtgtctggcgtggtctgcttgacggccggatcgatcaccgcggccagcgtgttggccggtttcactgagaaatacaccatgccggtgccggtctgctggccgtcggaaacggtcacttcgatgccggcgcgtccggaagacatggatcccgcgttgaacacgagctgcccgtcggcgcgtgtggaaacggtcacctggtcggtgttttgcggggttgcggatacgagggtgagcgggtcgccgtcgggatcggagaagctgcccagcgcgttggtggtgtaggccgctccttgttccacgtcgatttccggtggcgtatcggtttgctggggcgcgttgtcgtccccgcctaccagtgtgaggcttacgttggcgttggaggtttgcccgcgtccgtcggagatttcatagctgaacgatacggatccttcggatgccgcggaagcgtcgagctgcagatatcgtccgtcgtatacgggggaaacgctgatgttggcgccgtcgggggcgcttaccgaggtgatgcgcagtacggagcagtcggtctgttcgtcgttgcggagcacgtcgaggatctgctgcgatcctgttctcgcgccgaacgaatcatcttcggctttgatctggccggattgcgacgagcaggtcttgctgaaattatgctggttgttggcgctgtcgttgttctgttcctgttgcttcgactgtttggtttccaccttgttccattggattttgatgaccttggtggattcctgcggattccaaacgttgccgttgaccacgtcgttgagtatgaccagacgatggttggtgcggaatatcagttccgaagtggcgttgatgttggtcagggtgtcgaatgccgtatccgaaccgtctacggagcacactttggcgtaattgttggctttctgcgcccatgcggcgaacacgcatccgcctgtggacaccggttgggcggcctcgcccttgccggaattcggtgtttcagaggttttcttggtgctgaggttcaccgttgcgagcccgcgtggtgtcgccacggccacccatccgttctgtttgccgtccgtggaaggggcctgcaaggtcatgctgccctgcagattgatggctgcgcttccctgcggccaatacacggtgccttttgccgccacgaccggggtttcgccgatgacggtgaacgattcggcatgcggtgcgcctcctatcgtgccaacttgctcgcgcgtgtcttgcggccctttgatgctcagcaccgcgccatcggaagttcggtatccgtatacggttccgtcatgcgtcaccgcgatttttccgccggatcccagtttcatgttcggcttgtcggtggtggggttgacggatttcacatcggcagcggatcccacccacacattgccggttttggtgttgatgaacgctgcggtattgcctccgataatggtttcgatatccgttttgatggcggtgttgccggtttcgctaatggtggaagccgcgatattgctggctttggtgccttcggagatcactgtgtcgccatcatgctgtgccacgtcgaaacgggaggctgcggatgagactccggcgtccacatccttgttcttcgcattgaatcgtgcggctttgcggtccttcagcgacgtgatccacacggtgccgtcgtcaagttgcacatgccgttgcgtcaccgaactgacgatgaacgcgcctgcgatgatacccagcagcagaagcagcatgacgatcggcgtgatccaccgtctgcttcccgacggcaacagcagtttgcgcatcatcgatccgaagcgcaattgacgttcgtgcgattgtgccggctgatcggctgcgttcttgcgtttgtccattttcggttcttccttgagtgttccgatggtcgttgtgttcgttccggacatcgcctgcgatggaataatgccgtcggccgaccctgttgggaagtgctgtgatgcttatggtttggccgcgcacgcgatcgcaggattctgcgacatctgccggtccgctcggatgaggctcacctggatgcaggtctgcgagccgtcggcgggtttgatgctgatgcgcgtgtcggtggtggtggttccttgggcgttcgggtctactcctgcatcgcctaccagcgaccatgcgtacgaatcgccgtcctgagggtcggggttcacccatgtgaactgcacgctgctgccatcggcggaatatgagccggccagattctcgacactgggcacgctacttgtggtgatggccgaatcaggcgaatcgttgtcctgatcgtgcgttcccggagtcttgatctgcacgctgctattgtcggaagccgaatccatattcggcaagatcacatacgcgaacgccagttcgacggctgcaatcgcggcgaccgccgaaacaacgatcgcaagaggcttggcccaagtgctgcgctgctttgggacggtcggtgaaacctgaatgttcgcctgggactgtgcgtacagattttgcgggaacggcggttcgccttcgaccgtggtcggcgtggcatggccatacaattcctgctgcgcacgctgcatgtcacgcgcgaaatcatatgcggaataataccggtcttccggcgctttattcaacgccttgcgtaaaatccgctccacttgcgggggaatatccggcctattgagcttagggagcggatcggtgagaatgatgtttctcagcagagcaccgcgttctttgcccctggtcgagccgagggccgcggaatagccgtattcatatggcgactggcccgtcagcatggcgaacagcgtcgcccccagcgaataaatatcggaggattcgttgcctccgccgttcttcgcaagcacttccggcggagcccacgcgatggtgtagccgatgccgggacgcccgtaaatcgttcccgcgatgccgaaatcggcaagcatgggcatgccatgcgtgttgatgagaatattgctgggcttgatgtcgcggtggatgatgccttcgcggtgcgctgtggaaagggcgctcgccagattgatgccgacggtgagcatctggtctgcgttgagcctgttggattccaggaaggtcttgtaattgcctcccggagcgtattcgaatacggtgtagccgttgcctgtggcggtgatgccgctttcgtacaccgaaagaatgtagggatgcgaggagatcctgcccatgaagttcgcttcggaacggaaccgcgacgccgcgcgcggatcgagcgttcccttgctgaccttgatggccacttgtcggctgggggaaagctgctggtacaaatacacgttcgcttcggaacctgaacccaacttttgggcgaatgtatacccagggatttgagggggaatgccgttcatggcttccatatgctctctttcctcgtggtgcgtatgcttttcggccgctctctctggatcctatcctaactgaagaccaacccagaaacctatcagcaaggggtcaaaatgtccatatacaaagacgggcatctgagacatgttgtggctgaataatagaagtcgtagtgatagaaagaacgtgcgaaccttaagagacggccttcgtggcgacgatgagggtacatacattcagttgctggatgacgggcatctggctcaaatggaaatgaccattgatgtgttgtcggcgttgctgcagatgccacgaaggagtggttgcaccgcagatcgtgttggataaaggttggcttcgagacaactttgcaggttccggatttgtcaggtaaaggagggcgagactagtagtgttgggaggcatgatgaatttggaagaccttgaccgcgtcacgttggttgcgggcgcgccgagcagtggaaaaaccgagtttgcgctgggcatgctggttgccgcaatgaggcggtatggtgacgggaatgccgtgatgacggtgtctggcaggcagatcgccgatgcgttgggcgatcgggcgatccgcgaattgtcggccgtgtcgcaggcgcgaccggtcactacgttgcctgccgtcgcattccgtctgctgacggccgtgagatcaagtcaaggcgaaccgttgccgaaactgttgaacggtgcggaacaggatgtgatcatccgcaaggtactagcttcgcatgtggagcataggcaacatggcgacgattgcgccacctgcgatctgctgcgcacctatttcgcggtttccgaatggtcaggactggtggccgacgattccaccgacgcattcgccaaccaattgcgcgacatgctcgcacgcatgaacgagattggcgcgaaaccgcagttcgaagacatgctgatcgcccgtgcggccagcagggacggcatgcttgacgaacgtcgcgaacgcctgcgcactcaatggcgtctcgccttcgccttgcgtgaggaatacaatgaggcgatccgttcgtcttatcctggcgaatatcgtctcgacgcgtcgcagctgatgatcgacgccaccgaagccgtgtctggcatacaggaagccgatattgcgaacatgctgatcgtcgacgattttcaagatacgacgttggctggtttcgcactgcttgaagccctgcatgaacgcggggtgcgcctgctgttggttggcaatcccgacgaagccgtgcagacgttccgaggatcatatccggaatatctgttcaaccaggcgcagacgcgcatgggagcgaggcttgaacgcatcgaaggtctgcaaacggcgcacgaaggcgataccgcgcaaaccgtgtcgaaccagcaaggcgtgcatggcgactatcgcacgcttgtcgcgacgcgagtgagcctgtcgatcgcaagcacggagtcgacggacgtgcctctgcccgatcgtcccggcaaaatgagcgatatgccaggcgcgatgcccatcgaaacgttgccggccgacgatacgggcgctcgtgtcacgccggccgacggcagtgtggaaacggccttgtaccgttcctcttccgaagagctcgacgacgtggtgtggaagatcaaaactgagcatttgcaacgttcccgtgtatggaacgacatggccgtgatcgcgcacgacaatgccaccgtgcgcgcattcggcgagcggttgcgcgctgacggcgttcccgtgcgctattccagcgtgacccggccgttgaaggatgagccgttcgtgcagggtctgttcgcgttgatcgagttggccgaattgaaaaaccagacgatcgcggcttcgaccatggacctgcagaccgccggatcctatattcgttcgcgcgtggcgctgattatgggatctccgctgattacggtcggtggtgatcaacggcatgaggggcgtccggcccgtctcgcatccatcgaatccgcgatgaacgcgttggtttcgctcgcttcgattgtggaaagcaaggctgcgaaccatgatgaggatgctgccgaagaatacgacgaagatgatttcgaagattactttgaagatgatttcgaagatgatgaggatgcggcggacgctgccgtcgaacaacaggcgttgctccctcgtttgatggaagactggcgcgattatatgacggactatcatgcgattcgcgccgatggcgagcatgatagtgagcatgaagacgagcatgaaggcgatttcgcgctgagtatggaagcgctgtacgtgcttcttatggagggcaataccgatcgcgtggtcgatgcgatcgcctccgtgctgggcgcggatccgcagatcaaggcgttcgcatcattgtggaaggttcttgacaaaacatgcgagtcggaagccaaactggtttcgcgtgaaccgcaatatgtgttggattgcgcatggagggcctgcggcaaggcggaagtctggcagcgtgtggcgctggagcattcggctgccggccgtgccgcgaatgatcggcttgacgcggcgatgcgtttgttcaactatgcttcaggcggcgagtcaagcggggaattcgcggtacacaccatcgaggcgttcatcgaacaggtgcgtttgctgaccattgaggcggattcgctggcgcataccgcgcccattgatcaggcggtgaccctgacgactcccgcaggagcggcgggaaagcgctggaatctggtttttctgccggctttgcagcaggggcagtggccgaatctcacaccacgcaacacgttgttcggcggtgaggaactggccgatgtgatgctgcacggcgtattgtccgacacgatcgtcactccggcgggcaggcaggacgcgcaactggcgtcggtgctcgcctccgagcagaagagcctgttggtggcgttgacccgtgccagcgagcgtgtggtggtgagcgccgtgctgaatgacgacaatgtgccttcggattttctatacggatatatgccggagtgcttcgaccgcgatcgcgacgccgatatggaacggcgagaatatgcgtcggtcggcggccaaggcgattacgcggggctggaaaccgatccccgtggtctggtcgcggccgcccgaagcgtgcttgcgtcggaacctgaggacagcccgaaggcgcgtgatgccgcggaagcgttggcattgctggcttcgcatggtgttacggcggccgaccctgaccgttggccgtttatgggggagacggtcgaggccaccatgcggaagatcgcggccgtcatgcggacgggcatgagcgacacgtcggaaagctcgacgtcgggccgaaacggtaaatcgcggcgatccgacgtggtgactttgtctccttctgcggtagacaatctgtgggcgtgcccggtgtgttggatgttggaaaaccgcttctccggcccgcgcatgggcagcgtcgccacgagtttcggctcgctgatccacaaggtggcgcaacaggccaccgaagccggacttgatatgccggaacaccataccgccatcagcgacgtggacaatatcaatgcgatcaccgaatggatgtatgccgaatacaagcgtctatgcggcgatttcaacgccattgccgatcccgcgcaacggtatcaggcgttgaagaaagatgagcaggcgcaggaggcgttgcgtaacatcgccacgtatttcgtgcaatcgaatcatggtgattatccgattaaaaataatgatgcattcagcgttggaaaacttacgaaagccgaacctgagctgaaatttaccgcaaaattcgatttcgacgatattctcgacgcctacaatgcgatggacggcgttcacgcgatttcacggaacgaattgatcgccattatgggagcgttggtcggaggatggccggaaaccggcatgagcgagtatctcaccgtgcgtttgaccggcaggatcgaccgtttggaacggcgtgaaatggcggatggcacgcagcaggtgcgtctgatcgactacaaaaccggtgtcagtccgaccggcgaaggcctgttcaacgatctgcagctcgtctgctatcagctgggactcgtattccccgaggaaagcggcatgcgcggggcgcaggcggtggcgaacgcgccgaacatcacgcaaagcgcgctattccatgtagccaagcacgcataccctgcgccgtatggcgacaccgccgccgaatcgcatatgcagcaggcgctgttcgccaatggaagtctcaataccggcgaattcataccgcgctattacgtcaaaaaactcgacaaggatttccacgacggactcgatgacatgcttcctccgttggaagtgagcgacgagcattggaatgagttccttggcttacgcggcacgatggcggtatggtccctcaccatgatcgcgagggtcttctatgcggccgcggccagcagggcgaacgaaatcaccgcaagaccgacgacggaacatgtgagatactgcagaaacactacgatctgcccggcctgtgcgggcgaacagaacaccgtattcgaaaggagaacggcatgagcggaaccatgaagttcaccgacagtcctgagcaggctgccgtcgtccaagcgccctcgtatgcggatgtggtggtggtggccggcgctggatccggcaaaacctacacgatgaccagacgcatcatcacgctgatcgaacagggggtgagccccgaaaagatcctcggactgaccttcacgcgcaaagcggcctcggaactattgtctcgagtgtctgcggccgtgactcgcgaccagcgcgaacgcggcctgaaatcagcgaacatgacgttcctcaaaccggaagtctccacgtacgacgctttcttccaatccatcgtgcgccaatatggactgcttgtcggctttgaccagaacacgcagccattgagcgaagcaggtgccatgcagctcatccacaccgtgcttgacaggcatatggatgatcttatggcgttcgacggcgatctgaaatcgttcaacaccatagcgggcaacgtgttcgccctgtccaacgccatttccggcgccatgatcggcggcgactgcaccagcttcgacgaagccgtgcaacgcgtgcgcgactgggatgaggcgttcgtcgaacagatcgccaaggcgcttgacggcgaaaccgtgccaacggaagagccgaaatcgccaaagctgccgaaacgactgaaaaaggattccgacgcggactacgaaaagaaactggagaaataccgcgaactcgggcacgacatgtgcgtgttcaacagcgcgcaactcgcattcgtcgccaagcaacgcgacctgctgctcgatcttgtgcttgactatcatgccgaaaaacgcgcctgcaatatggcggaattcagcgatttcaccatcgcggcattccagcttgtctcccgattcccgtccatcggagcggcctaccgcaaacgctattcgcatgtgctcctcgacgaataccaagacacgtccaccacgcaggcggcactgctgagcgcgctgttccacgctgacgacacgcatcgcagcgcggtcagcgcggtcggcgaccccttccaatcgatctacgcatggcgaggggcgagtcctggcgcattccgcatgctgcaacacgatttcggcatggacgccaccagcaggccattcgcattgaccgtgacgcggcgcaactcacgcatggtgctcgaagcggcgaacaatctcaccaaaccgctccgcttgcctgccagacgcctcagcagctcgctgatgcgcgaagtcgacgttccggcgctcgtcaataccgacgaagcccccgaaggaacggtgggcgtgcttgcgttcgacacgttcgggcaggaggtcgacgcggtcgtgcgcttcgccaaacatgcgatcgccctgcacacgccttcctcgcgcgacctcgacaatggcatgaaagacaatcgtccgcacgtggcggtgctgttccgttccaaaggaatcatgtcgcaattcgcggaagcgctcgaacgcgcaggcctgaccacgctggtagtggggcggtcggcgttgctggaacgtccggcggtgcaggacgtgttcgctttgctacgcgtcgtcagcgatcataccgacagtgcggcgcttatgcgattgctggccacgccgcgattctccatcagcgccaacgatctgcaggcgctcgccgataccgcggaacaggtgaacacgatgtgccggtatcgtgcgcttgtttcagctggaatcgtgcaggagcaatccaacaaggaagaaaaaccggaaaatctgggaatttatggagtaactcccaagtcgggtccttccgatgctgaaatccgtgccatcgtacgtgaatatcgagatcaagtgccgaatgcggttttccttgtggacctcatgttgcgtgacgatctcgcggaactcattgacggcagggtgagtcgtgaagggacgaaggaagtgcttcgcgccgcggatgcgatccgtcaggtgcagcgcatgcttggccacccgttgccggaagtggttcgtgaggccatcgtcgcattgaatctcgatatcgacatgcagctggccgagcatatgcgcggcggtcaggccgatgccacgctcgccgcatcccgggtggcgctcgccaaatcgccgatcgatgcgttgctgaagctcgtcgacacgtatatgcaggagatcgcgtcgcagggaacgccgagcctgcgcgcgttcatctcatgggcggattcgctgcgcgacgcacgcgaggagaacgcggtggctcccgatgtgcctgtcgacgtggtgctgatgaccgtacaccagtcgaagggccttgaatgggatgccgtggccgtggtcggcatgaccgatggcggattccccaccaacaagggcagcgatctgcgtgtggtcgttgatgaagagcatctcaacggtttccaggatggcgtgtggacgccgcccgaatatcatgagaccgccaaaacgtggctgaccgatcctgctgcggtgccggttccggtgcgtgtggacgccgatattctgccgcgattcccccatgacgcgcttgtgggtggaaatccgttggaagcgttggaaatgctggaggatgcggaaatcattgacgacgaagtgttcggcaccttgcggaatatgagcgtcgatgacatggaaggtattgatccggacggactgtatttgacgcaaatcgaggagtatggccgtcggttgcatgccgacgagcgtcgcctcgcgtatgtggcgttgactcgcgcccgtcatgaggcgctgctcacctgcagcgcaacgaatgcggaaagccgtgatccgcgtgccgtgggcgatcgcaaacgtgtgtccaaaccgtcgaatttcctagtggaagtgcgcgattccatgctcaatatcgtttccagagcggctgagccgagcaacctagccgatattgcggaagttgaggatgtcgattcctccgaaaacggcatgaccagtctgcattcgatcgatgcgccgttgccggatggattttttgtgggcgagcatgcccgcgattttgaagatgcggtggtcggcgacgcttggaatgcgccgctcgagccgtcggaaggcaaccagttcctgccatggccgtgcgagttgagcgatgagaccctgcagacgttgcgtttgtctgcgttgcaggtggattcggcgatgaacaatgctggcgggcagactgatgggcgggctggcgaacgggccagcgggcaagttggcgagcctgtcggtggcgaaggtgctgggcgttgcgaaaatacgggtgcttcgctgctgcgatgcgcgcaattgctggtggccgacagcaatctcatgcctgacatgcttggagaggcgtcgcaggatgcgttcgacagcgcggtgcgtgcgaagggcgagaggattcttgcgtcaggtcgtcagaacgtcacctcgctgcaggcgcgcgcaggcatgatggacgagcgtggcgcccgcacttactggcgtgggctggtgcgtccgataccgaacgtagcgtctccggccgcgcaactgggcacgcagttccatgcttgggcggaacggttcatcatggccgatgcgaatgatgccggcattggcgttggcgcgagcggcaatggcggtactcgcgtagctgaatcgcgattggcgatgcttgccgagctgcgacgcaacaatgcggcgcaatcgcaagacaatcaagacgataatggggcagacaataacgggatattcgattggcaacagcgtctcgcaacgtcgacatgggcacggcgcaagcccgcgtgggcggaacggcaaatcgtcgtcaacgtgccgcaattgggcaccatcgtcaacggcaagctcgacgcggtgttcttcgggggtctcgatggggtggatcggtcgaaacaatatactattgtcgattggaaaactggaaaaaaacctcgcaaaaaagaggaaattcagaaaaaattagcacagttggatatgtatcgtatcttgctgtcggcaatggagggtgtaccgcttaccgctatcgacgcctgcctctactatctgagtgaacccattgagggcgatcgacagctcaatgctgccgacaaaacagaagaagagatccttgccgagttgagctacggaattccggaacaatccgacaacgactagtgctggtgcgccgaacgtgcggcgctttccagcctgcccgtagggtaacgcactatgggcagcgttgtggaggagcgccgctaccctcgtgcagcatgtgtgggcgggcacacgtgccggacgcaacgaaagttaaggagcgataatcatggctgccaccagcgcaaccgaaatcccgaagtcgccatattccgtactgttctccattccgggaaccaaagcgttctgtgcttccggagccttggcgcgactgccgatgtcgatgatgagccttggcattatcctcgcactcaaccatttgtatgacaattggacgatcgcaggcgtgatgagcgcggcatatgtgctttccacggcggcggtcacgccactgtacgcacgactgttcgaccgattcggccagcgcaaggtcggatcggtagtgcttgtcgtgcaaatcatcgccatgcttggctttgcgttcgcggcattggtgcgcgtgccgattccactgctgttcgccttggctgtggtgatggggctcacgcaattctcgttcggcgcgcttgtgcgtacccgttggacgtatgtgcttgaccgtaccggcaacggctcattgctgaacactgcgtatgcattggaatccgccatcgatgagatcgtattcattttcggaccgattctggccgcgttcctggcggcttccgtgcatcccgtttcgcagttgtttgtgccgacgattgcgtgcgcgatcggcggcacggtgttcttcgcattgcgtgacacgcaaccgccggtagtacgtgaaatcactgttgtttcggcatcttccgacgatgcggacgtgcgattggcggttgacggcaatactggaaataatggcggcgcaaattccgtgcaacaagacaaacaacaagacaaactgaccgtcgcgcagttgaagtcgaatgacaatcgcaagaaacgcaatgtgctcacctatgcgggcgtgattccgcttttgatggtattcatcgtgttcaacatgagtttcaccgcattcgatacgtcgatgacggccgttatgaaagcgttgcatcttgattccctgcttggtgtgcagcttgcgatgttggcggtcggctcgtgcataggcgcgctggttttcggcacgcgcgagctgaagggctcccgctggcgccatatgatcacgttcctcgcgatcataacggtaggcttcttcatcattcacatgtgccaaggcaatctgattatgatgggagtgtttgaaatccttacgggtcttaccgtttcgtcggtgttcgcttcgggcaatctcgttatgaaggagaccgtgccggaggaatcgctgaccgaaggcctcgcgtgggtgagcaccgcgggaaccatcggcgcgtcattcggttcgatgaccacgggaatcatgctcgaccatttcagcccagacataagtctgatgctgccatggattttcgtgctcgcttcgattccgttcgccttgatcggctgggcggtgacgcgtcgaagcgtctctttacattcgtaaatggaacattcctcagtagaatgagtgagactgatttgaaatgctgttcgtacgctcgtacgtgcgacatgcttgaaggagctgcaatgatcaaggtttctgtagttggcgccaaaggacgtatgggttcccatgtggtcgatgccgtgaacaacgcggccgacaccgaattggcgctcgcgcttgacgccggcgacgacctcacccaaatcacccccggcaacactgacgtggtggtggagttcaccgtgccgagcgtgtctcttgacaatgtgctcgcactcgtggcgcaaggtgtcgacgtggtggtgggtaccaccggctggaccgacgagaagctcgatcaggtgcgtgccgcgctcgctgccgcgcctcgcgagggccagagtgtgttcattgcgccgaatttcgccatttccgccgtgctcgccgactatttcgccaaggttgcggctccgtacttcgaatccgctgaagtgatcgagctgcatcacccgaacaaggtggatgctccgtccggcaccgcattccacaccgcgcagggcatcgccgcagcccgcaaggccgcaggtcttggccctgtgccggatgccaccgaaaccgatggcggctcccgtggccaggtggttgacggcattcacgtgcacgccgtacgtctgcgcggtcttaacgcccatgaggaggccctgttcggtaatgacggcgagcagctgaccattcgtgccgacagcttcgaccgcatctccttcatgccgggcgtgctgctggccgtacgcaaggtctccaccggcgcatacccaggcgtgaccgtcggcctcgacaacttcctcgacctgtaaatctacctcgtaaatctatggggtctggaacttttccggtctgatcatacaatccccgatttggcggcgatggtgagttttcgcttgctggatcggggattgacatgttttgcggtctacgatttcacgaggcgtgctatggccgcgcttgcctcggcgattttcgcttcggaaacttccccgccctcttcgatggcttctttgacacagtggttgagatgatcgtcgacgagcagcagcgctaccgatttcaacgcactgttcacggctgatatctgcgtcaggatgtcgatgcagtattcgccgttttccgtcatttggcgtatgcctcgcacttgcccttcaatgcggttgaggcgcgcgatgattttcttctggtcgtccgcgtatccgtgatgggttgcgttcatgatgctgctcctcgtaacgctgaaatcttgatcttaccgctgaagatatcgcttttctcttgcaaatataccctataggggtatattgtgatgatagtcattgagacgtgaacgtgaataaggttggtgagaatatgcaggctttgattgccgtcattgtcgcgttcattgtgacggcagccgtgttatggttcttcttcgcgccgcgcaaagcatttcgcgctcgtgtcgataacggcgtgcaagaggcggttgtcgaagtcaaaggtgggtatagtccggcaatcatcgaagctgaggccggtttgccattgcgattgatattcgatcgcaaagaagacggtgaatgctcgtcgcacatggtgttctccgatttcggtgtcgacctggcattgcccgctttccgcacaacgacattgacgcttcaccctaacgaaccgggggagtacggtttcgcatgcggcatgaacatgctgcatggcacattacgggtggtgccgggaaaacatcatgccgcaatgccgaaagaacattcggaatcggaagagagcacgaatactgctgaatctcacgttcatatgcaatcgcaacaaactgttgttgatgaaaaatcgtatgaatccgctgaatcttccaatatttcttcagattcttctgattcgtcaaacgattcttccgaatctcgtgagatgcgaacgctgattgcgcgtcttattgtgtcagccatcgttacgattccagtattcggttcgacgatgttgatgctgtatccgatgccgaattgggtgcaatttgtgctgatgctgccggtgatgtgctatgccgcattaccgattttccgcagtggtttcgcggcgattattcaccgttcgccggaaatgaatgcgctggtcagtctgggtaccgtatgtgcgtttgcctactcgtgcgtggtcacgtttattccgcagattctgcctgagaatgctcgcgaaccgtattttgaagcggttggtgtggttattacgctgatgctggtcggccaattgcttgaagcgcgcgctcgtgtcggtactggagaggccatgcgcgcgttggcgggattgcagccgaaaaacgctcgcgtggtacgaggtgaaattgaagaggaaattccggtcgagcaggtggcggtcggagatattattgcgattcgtcccggcgaacaacttcctgttgacggtgtggttattgctggttcgtcggctgttgacgaatccatgattaccggcgaatccatgcctgtggtgaagcaggccggcagttccgtgaccggcgccaccatcaatggcactggatcgctgcggtatcgtgccacgaaagtcggcaaagacacggtgctcgcgcagattatcggattggtgcaatccgcgcaaagttccaaagctccggtacagcgcatggcggataagatttcaggcattttcgtgccgattgtggtgctgatcgccgtatggtcgtgcgcattgtggtttgcgttcggaccggaaccgcgcgtggtgcatgcgctggtggcggcggtttcggtgctgctgatcgcatgcccgtgcgctttgggtcttgccacgccgctttccgtaacggtttcgaccggtcgtgccgcgcagatgggcgtgctgatccgttccgccgaagcgttggaaacctgcggcaaaatcaatgctgtcgtacttgacaaaacaggcacgatcaccgctggaaagccatcgttgaccgacgtgtttccgcttggaaaatggcgcaaaatgccggatgatctgctggcgatcacagccagtgccgaacgggattccgaacatcctcttgccgccgcgattgttgccggagcgcaagagaagcatcttacgttaggcgagaccacgcaattccgtgcgatttccggtcggggcgtcactgcgcacgtcgcgttgccgttaatatctgcaaataatccgactgttgcagctgacgaatcctctgcatcttccgtgaccttcgaatcatccatatcttctcccgaaaccgcaatgtacaacgttgcggtcggcaataccgatctgatcgacgatcttgacgtggccatgccgagcgtcggcaacgaggatctcgatgccattatcgaggctatggaacggctatcggcggaagggaaaacgccgatgctcgcagcaatcgacggcgagcttgcgggaatcgtggccgttgcggatacggtgaaagccgattcgcaacaggccatcgcagctttgaaatcgcgtggcgtcaacgtggtgatgctcactggagacaacgaaacgacggcgcatgccgtggccgatcaagttggcgtcggcaacgtgatcgcgggagtgcgcccggaaaacaaggcggacgaaatcgcgaaactgcaggcgcaaggctatacggtggcaatggtcggcgatggcgtcaacgatgctccggcgcttgcccgcgcgaatgtgggattcgccatcggtaccggtacagatgtggcgatccaatccgcagacgtgacattgatgaatggctcgctgatgggtttggtgcatgcgctcgacttgacccgcgccaccatgcgcaatatcgcacagaatcttggatttgcgctcggctataacagcgtcggcatttccattgcggcgggcgtactgtacccgttcaccggcatgatgctcaatccgatgatcgcgggcgcggccatggcattctcgtcgctatgcgtggtgacgaacgcgagccgactgcgcctgttcgatccagacaaggcggtgcgtgccgcaaataagacgtatcaggttcgccagccgaacccgaacgataataatcacaacaaccatagtcagaaaggattcatcatgggactgttcagtgatcacaaagccaagaaggaaaacgcccacgaaagtatggaaggcatgcgctcttgctgtggcggccacactgccaacggcaatcagagcgcgcccgccaaagatccggtctgcggcatgagcgtggatccggccaccgctgcagccacccgagaatacaatggcaccacctactacttctgcaacccgggctgcgccgccaagttcgagcagaaccccacccaataccttgcctgagtttgttttggtgggcgcacttttccctcttggtgatcgcactgttttggagtgttgtgcggtcaggaaagcaaaatcgtgcgatattccgaaatcgtgcggtcaccagatcaaaatcgtgaagtcatttggcttgaatccccctgagtatgcggctaagcgtaccgattcttccacttgctgggggattttggactgtgggaggcttggcagcgggaggattgttccattaactggaggttttgggtctctgggaggctggttgacgggaggattgttccagcgggtggaggttttgggactctgggaggctcggcaacgggaggattgttccagcgggtgggggattttggtctctggaaggcagttcatattgcgatatggtcgcgaactcgggcgcttcggcgtccgtggcgggaagtaccgttggcactatgactgacggtactatgcatcttcttgatcctgctcctttcggacgtattcttccggccatggtcacccccatgaaggccgacggttccgttgatttcgaggccgcgcagaagcttgcgaagcagcttgtcgccgatggcgccgatggccttgtggtcaatggcaccacgggcgagtctcccaccacccacatggaggagaaggtcgagctggttcaggccgtcaaggatgtggtgagcgtgcccgttatctccggtgcgggttccaacgataccgcccacaccgtgcgcatggtggagcagactcaggaggcgggcgccgatgcggtgcttgtggtcgctccgtactattcgcgcccgtcgcaggaaggcgtgttccgtcactacaaggcggtcaatgattccgcggacaagccgattatcgtttacgatgtgcctggccgcaccggtctgcacattcagttggaaacctaccgtcgtttggctgagcttggtcacgtcaaggcggtgaaggacgccaccggagatatcgcgggtgccgtgcgtaagcgtatggaaaccggtttgacttggtattcgggcgatgacggtctgttcctgccgttcctttcggttggtgcagtcggcattatttccgtgatcgcacatgctgcttccggtccgatgcgcgatttggctgccgcattcgaccgcggtgacattcatggggctcagcgcattgccgtgcagcttgctccactggtcgaagcaatgaacggcaacggtttccaggctgttatggccaaggcttcgctgaaggtgcgtggcattctcgactccacgacgatgcgtctgccgaacgtcggtccgggcgaggctgagatcaagcgcgcggaagatggcatgcgcgcttccagcttgctgtaattgaagaacttgtgattgcgaaacttgtgattgcgaagcgcttgattgtcggcgattgcgctgattccgggcattgttgcgatcacaagtttgctgggtttgccgtaatacggcaaactaactgaattcctcgtttccgcacaggcggagacaattagtaatggaaatccaactaggaaatggctatagaagaaaccaaaacagtaactacgcacaagcgcggcagcaaagctgccaagcgcactgaaaacacgcagaccgcggatgtgcaatccgtgaagtctgtgagctctgagaaggtcagcaaggctgaaacgacttccaagaaggcgaagtcttctggccgtggcaatcgtgcgggcgatgcgtccggttccgttcgtggcggttctcgcggcaacggcagcggctcctccaagggctcgaagagcacgaaaaacgtgaaggccgcaaagaacacgaagaactccagaggtcccaagaactccagcgcggcaagctcttctgctggaagccgtcgcaattcccgtcttgctccgcagaccaccgcgccccagcaggatgacgtgttgatcgctccgccgaagtaccgtaagggctccatgcgcatcgtgccgcttggtggcctgggcgaaatcggccgtaacatgaacgtgatcgaatacaacggccacctgctgctcatcgactgcggtgtgcttttccccgaagaggagcagccgggtgtcgatctgattctgcctgacttccactacatcaaggatcgtctcgacaaggtcgaggctctggtgcttacccacggccacgaggatcatatcggcggcgtgccgtatctgctgaagctccgccccgacattccgctgattggttccaagctcacgttggctttcgttgaagccaagtgcaaggagcatcgcatcaatccgcgactggttgaggtcaagggtcgtgacaagctgaaggtcggtccgttcaatcttgagttcgtgaacgtcacgcattccattccggacgctctggctgtgttcgtgcagactccggccggaagcctcatcgataccggcgatatcaagcttgaccagctgccgcttgaccatcgcatcactgatttggtggagttcggcaagctcggcgaaaagggcgtggatctgctgatgatggattccaccaacgctgaggttccaggcttcgtcaagccggaaaccaccattggcccggcgctggatcaggcgttcgcccaggccacacgcaagatcatcgtggccagcttctccagccatgtgcaccgtgtgcagcaggttgtcgacgccgcccacaagtacggtcgcaaggtggtgttcgtgggccgttccatggttcgcaacatgtccatcgctgcggatttgggctacttgagacttccggaagacacggtcatcgacctgaagaaggcccatgatgtgcaggacgacaagctcgtctacatgtgcaccggttcccaaggcgagccgatggccgcgcttggccgtatcgccgacggcaatcatcgcgacatcaccatcaacgaattcgacacggtcattcttgcgagctccctgattccgggcaacgagcatggcgtgtacaagatcatcaacaagctggtgcagcttggcgctcgtgtggtcaatcgagacaatgccgccgtgcatgtgtccggccactgcaatgagggcgaactgctgtacatgtacaacatcgtcaagccgaagtgcgccatgccgatccacggcgagaaccgtcacttggtggccaacggcatgatcgcggtcaagacgggcgtcgatccgcagaatgtggtgcttgccgaagacggcgatgtggtcgatttgtaccacggccaagctgctgttgtcggttccgtgccatgcggctacgtgtacgtcgatggcgattccgttggcgaacttaccgaggacgagcttgagaagcgtcgtattcttggcacggaaggtttcgtgtcgagcttcgtcgtcgtcgatacggaaacggctgacgttgtcgcaggtccgaagatctatctcaacgcggtggccgaagacgaaagcgaattcgacaaggttcgtcatcagatcgtcgagcaattgcaggatgcgatgatggctggcacgcacgatacatacaagttgcagcagatcatgcgtcgtacgttgggtagctgggtcgcacgtcagctgcatcgcaagccgatgatcgttccggtcgttgccgatatcgcacaggatgttgacgaagcgatgggattgaacgcagcgcaatgatgaatcgacagatagtcaatatttttcgcaatatcgccgattccagcgaaatcaatattggaataatattgaaatatcgacagatcgtcaataattgttgattacataatcaaaagaaggacggcgtaaccggcacaaccggttgcgccgtctcctattcaataaataggaatctcaacacaaataaggagtgacatgccaggagcaaatctcacccgaatcgaagcggaagaacgcaaaagcgttatcgcagcaccggttcattacacggtcaaacttgatctgacccgtggagccaagaatttcggttccgaaaccaccatcacgttcgacgccgagccgggagctaccagcttccttgacctgatcgccaccgaagtgagcgaaatcgtactcaacggcgaaactctcgatccggccgaagcgttcgccgacagccgtatcgaactgaagaacctcgaagcgcacaacgaagtgaccgtcaaggcactgtgccagtattccaacaccggtgaaggcctgcaccgtagcgtcgacccttccgacggcaacatctacctgtactctcagttcgaagtgccggatgcccgccgcgtgtatgccgtgttcgaccagcccgacatcaaggccgtgttcgatttctccgtgcttgcagccaagtcgtggatcgtcacctccaacatgcctgccgcatccgtgaccgacaatgaaaccgttaccgaagagggcacgctcggcacgcacgaagccgaaaccaccaagctgtgggtgttcgaatccacgccgaccatgagctcctacctcaccgccatctgcgcaggaccgtacgccgaatggcacaccgaatacgccaacgaagacggtcgcaccgtgccgatgtccatgtactgccgtcaggcgctcgccgaagcgttcgccaaggatgtcgactacctgttcgacatcaccaagaagggtttcgccttctatgcgaagacttggggcgtgccgtatccgtacgccaagtacgaccagatttacgtgccggaatacaacgccggcgctatggagaacatcggcatggtcaccatccgcgaccagtacgtgttcgaatcgaaggtcaccgatgcgtatgccgagcgccgtgtcgtcaccgtgctacacgagcttgcacacatgtggttcggcgattacgtgaccatgaagtggtggaacgacctgtggcttaacgagtctttcgctgagttcacatccacccttgccactgccgaagccacggaatggaaggacgcttgggccacgttcagctccggcgagaagagctgggcactgcgccaggatcagctgagcaccacccacccgatcgtcgcgccgatcaacgatctgaacgacacgtatgtcaacttcgacggcatcacctatgccaagggtgcttccgtgctgaagcagctcgtgttctatgtgggtcgtgagaagttcttcaagggcatcaacaactatttggacaagcatgcgtactccaacgctacgctcgccgatctgctggctgaactcgagttgacgtccggtcgcgatctcaaggcgtggagcgcccagtggcttgaacagtccggcatcaacaccatcgctaccgaagttgaggaaaacgaggatggtacgattcgccagcttgcgttgcgccagtccgcttcggctgaacatccggtgctgcgtgcacatcgtctagctgtcggcttctacaatgaggatccggagaccggcaagatcgtgcgtaccgaccagttcgaacttgatgttgacggcgaactgacgattgtcgaagcggctgccggcaaggcacgtccggcgctgattttggtgaatgacgacgatttgacatacacgaagctgcgcttcgatgagaagagcctcaagttcgctgcggagaacctgtatcgtttcgacgatgcgctggctcgttccgtgatttggcttgcattctgggatatgactcgtgacggcgaattgccggcaaagcagttcatcgaaacctctttggctgcgctcgccacggaacatgagtccaccacgttccgttacgctttggcgcaggttagcaccaccgcatggcattacaccgctccggccgaccgtgccgaagtggtggagcatgtggctgccgaactgttcaagctggctcaggctgccgaagccggttccgacgagcagttccagctgatcaccgcttacttgggttatggtgagccgggcgatgctgcgttcgaagcgaatgcgaagggtctgctcgatggttccgtgaagcttgacggcttggagattgacaataatttccgttggaccatcatcaacgcgttgagcacgattaacgccattggccagagcgacatcgacgcggaacttgccaagcgcgaaaccactgagaaccgtgagttcgcattgggtgcacgtgcggtcgcaggcattgcggaagccaaggaatgggcttggaacgaggctttgcacaacgacgagctgaccaacatgcagttggaatccgtggcccgcggcttcgcatccactccacgtgccgacttggctgaaccgtatgcggccaagtatttcgaggttgctgactggatttggaagaacaagaccttccacatggctgaggccctgctggaaggcctgtatccgagctatgccgatccggccacgctggtggatctcggtgatgcttggctggcttcgcatgcggacgccgacaacgcgttgcagcgtattgtgcgcggcaatgtcgaatcgtcgcaccgcacgctcaaggtgcgcgatttcaacgcgtccctctgatgccgttcctggcaccactacagtagctgtttttggcagctacttctgatatcacttgtgatattgcatcataagcccggactgacggcgtgacttatcccgctgccagtccgggcttgtttgcttctagacaagccatcccaaacaaagtcccataacggttatggacaatgggtctttcggacccataatgacccggccggtcggaatcggaggatggaagtgagatcgcaagaaacttgagattgcggaaatctcacgacgttgcatactgcggcttgcctgacatcgcatactgcagtatgcaggtatcgcaacatgctgttgactattttgttgaatggtgaacccgttgagtacgatggtgcacggcaatataacttgagatagcgaggacttgagactcatgccacgtatgttcggaacagacggtgttcgaggattggcgaatagggctttgaccgcacagcttgcgttggatttgggcgatgctgcggtgcgcgtgcttggcgatgatggagacaaaagcgaattcgacggtcgtcgccgtgcactggtcggccgcgatactcgcgtttccggcgattttcttgcagcggcactgtccgcaggcatgtccgcaggtggattcgacgtgatcgacgcgggcattattccaactccgggtgtcgcatacctgacttccgtgctgaacgtggaaatgggtgccgtgatctccgcatcccataaccccatgcccgacaacggcatcaaattcttcgcacgaggcggattcaaactgcctgacaccaaagaagacgaaatcgaaaacgtgctcggccaggattgggaacgcccgaccggtgcaggcgtgggacgtatcagccacgacacggcaaccgcaaccaacctgtatatcgaccatctggtatccacaatcgcccccatcgggcctgacaagtcccagccgacaccgttgaaaggcttgaaagtcgtggctgactgcgccaacggcgccacctccgtggtcgcgccggaagcgttgcgccgcgcaggagccgacgtgatcgtgatcaacgcttcgccagacggctacaacatcaacaagaacgccggatccacacaccccgaacagctgcaggccatggtcaaagcctccggagccgacttgggcgtggcattcgacggtgacgccgaccgttgccttgccgtagacggcgaaggcaatatggtcaacggcgatcagatcatgggtattcttgcacgtgccaagaaaaacgcgggcaaactcaaccacgacaccctcgtggtaacagtgatgagcaacctcggcctgaagctcgccctgcggtccatgggcatcaaaaccgtgcaaaccggcgtgggcgaccgttacgtgcttgaggaaatgctgcgcggcgactattcgctcggcggcgaacagtccggccacgtgatcaaccgcgaattcgccaccaccggcgacggtacactcaccgcactgaccttgtgcaacgaagtggtcaactccggcaagagtctcaaagaactcgcatccgacttcccgcaactgccgcaaaccctcatcaacgtgccaaacgtcgacaagctcgcagccaaaaccaacgccaaagtgcaggcggccgtcgaacgcgaagagaaaatgctcggcgacaccggccgcgtgctcttgcgtccctccggcaccgaaccgctcgtgcgcgtcatggctgaagcggaaacccagcagcaggccgacgaggtctgcgaccgtctcgctaaagtcgtggccgaagaactcgccttgtaatcacaccgccgatacacagtatttggcaatccaaaatcccgaaccaatccgcgaaggaaccccatgtttggacgtaactcgaaagtcaacctcgagctcaaccgcgaggtcgaaaaactcatcaaaaccggcggcaaggaacagctgcttcccatcgtgcaggcaggtgaaccggtactgcgccagcagaccgcagcctacgaaggccaactgagccgcaagacacttgacaagctcatcgaaaccatgcgcgtcaccatgatcgaagcgccgggcgtaggtctcgccgcaacccagatcggcctcggactggcgcttgccgtggtggaagaccatgtgcgcgacgacgatgacgatgacccgcgtgaagcggccgaattcccattccacgtcatcatcaaccccagctatgagccgatcggcaccgaaacccgcagcttctacgaaggctgcctgagcttcgacggctatcaggcggtacgcaagcgctggctcgacatcatcgcccgctggcaggatgaagatggcaaacagcatgaggaacatctgcacggctggccggcccgcatcttccagcacgaaaccgaccatctgagcggcgaactgtatatcgacaaggcggaaatccgcagcctcgccaccaacgagaatcttgaggatttctggtgcgacgatccggttcccaccgaagccgccgccgaactcggattcgaactgtaaaccaggagcgcacgccgcaaatcgcatacatgcgcggcgaaaaacgctgcggaatccgattgtcacggaatcctatcgttgcgcaatccgcggaatatcctgcagggggagaggcccacaggcctctccctttttgtcataccgtcattttttcgtcataccaccatgcgcataaccagtgcaacgcgcgcacgcatcacactccccacggcagacgcacgtatgagcgtaaccatgtttgcatttcgcggcattatcgacaatatcggcgttcgcgttgcgatggaatgatttcgtacgcgacgtcgtgctccgtctgcaacgcgcatgatcgtatcctgacgacgaatgcttggtgaacataatcgtttttcgtagcattgttctttctcttaccgaaaatcaacgaaataaaacgaacccaagataacctttcgaatctcaaaaaacttaagattgcgctatccgagaagcatcatggttttttgtacgcgccgacgtgtactgcgccccctctcggctaccatgcaaagtatgaacgaagcaaagacgggccgttcctggcttaccgaagccaaacaagacatcagccaatggtcggcatcgatgccgaaaaacgccgacaatgagcgcatcgactggcattgggtcatgtctctcgacttggaacgcggcatcggagccgccaaaagccaaggcatcgacctgatcgccgttctgaatgccgcgggtaccacgttttcgtcgacctcggagaaaacggatcccatgcaggattcggtactatccgtccaacagttgcataatctgctgaaaaaggatttagcggtccgtgaccggctcgaatccatcatcgcgcaatgcaataccaccttcatgacggatttcgaccgtctgatcgcttcataccgtttgcctcgcgcgctcgcctatgcgaaccgtaggttgtgcgacgaaattgccgtgttgcggcgcattggtgctgcgatgggattgtggacgattgccgaagagcggcgggagcgggtgatagtgcccgtgctgcagtctgttgccggagcggaaagcctcgtgaatcttaacgatattcaggatcgtaccgcgcagatcgtcaatggccgtgccgaacgtcgtgccgcggaacgtgaacagaagcgtgccagcgattacgccatgtcacgcgcgaatttgagcggggtgacgagtccgggaggctcgaaggtgttcgactatggttccctcggatccgctggcggttccgctgactcggcggaagccgcgcaggaccgacgtttggcggattacaaaaagtcggattggcgtgacgcctaccttcccggccgtgacgtcgacacggtgatgggcattgatatcgaaactacgggtacggatccggctcgcgtgtacatcatcgatgccggattcgaattcatgaacatgatctcgcctcgtcctgccggcgagcccgcgggctaccgctacgaacaggattattacgagaccggcgatgcatatggccaggcacgtctttccttcggcgttcccacgcagaatgcgctgcttggcaatcctctgattctcgaccttaccggtattgacgtgcgcgatcgcgccagcgcggactttcgtctgttcgacgaatggcccgaagctcagatcggattgctgcaacgactcgaacagcagccatatgttgcgcataacgcccggttcgagcatagctttttcatgctgaacgtcgccggatatgcggaaagctatcgtgccggcaatatcacgatcatcgacacattgccgatgagccgtcgttgggatgaggggtcgattcccgatgatgagcatccgcacggcaacaatacgttggatgcgtatgccaaacgtcagggcgcgttggatgcatccaaaagcgaacgacatcttggcttggaagatacgcacatcatgctggtcgccatgaagcatcatctgggtgtgctgcatgccgaggggcgcgggccgtggggcgccggtggcaggtccggcaatggtggcaagcgctgtggcaagcgctggtagacggagtcgctcgcaggttgtgtggcaaggcgtaagttggtcggacgaattgacgttgctggatgtgtgtcaggcgtagtcgtgttgtgtctgttcccgctggatgttttgcccgctgtttgtcttgtacctttctgtcattcgttcgtctcgtgtgcgacacgcccggatgttgacctgccgcgaggtatgttgaggtttttccagcgggattgtgctgtgaaatggtgctcatcactcgattttcctgcgatttcgacacgccgagagatacgttatttttcaacggtttacacggtgtttacggaaggtcgatttgcgtagatcggcaaggacgtgtaagtttacatctcgctgctcagcacggcggttccgctcctgaggttcgggacggtctgctggtgtggtggtggtttgagaactcaagagcgtatttgtactacttctttatagtcaatgattgccagttcatcgtccgctcgccacattgataggctccgccgtagatccagaccatgaccggcagcttttcggaggctaccatgctatccgcgccatatccgcgtaatgccggagtccaaatattcaggtagaggcaatcctcgctcatcggcacggccggatcagtgccccattcacgatcatagaaatcatcggaggcgcccggcgtcggctgcatcgcggtaggcccgaaatcgaaggcttgcagcacaccatcccatggcagggccggctgcggcgcacgccagcgcagaccgccgacgggaggctgggcgaacgggacccctcggaacacggtgatgccctgatcctcagccgccaagccttcgacagttccttgcgacactatgacctgtcgcttcattgctctctttccttcgtatccggcgtcgaatacgcaaagtcgtaaaaatcggcgattccaccggtctcttttgtcgaatacaggaacaatccgatacggcaacctgtgaaatgatccattttgaagaccatccggtgcgctgtccccaatggacaccattcggattccggcgtatccgcatcgcggtagaagaacgtcacttcatccttgcaatcggtgaaatcatataccgcgcgcaggcgcatgcaatccgcatccgccatgatttccgcatccgttacggctggactgtcccaatcatcgtcggagaagatggaatcgtcattcgccggcttgtattggacggtcagcatcgtgcggccgttccttcgcgtaagcgcgatgtaggaatagcatccttggaacgccgccaatccggcgaagtcgccatcatgcaatgtcgacgcgtcgacggtgacttcggccaccgtcaccggccccatcgtgcgctgcgtcagcgtattccatgcatgattgagattcgagctgatgcgtccggaatgcaggcggaatgctcccggacgttccgtcagtgaccagtattcgttatgtgggatgtgattgaactgccagtatggctgcagacagttggcatcgactccgccttcggcgttatgccgggctatgaattcgctgccgttgatgggcgtgacaggttcggcacagcttgcagccggcacgctgaccgactgcggcactttgccgttctcgccgacgacggggaatccgtcctcgccgaaccgcatcggcatcagtatcggcacgcgtcccacaccgccgcggtcctgcatcatgaatgcataccagtcgccgtccggagtgtccaccataccgccttgcgcgactccgtaaccgtggaaggacaggtcgtcttcgataatttcacgcacttcgaaagcgccatccaaggattcggccatcaagcaggcttctgttttgcccttgccttgcggaaagtgacaggtgaagacgtaatagcgtccatcatgcttgtacaggtgactgccctcataaccaaggtcagcctgcggatcgtcctgcacgatgacccggtcgagcccacccggcatcggcccgcttaattcaggattcaactccgtgatgcgcaatgtcgactgtccatgtacgacataggctcgatcatcgtcgtcaaagaacagtccgctgtcgtaatagaagccgtcaagctcacgctttcgccatgggccgcatggatcgtccgccgtcagcagatagctggcatgcgtatcgttggcggcgaacaacacataccaggtgccccgatggtaacgcagtgacggcgcccacatgcctcgaccgtaggcgttggcaccttcacattccaaacgttcttcaggggtatccgccacgatattcaatgcgtgcgcaatgaattcccaatgcactaggtcatagctgcgcagaatatcgcacccgggtgtgaaatgcatagtcgtagtggccatgtaatacacgcccccgacccggatgatgtctggatcaggaaaatccgtgtagaccataggattagttgaggtaatcatcattcataccgatactttccgctcaacgccagcatggcgaaagcatagaggaaattgtcatagtaacgacgcgtgccggttcgcatcggcgtattccacagcatgcgcacccattcacgggcattatgctccgcgtcgggctgggccgaatgcaccgccgcaagtgcgccttgcgcggtcgcggccaggaatccgaccggatgaagcacgacctcgtccacggcggtgccgtcgatggcgtagacgctagtacggtcgtgggtcaggaagaatcgctgcagcgcggcgacgcggtcgcacagcacttcctgcggaccgttccaggctgcatccagcccgatattcgccgcggtacggtaggcgtcggaatagaaatgccaatgattggactcgtcgacatgcggctttccgtcataatccgcgtattcagcgttcatgccggtccgctcgtcgcaggccgcctgcagatagcgacggcttgcggcggctgcctcatgccaaaatggacggtcttcttcgtcggcttcttcggcgaatacttcatagaagtgcggcagatggtaggacggatcgctccactcggtttccggaatgaacttgatgagcttgttgtcgggattccacatgggctcgccgtcgtagcgttcgcccttatgaacgcaatatctcaagatctcgcgtccccatgcggaatattcgtagatatcctcgccatcaccccagcgacgggaggcgaggaacagatccatcgcgaaatattcctcgccgtcaggtgcaggaccattcgagttcggcgtaccgtccggcgcgaccgaccatgcgaaataatgcgcatgatgaccgtcctccatgtacatgtgacgcattacccagccccacagcttgtcgaatacgtccttacggtcgtattgcagggcgatcatcatcgcatagctcataccctcggtacgtacatcgttgttgccggtgtccatcacataggcaagaccttcgtcgttctcccaatagaatttgttcggaccttcgaaaatttcatgccagacctgtgacacgcgcttatcgatggcgtcttgggcatatccgcactgtgcgaacatggactcgcccaatgtcttgctggtatcggttgcatttgtcatatcagttgttccattcccagattcggatgcgattctctccggagacaagaccattcaacgccccggccttgcgttccgttgccgtcaagtcttgttccagcaagtcggtgtccagcacatagtcactgccatcgggctgttcatagcgttcctccacgatgcgaggcacgccgagcatatcgctggtgacgacctgcatcctggtatcggcgacggcctgtggcacagtgcaccgcaggtacagtccatcgggttcttcgaccaatgtcaccggcatgggctcatcacacgcaacgctcgtggaggcggtgccgccgaagaacggggcgtcctcctgcatgcgctccgaatcgtcggctgtaccttcctgcttgttcagcccctgtgcgccggacagatagatgttgccgcccgcgtatagagactgcagaggattgcgctcgccaccaccctgcgaaggatctgcccacatggcccgctggcgttccaagtattcatgcatcgacatcgggcaatcgctgtaggcggacaaaccatattcaccgacagtcggtttcaccggttgcggcgcgaacatgttgttcagccaacgctcatcgccgccggacaccacagcgcacccggccacctcggtggtgtgcggatagtgatacggcgtggaacggtcggggacggtatgcggttcaatgccgccgcaaatcagattgttgacgaaggcaccaccttgcgaccagttctggaacatcaccggcgaggcgaaaacgttattgtccaccagatacggcccatgactcacttcaatcatgaggtcacggacgttatcgtggaacacattgcgcgtgatgcgcgtgccctgcgtctgccaatccatccacatgcccagcgagcagtcgtggatgttgttgttggcaatgaccgtatccaatgcggcatggaatttgatgccagcgacctcccatccgaagaattcacgcttcaacgcaatgtgatggacatggttatgctcgatacggcagaatgcgctgcccatatgtccgacgatggcattctgtccacactcgtagatgtcgttgttgcgtacgatatgaccgccgatcagccccttttcccagccgatgcgacgggccttgaacacggcctccaactggtactggtaaccggtcttacgctcggttttcgcccactcgttgtcgccggatgagatttccttgcccaatgacaccgcggagaatttggcgtcatgcagcacgttgtcttcgatgatccagccatacgaccagttcgggccgatcatgccccactgctgcgaggtaggcggcgcccaatctccagtggcctgcgccatttcaaagccacgcacggtgatgtagttgacatggttgcgggcagggaagaagcatgtgcgacgaacactgacctccaccagttcctcattcggatcggcaccttggaaattcgcccagatcgttgtggtgccggcattctcgtccacttcggcatgccatacataacgtgtacggtccacatccggcacagggcagggaatcttcaacgcgaaatcctcatccgtatcacgcggctgcggatcgtatacgccttccaacgtcgtcgattcgaagaaggaaacaccgttgagatacacatcgccaagatgtttgtccggatcctcgccgaacttgggcatttccagccagtcaccgaaaatcggggtcgcgaatggattgaaatccccgaacatcgtattatcaagcaccaccgtccacacatgcggatgatcggccaattccgtccagccctgcacgcattccgagcctttgataaccggccgtgcttcgccttcggctccgcagtaggtgatgcgctcatgttcactcagaccgccgcgtttcggatcgacttgttcgcggtatacgccttcatgcacgattaccgtatcacccggagaggccatctgcgcggccttggaaatcgtggcgaacggatgctccgcgtcgccgcacgcagcatcgctgccggttggtttgacatggtattcaaacttcattgctgaatctccttattcacacatgttcctaaaccgtgacagtaacgctccgccatggttcgcaccaaccccataccggtacgtcctgctcggattgcagcacacatccgtcatcgaaaatcttcggcatcgcaagcatcgttgctcttccttcttccatctttgacaagtccacataaagcctccatatacgattcatgacggcttgcatacgtcagtggcgacgaaaacacagctcccgtcgccaccaaaacacctactcgctatcaggcaattcccgataatcgaattcgctgaatttcgcaaccctgtcgtatccagaaagatcgattgcagccaaaccgacgaatgctccggtgaagaatccgccgtatcgacgcaggatatagtcgtccgacaggatcttcgcgtccagtttcacgcccaaatcgacccatgaagtcccatcaaacgaatattcatacgaataccactgcttgcgcaccttcgtgcgcagccacacggacttcacgtcatccggcactgctggagcggtatcccgcaggaacgacgtgtagttgttgaaatcgttctgagcgacctcaatcacgcggcattgccgccgctcgtcccaagtcacgaacacccacgaccagcataaatcatcgtagtagttcgtcaggccggccatctggcggtagttcttcggatcgaactcaacctttacggtcgcatcgaagttgaacgcctgccaacgacgtgccaccaacgacagatcgaaaaggttgcacagcgagccttggccacgcagttccaacacgccgccaccgaccttgcccatctcgccatcgaacggcacacgcagcgtattccaattcaaatccaacgtatcggacatgaaatcgtcatgctggctgtgatccgcaggtgcctcggtctcgatggcatccttcggagcatccacataacgctgtccgccatggcctccgacaatatacggccagccatcctcggtccatccgaccttctggatggaggtttcacgccccagcgtgcaccagccgcgcggatcagtgaaagattcattgtcgtgatgccacggacgaccgcacagcgaggcgtaataccattcgccggacggggtatcgaccagcgcgccatgcccctgcttttgcagataggaacgcggcgtgtcgaaattcgtgatgaacggattcgacggcatgccttcgaaggacaacgcgtccaaagtcttggatcgggccacgacttcctgatgcgtatacacggtaccgccttcagcggcgaacaggtagtaatagccattgatcttgtacagatgtggtccctcggtgagtttgacgtccgtaccgcgccaaatcgtacgttcagtttccggcttgagcttcatcgtcttcacatcgaattcggtcagtgtgatgccgtcgaagccatgatggtactcacgaaaatcccaagtctgctgcaccagatacttgcggccatcgtcgtcatggaacaggcttgcgtcgaagccgacaccgttcacacgaatcggctcgctccacggaccatggatactttcggcagtgaccaaatagttcgtgcaatccttgaacgcaccgttcacgaccttcacgtccgtgtagatcagccagaatttgccgtccgcataggaaagatccggagcccagatgccaccggatgacggattgccgcgcatgtcaagctggctcgtgcggctcagtggactcggcaacaggttccaatggaccatgtccttggactcgtgcagacggacacctgggaaccattcgaacgtggaattggcgatgtagtaggtatccccgacccgaatcatcgagggatcggcattgaatcccgggagaacggggtttgcgatttgcataaaatactcctttatatggaaccctcggccataggccgagggagttgcaagcaatcagatgatgatcagacgtattccatgcggcattactgacggctacgctcgtcacgaatcttcgcgaaatgcttctccggatcaggcgcggcattaagcaacactttcgtgtagtcttgctgcggattcaaaatcacatcatcagaaggaccatgttcaataatgtctccatgacacatcaccataatctcatccgaaaaatggcgagcagtcgccagatcatgggtaatgtacagcatgccgatgtgttcttcctgctgaattctagacagcaggttaagcacgcctaaccgcaaagaaacatccaacatcgaaacaggctcatccgcaattagaacctttggcttaggagccaatgcacgtgcaattgcgacgcgctgacgctgtccaccagacagctcatgagggcgtcgatacatgaaattgacggcaggcgttaattcaacacgttccagcagttcgataaccttctgctcatattcctcttggctatttgccatgtgattaatcataagaggacgaagaatatggtggaaaatcgtatgatatggattcaaggaagcgaacggatcctgaaataccatttgcacattatgacggtattcgtacaaatccttaccatgcgtagggacaggcttgccgtccaacgtgatgcttccagaagtcggcgtctccaaacatgtaatcattcgggcgattgtcgatttcccggaaccagactcaccaacaagagcaatggtcttatccgaagctaactcgaatgatgcatccttcaccgcatgaatcgtcgtggttttcaaaccattacgcagggtaaaatctttttttacatgctcaagcttcaatactgacatgattattcctttcacgcatggcgtggaacacgaacgaatgagccacgatctcctgtcaaagatgggaacgagctcagcaaccgttgtgtatacggatgcttcggattgaaatacacgtcttcagaaacgccttgttctacgatgacaccatctttcatcacagcaattttgtccgtgatctccaagagcatcggcaaatcatgcgtgataaaaataacagagaagcccttgtcacggcgcaattccgaaatttcctcgatgatttcacgctgtacaacaacgtccaacgccgtggtcggttcatccataataatcagctgcggctcaagagccaaagccatggcaatcatcacacgctgacgcatgccgccggaaagttcaaacgggtaagcagctagacgatttggatcaacatgcaccatctcaagcaaatgtgcgcaacggtcttgtcgttcgctcttcgccatatgaggacgatgagttttataaatatcggcaagttgcttaccaatcttagttacaggacttaatgaattcatggcgccctgaaacaccatggaggttttctcccaacggtattcacgcaatgaacgccccgacaaagcacggatatcaatatctttccctgacttatcatggaaaatcacagagccagagttaatcttacccggagctttcagcatttgattgatgctatacgccaatgtactcttgccgcaaccggattcaccagccaaaccaagcatctcaccgcgacgcaattcgaatgtagcgttctgcacggcgtgcaccggatcatccgtatcgtagataacgtcgaggttatcgaccgaaagcaggatatcagaattctgagtcgccatcgtgttcaccctttctttcccttgctgttcttggtaggcttacgcagtcgcggattgatgacttcatcgatggagaaattaatgaaggacaatccggcgccgatgatagcgatcatcagtcccggtggcaggaaccaccaccatgcgcccgtgttcagagcagaaccgttctgcgcgtaatacagcatggttcccagcgagaaggattgggtcgaccccaggccaatgaaggacaacgaagactcactcaggattgccataataacggagaacacaaactgcgatcccatcacaggcaacagattaggcagaatttcaacggtaatcacgcgccacggacgttcacctgcaatttttgcggcaagaacataatcacgcccacgcatcgacaatgtttgcgcccgcagtacacgggcaccgccagcccatgcggtgattgaaataacaatgaccaacatcatcgtgcccttggaaggcatcaatgcagaaatcacgatggtcagaggcaaccccggaatcaccagcatgatattggtaatcagagagaacaaatcatcccaaattccgccaatatatgtgcccaaaacaccgaaaatgaacgacatcgcagttgcaatcaagccaacagcaaagccaataatcagagagccacggacagaatagccaagctgagtgaaaacatcctgaccagactgcgtagtgcccaaccaatgctgggcagatggcgcagacaagccaatgtcattgatcttattaggatccttcgtgaagataggaacaataatggcgaacaaaaccattgcgatcacaatggttaatccagccgtcaattttgcagaacgctcaggaagaactcgcttgagagaatccaaagcggagcgacgacgtttagcttggctacgagccacagcagcagaagaatttgttgcagacatatttaacctcaatcctgttgccgcgtacgtggatcgataatgccgtaaagcaaatcaatgataaagttcacgactagaacagtaacggtaataatcaggaagataccttgcatcagcgcgtaatcgttactggtcaccgcttgcaaaagcatctgaccaacacctggataggagaacacctgttcagtaagcagcgatccacccaccactgcaccgatagacgtgccaaaaccagaaatggatggcaacactgcattacgagctgcgtagcacatcataatgcgtttaggacttaaacccttggcctcagcagtaacaatgtagtcctcagacaacgtggagaccatcatattacgcataccgacaacccccatgcccagagagctgacaagaatcgtcaaggccggcaagattgcataccgcactgcgctcgagaagaattcccaagtgaagccgggcacaacctcacgataattgtatccgcctgactgagggaaccaatgcagcgtacgggcaaacacccaaatgaagatgagtgcaagccagaagtaaggaacagcttggaaaatggtggacacaggggaaatgatgttatcaaaagcgccaccacgacgccaaccagcccagataccaagagcctgttgaataaagaacgatataatcgtggttgtgccgacaagacaaatggtccaaggcagtgcagaagcaatggacgttgtaacttggttggggaaatacgttacagatacgccccagttgccggtgaagatattcttcagataatcaatatactgctggaagatgttgcctccaccttgtcccagcattgcagtaatcgcttcccttgtttcgggtgcaacagtaccacctcgcgatgcaagcctggtaagaacagctgaaaccggatcacctggcatcagtcgcgggatggcaaagttcaatgtcaaagccgcaaacaatgcaacaaggtaaaatcctatctttttcaggtagaacctcatcgttacctcatttctacatggaaaaatggtgcacaaagcgcacatctaaaacgccttgtgcaccgttgattcataaaatccgtcaggttacttcttaaccttcaggttcttcaggacaatgcccaaatcaggatttgcccaagtctgcggattagcatagacgttatcgtttgtcggccaaccggtaaccttatcgctccacatttcgctcaaaccggattggcgcagaatcgggatatacggcatgtcctcaaacacctgagtctgaatcttctcatattcagacttcttggtcgccacatcagtggtggcactgatgacattaagagcatcatccacggtcttattgctgtagcgagcgtaattaggccaagcgcttttacccactgcagccgtactggcagtggcatagaactggttgtagaacatccatggttcggaacctgcgacccacagaccatagatggacatttcaaactggccctgctgcatcgcctgagtccattcattagaagacatttggtccgcatgcagatcaataccgatttttgccagctgctgcgaggcgacgttaatcgtgttgatccagtcagagacatcactcataacagcgactttgatgctcagcttaactccgtccttctgatagatgccgtcatcacccttcgtatagccggcgtcctccagtatcttgacggcttcatccgtacgtcctttacccggaataggtgaatccgggacgtcatccgaagcgtacttggtgaactgtccatacggatacagagaaccagccagctcactgtactggccattcagagcaagtttattaatctgatttcgatcaagagcgtaatagatagccttgcgcactgccggatcagtgataggaccactgcagccgagttctttgttcgaacaggtcatgaatgccatctgactagaaggaacgtcaaccgtctgaatatcaggatatcccgacagcacatcatccatattcgggaagatcgcagacatccagtccacatcgccagcggtcaaagcattttgagaagcttgggtgccaccggtgatcagaacataacggacgccatcaatttcaggcttaccttcatcccagtagtacggattcttcttaaacgtgtaagcggttggggaaaagttcccgcccttaactgtgaaaggcccagagccaacagcatctttattggtataggtcaccggatcatcgatcttttcccacacatgcttcgggacaatcatcgtgccggacagatacgacagagcattcaccgactcagaattgtccaaagtgatgcgaacttccgtatcgctaagggccttggcagagccagcaaagccaccggtattcaaagccttgttggagttaaggaggttgaatgtgtatgcaacgtcttcggcagtgtaaggttcgccatcagaccacttttcaccgtcacgaatcgttacatcaatagttttcgcatcgtcactgatagtgtaggatttacccattagcggttccagcttagtagggtcgtccttaaggttgttcatatagaacaatggctcgtacagagcaccgaccacaccggtcaaagctgtagaagagaacggattataattcaacgacgcctgcgaagttgaattcataacactgttgataatgactccgtccttcgcggtgctattagcacccccccccccgcacgcagccattgaaacggccgctacaccagcgcaaacagcagcaagcactcgcttccaagttcttgacttcatcatgtctttctcctttggcgacatatatgaacacacatcttcatgtttcgtaaatgctttagcatttcagtcaaagcactgtttgattatatagcttgactttcaagaaagtcaagtcacttaactaaatacttaaaatctttgttacgaaagttttatatgcaaatatttacgaaactttcgaatagatttaagtattccagggacgacgccctgcggcctagcctacgccgttcactttgccatcagcgacatcaacagctgcgcataaccataagacgcatgggcgttagactcccccctgactccgcagataaaaggcttctagcgattgccggaagcccttttgcatatcggcttagcgcgccaaacgttcagcagcggaagcgatcgcctcgtcgctggcggtggcggagaaacgcagacattccggcgcaccatagaactcgccggggctggcgacgatgccgatttcggcaagctggcgcagatcctcccagcagtcgccggacttggctttcacccacacgtacaacgcgccttgcggcatgtcggtgcagtatccgtatgcgcgcagagcactcaccagcatgcccagacgctcctgataacgggaatgctgggtcttgaccgcgtcgaagtcacgcagcccggcggccatcgcagcctgcaccggtccgggaatgatctgcccgatctgtttgcggtatgccgccatcggcccgatcagcgatcgatcgccagcgataagcgccgtacgatacccggccatgttgctttgcttgctcagcgagtacagcaccaatacgccttcggcggacccgccacacacatcggcgcgcaaggcgcacggcgtggaggcaagcgtatccgcatccacttccgcaacgtcgtcttcccattgcatcaacgcatagcattcatcggacagtaccacggcaccaatcgcgcgcgcgacacgcacaataccggccatctgttccgcggacagcacctcaccggtcggattgcacggcgaattgacccaaacggccttgacgcccggcacatccttccaggaatccgcatccgccacgtcgtcgaccttcagcgtttgcgcgccggccaactgcgtgccgatctcgtacgtcggatacgacaccttcggctgcacgacgacatcgccttcgccgaaatgcagcagcgacgccatcaacgcgacgccttccttggaaccgaccgtcggcaccgcatcggcgccgatcgcacgcaaatcgacattgcgggcggccgcgaaccactcgtgaatggcgtcacgcaaatcggcggtaccggccgtgacgggataaccgtacgcgttcgggtcgttcgacgagaccgcgagcgccttacgcaccgaatcgggaacggggtcgacgggagaaccgacggacaggtcgaccatgccaccgaacgcggctttcgccgtacgtttgtacgacgcgatgcgggaccagtcgtacggcgaagaaaactcatgaaagcccatcgtgaaaaccccttaataatcctctataaacaaaatatgcggcctcttccaacgggaaaaggccgctttcaaatgccaatcactgattttgcggcggcagggccgcgacctgctccggatccttgccgatcgggccggctgcggaagcgccgcccatatcgccgacttcagcgaagaagctgactgcggcatccttgtaccaggcccactcgtctggcagatcatcttcatagaagatggcttcagtcgggcacaccggttcgcatgcgccgcaatccacgcattcgttcggattgatgtacagggaacgggagccctcgtagatgcaatcgaccgggcattcgtccacgcaggccttgtctttgacatcgacgcacggctgagcgacaacgtatggcatggttacctccttaacacttaccgttcaagactactcttgattgccaacttccagctctcccgtaccaagtcgggcgtggcggtagccgtagccgaagtagatgcagaagccgaccgcaagccagaccacgaatcgaatccaggtgagcacgctcaggttgagcatgagccagatgttggcgagcgcgatgaggataggcacccatggattgccggggattttgaagactcgcttcaggtcggggcgcttcttgcgcatgatcggaatagagattgaaacaagggtgaatgccgacagcgtgccgatgttcaccatgtcggcaaggatactgacgttgcagctggctgcgatgagtgccatgaccacgccgacggcaatctgcagacgcactggagtgccgtgcttgcccgtgtgactgagcgagcgcggcagcaggccatctcggctcatggcgaacaccacgcgggtcaggccgagcagcagcaccatgaccacggtggccaggccgatcacaatgccaaaactgatgattttggcggcccagtcagcgccgaccatttcgaatgccgtggcaagcgacggatctttctgcttggcgaggtctttgtaggagaccatgccggtggtgacgatggcgacgagggtgtaaagcacgatgatcagtcccatgcccacgcctatacccagcggaacgttcttcttcggattgacggtttcttcggaagtggtggcgactacatcgaagccgaggaacgcgaagaacacgagcgcggctccggagatgatgccggcaatgccgtaaatgctgggggtcatgccggtggcccactgccataatggctgttccatggttgcggccaacccggatccggtggcggtcgccggttcgctcggtggaatgaatggggtgaagttctcggctttgacgtagaagaatccgacgattaccacgaatagcacgatggcgattttcagcatggtaagcgcgccgtcgacccgtgcgccgattttcgtgccgcacaccaagagtgccgtgaagaaagctacgacgatgattggcgcgaaatcgaaattgaatgatccgatggtgacgttggtattgatattccatccgacaagtcggaagaaatcgttgagatagacgccccaatatttggagacgacggagcctgccatcagcatttcaaggatcaaatcccagccgatcacccacgcgacgatctcaccgacggtggtgtaggtgaaggtgtaggcggatcccgcaaccggaatcatggacgcgaattcggcgtagcacattacggccgcaccgcataccacgccggcgatgaggaagctgatgatcacggccggacccgcatggaaggctgccgcctgcgcgccgatggaaaagatacccgcgccgacggccacggccacgcccataatggccaaatcccaccaggtcaggtctcgtttcagggagcgccccgactcctctgtttccgccagcgtctgctcgacggatttcttacgtaatacgttcattgcgtttcccttctcccttcgttcttacgtttacttaaggctcatgccgatgacgaccggttcgggaacgagacgaatgccgaatgcccgttcaacgccatcctgcacggttttggcaagttccgcgatatctgcagctgtggctccgccgcggttggtcaatgccagcgtatgcatggtcgaaagccccgctgcggcatttccgctggttttgtagcccttatggaatcccgcatgatcgataagccatgccgcggatgttttgacgcccggcgtgccatccggcaaggtcgcgtcgaatcgtggcgcgtcttcgggaagctttgccgcttgttctttggtgagaatcggattcatgaagaagctgccgcagctgtggcgattgtagtcgggttcatcgttgcctgtctgcgtgcgctgtgcgtcatgcgcgatggcgaccagttcgctctttttggtgcctcgcatggcttcggtcagatatcgatgggaatcttcaagcatgcctttggaggcgcgtactttcaacacggcgttgcgaatatccgcggtcgccatacggtcgcccacttccacgcccaatgctttggcgagctggccgtagccaactacgccggtttcgctgtgatgcagcgcgaaagtaacggacaacaccacgtagcgcggtgtcgggaagaagtcggccgcaggcgttgccggagcgctgtacatgctcgctttgagcgcgctcatgcgatagccgaaatgaagttcctgattggtgagctccttggtctgcttgtttttgcgatcccagacctccacgctttcgacgctggatgcgacttcctggccgtatgcgccgatattctgcacgaccgacgcgccgacagtgcctggaatgccggagagtccttccacgccctccaagccgaggttgacgcagtagtcgacgaaatcatcccaattgcaacccgcttcggcgttgacatgcacgattgtttcgccgttttcgacgggagccgcctcatcaagcacgcttacggcgtgtcgcgcgtcacgcaccacgacaccatcgaacggcgtgtcggccacgagcatattggatccgccgccgatcacgcacagcggcaatcctttggcgtcggcatcctcgacggcttcgataacgccgacacgcgaggtcggttcgataaaggatgcgattggtccacctacggcgatggtcgtgagatctgcgaaattggtcatgatgtttagcttagcgtgcggggaaggcagttggaaaggtgtcaagaaaaggttgaaagaaaacaaaaaacccgaccatattggtcgggtttcataaagctttgaactcgctcagcgggtctcgcgatgcacggtctgcttgccgcagcgggagcagaacttcttcagctcaagacgatccggcgtgttacggcggttcttcgtcgtgatgtagttacgctccttgcactcggtgcatgccagcgtgatgcccggacgaatgtcggcgctcttgcttgccatttaagttcacctcttgtggttcgttgctatgccgacgttccgtcgacctttgtagcgagaaagagactcgaactcttgaccttacgattatgagtcgtacgctctagccagctgagctatcccgccatgagagcctcgagtgagaatcggactcacgacctcttccttaccaaggaagtgctctaccactgagctatcgaggcgtggcggatagtggattcgaaccactgaagcacgaggcgactgatttacagtcagttccctttgaccgcttgggaaatccgccgtgctgcctgtttggttgaaccccaaccggcaacccgtttagtatgccacagatcatgcgattaacgcaaatacggcgtgtcgcggaagccaaaaagtctcaaaatcgttgaaattccaacgatttctcactatcagccacatgtcggtgtcaatcggagcaaatcctcccgaaaaaaattccaaaaagaaaaaacacgagtatttcttccgaaccttccctgcagaccatctgaacagcgacgccaacaccagcacgccaacgccaatgaacacggcatacatcggccgcgcacggcctattgcaggaaccccaagtgcttgaaatcaacaagaccccgccaacgcaacgattgttcaccaatcgttcgctgacggggtcttcaaacagctacgcgctacgctcagccgagaatggccagaatatcgcgggcggagacgatcaggtaatcctcaccctgatagtgcacctcggtgccgccatacttggagtacagcaccttgtcgccgaccttgacgtcgaccggaatgcgctcgccggcgtcgttgcgacggcccggaccgacagccaggacttcaccctgctgcggcttctccttggcattgtccggaatgaacagaccggatgcggtctgggtttcagcttccgcctgcttgacgatgatcttgtcttccaacggtgtgagtgagatcgacactgtggacctcctctttctaagagaaatcgttacttaccgcgccgggacccgctagcaagaggctgacgatcacttacggcgtcgtcctttcgcgctgaaacatatcctagcgcgattattagcactctgccaactcgagtgctaacgctgagagcaaaatatacgaaaaagcctgaaaccatgcggtttcaggctgatgttctttacgcttgttcgtatgtttcgtgcgtttcgtgcgttcgctttccctccgtcacgccccgcgacgggccatgatggacgccaaacccacgcccagggaatcggaggtgacgctgggagcctcaacgtcggcgctgacctcggagtcgtggaatcccacggtatccacgtcctgcagatgcacaccagcctccacacgggctgcggcctcgtcggaatccatgctgctgatcgcgtcggtcggcacaatcaacggctcgacattgtcggaaaccgtactcgcagtcggaggcacggccttggcgacctgacgagtggacttgatttccatgctttccggagcggctggcgcgatatcgttaccgctgcgtggcgatcccaacgagaacgaaatcagatcctgcgacgcgccggccacggcggacgaatccgcatcgcatgcatccacaccctcggttttggcgatttcatcacgctcatcgtggatggacagaccgttcttcttatccggcacgacttgcgcatccacaacgttcggttccgcagcggatttcgcttcggtttcctccttgcgtttgcttacaacaacatcacggtcggccttgccgcgatcgatcgcctgacggatctcaccttccggcataacatcggtcggcacctgagattcggcgatcctgcgaatttccgcaagctcctgctcccgcaaacgagcgcgctccgcctgctcttcctgggcgcgcttgcgctctgccgcagcacgcttcctcatcttggaacgatacttggcgactttccgctcccacgctgcggcctgcttggcggccctcacccccaaagcgagcactccagcaagcagcgacgcaggaatcaaagcaaacaacggactgaaatgcaacacaaacgcacacatcaacacgacgattgtgatcaccagcatcgagacaacaataatccgccttctgcggatcgcggcacgacgaagggcacggacatgcgcgatcctttcgtcggtcagcttgccctcatgcgtctcgttggactgcattattgcccctttcgcctttgcggcggtctcatcggagaatcgcgttccactgtcggcatccaccagatgcagcgacggcgaaaagcggtcctctcggtgctcgattacccgcttcatgcctttgaccgtccgtttgggcagccagaaaaccatgagaataatcacaatcgcaagcaccacaaccgtgcttaacgattcataacccataactcataagaataggtgacattccgacattctccggggtgcacgcccccgcgtgtcgaacatgtgcgcgaaagcgcgtgtcgaacctcgccaacggctcactcgcccatcaaccgtgcggtaaagccattcggtgcgtactccggcagcaacgcatacgattcatggtcacgccattgcccgttcacgaacatgtacgccttgcgcatcccctcataggatgcccccactttgagtgccaccttacgtgaacgttcgttttcgggaagcaagtcgatctccacacgatgcaattgcggcccggaagggtcgaacatcgcccaatcagccaatagcgtaacagccatcggcgcatatccacgccccgcacaccgctcatcgacccaatagccaaccacgccggtacgcatggcgccatagcagatggcccctaacgaaatctggccgacgatacgcccatgatgctcgatggcgaacaccactccggtgccgtttcgctcgttgcatcgcatcgcacgcacccactcgttgaacgacatcgacgcgccatgcaccggatccccggattcccaaggcttcaaccaatcgtcgttgcgccagcggacttcgttccattcgtcgcagtcgtcagtagtcagcggacgcaggattatgggaacgtgaagcccatgtgcctgaatgaaccgcggaacatcaatggcattgggatccgaacgcatcatgccccgtaaagatcgcaaaatcgtcacgccctcattctgccatacgcataacatttccgattgcgcgcaaccatcccgtggtacaacatgcggtatgaccacgaacatgcaagccgacgtcatggaaaacagcgtctgtgacgacgccgcgaaccaacgtgagctgaaaaagcaatggcgcgcacacgcaatcgcacgaagaaagcagaccagtaaggaggaacgactggaagccggccgtaagttggccgaacaggcgcggaaggcgaatctcattcattcgttcaccacggtggccgcattcgcgtccatgggcagcgaaatgtcgatgatgccgatgctgcaggcattattcgattcgaattgccacgtgctggtgccacggctcggatccggcatggatattggctggagcgaacttggcgacattcacgatctgcaggaccagaccaacagcgacgggtccatcaatacgcaccgcccgcaagagccgggcaatagcgcaaacggacctgaagcgctgaaaaacgccggtctgatcattgttcccgcccttgccgtcgaccaagagggattccgtctgggacgtggcggagggtggtatgaccgcgcgctcgagtatcgtgcggccggcgcacgggtggtggcggtttgctggccgtgggagccgacggacaagcctgttccgcacgaagaccacgatattcccgtcgatggcgtgctcactccgaacggatttacggccatacgcgaataagatgtccgaagataagacgttcacgcagccgtctcagggaacgtactaggatatgtcccgttaagaaatttgagaacctggttgaagcgaggatactttgcctacttaccattaccgttgcaagaactgcaactacgatttcaccgaacagcagtcattcaccgacgatccgatcaccgtttgcccgaaatgcggcgaagagcaggtccgcaaggtgtattccgccccgccgatcgaattcaagggatctggtttctatcgcaccgacaagtccaagtgagcgaaaacgaatacacgtaaccgagcagccgaagcaaggaaacgagtcaaataaccagggtcagcaaaccttggaaaacaaggcgacacgccgaatcctgtggataactcgcatcctccgaccacaaccctcgatccggcttgcgcagcaactattcgtaaggtcatcatgcatgaatggtgaccttttttcatgaccttagccaacgtctgcaaggcacggacggcaaacacacgaaccgcgcaccgtcttcggcgcctcatcgacgacgacgaaacgcgcaattgcatcgtctacttgcttcgctgtgcgccggacttgccatattcgcggccctgcagtgcgtacgattgacgatttccacgcaatccgtcgtcattgcggcgaagtccatcgccaaaggcggcgtgatttccgcggattcgcttgctttgcgagatattccatacgatgaggccctgcgcagcgttgctcacgatatcgatgatgccgtcgggctgattgcccaagtgggtattgcggaaggcagcatcgtcacctcggccatggctcgcgcttcccccgttgttcccaaaggatatacggcggtcgaagttcggttggcgagttccgccgacagtctgacgattggcgatacggtgacgctttccagcgccacgatgttcagcgaggccacgccggaaacggtaccggatatggatgcggtgtcgttacgtgagctgtgcacgggagcgatattgaccgcgaaaccttcacggaatgcggacggcgacacgcttgcggtgtttgccatgcctcctcatgaggcggcaaccgtattgcaggcccaagaatacagcgcgatcatcgccatcgtcggttcgtaacggcattcccaagcgaatccgcagcaccatcatgcggaatatatgaaattcgggaggtctgaacgtatcagaacctcccgtatagcagacgaacgtcagcgctcccgctcggagaacacgccccaatgcggtggcagctcgcccagaatacgcttgtcgtcgtcagcattgcgctggcgttcggtaagcacatcggacggttcaagcttgacgccatcggcatcgaacagttccgtaccctgccgaaccacacgcttgtgtttgcgcgccgtacggcgggtggcggagtatccggacaccacacgcacggcagactggtcagattccgcggactcttggatggagggttcgtcgacgctcacttgacctcctgatacaggtcgctcaagcgtgccacgatgcgatccacttccttgtctggattcacgaacgcgccaacgctccacacggtcataacggaccagccaagcgattcgatgttctgcaaaagcacgcggtggcgttccctggtggactgcaatcccatgaactgcgcatcgtcggtaagcacggccaatgcgaacggcttgtcgttcaggccaaccaccagcggcagcttggaaccattgtcgaaaccgtagtcgacggccacattcaaaccgcgggcacgaatacggtcggcaagatcgttgagcaatacgttcgaaccgttcgtcttgacgactggacgcaccacgctgtcatcgagctgttccgcccagcgaagcaccgttttcagcatcttcggaccagcttggtgcaggcgctcgtcatccatgtcagctgacgagaatgcggacacgatgtcaagatgacgatccggcacggccaacgcatccagcaacataccccgtccgccttcggattccaacgctccaaactgttgcagcagccttccatgagaagtcttcgcgtagcacatcgcaagaatcgcatcggtggcatgcgcgccggccacatcggaaatgtccacgatgcgcacatgacgcaagaacatgcccatggccttgttcttattggcgatcgccttaagctcggctcccagtcgggtgcggaacgtatgggtcagcgtcaccacggtaagcatgtacgatgcaggcacgatcgtgaaaccggcggcacgcttggtgatcagcctgaccacctcgtcgatttcctgctggctgctttccaccagtccggacgtgatgaccggcacgccattggcatcggccacaaaatggtaggcgacctcgccctgcgcgccttccctggccacgtcgaagggcacggaaccgtagccttccgattccaggaacgcgttgagcttcggcgcgcggcgaacaggacgattggcgattttcacgctcggcagcaatgcgatgagacgcttcagaccgtcggaagtgacggtttcgcgatgcgcgatcaccaccacctgcttggctcggctgatgatgctgagcagttcgatggattgaatatgcgctgcggcatcgatgatcacgacgtcggccaatggcgccggatcggtgatggccgcaagcgtggcaggagtcgcaacgagaataggcttcgccgcggcgagaatctgcggatgctccttatgcaggcagttcagcgaaacattacgggcgccggcaagcgtggtatgcagcagattggcctcctgcgtacgcgagaacagcatgtcgcacagacggcgcatggattcctgcgccaccatcggaccgaccgaacgcacatgttccacatcgacctgggcgaaccgctccgcagcgccctgcaatgccgacccatcctgattggaaatgatcgcggaggatttcacgatgtcttcgaacgccgtggtccaccatgccagctgcagttcccctgcaacggcatcgttggcaacgccacgattgttcagatcttcgaccagctcgtcgaggccgaccgaatggaattcacgttccagacgggcgcgctcaggcagaatatcaagcgactgcttatcgtcatacagggccttcaaacgctcttcgacctgattgaaatcaacggtttcaagattgccgccctgcggagttgtggcaagcaccgcattcaacgcggtcatatcccgattgagattctcctgcgtttcgataatgtcatccagcttggcgggcaataccggccagccgccatgaggcacgaacatatgccactgatcggcctgcttggacaccaccagcaacgcctcatgcaggttctccacttgggcaccgacgcgcagcaaacccttggcttccttgatgtggcggcgacgctcccagaagcccatggacgtaccttcggccttgcgctcggccttcggcttggtcgcctcgatcatggatgcaatgtcacgttcgaaaatctccggctggaatacgtcaagcacacggcgcaggttcttcagcaccatgacctgacggctccactcctgcgcggtcgtgggaatcgggaatccgcaggtctgtaccgtactggccacctgctcgcgggtggcgggcaacaccttgcgcaacagctcaaccacacgctggtatgcgctcaccgcctcctcttcggaatacagcgatgccttataccatgcggtgtcgttctccgtaatggtgtattcgccaagctcgcccgcacgctgcagtttcgcagcccaatcctcgatcttgtccgcgatggaatgcgcggtctgcttgttcaaacgcacatgcgtggtcggatgggtgggcaatgccgcaatctgcgcgagattctgaatcgtctggtaggcggatacaccccactcctgactcacgccgtgaagatcgcccagataacgggtcaaacgcgaacgcacgccaaccagctcatcggcaatctgatcaaaacgggaggaagcaacccccgattggaagccgacggctgcaatcagctgacggtcaatcgcagcgttggcaccatcatcggcgatatccagcagctgtccgctcatttcgtttgcggcaacggcctgtacaaaacgacgcttctgatcggtcacacacggcacatagagcacagaccgtccgttcatcacgcaacgcgacgcaatcgccgcggcctgctcggcggtattgttggcgatcgcactatccacaaacagcgaatggcccgcggaagcaagctgcgaggcgtatcggacggtattgtccgcatcgccgacctcatactcgccatgaggatcggcatcaaacggactgtactccggaatttcggcaccttccaacgcttcggcggcggacttgtctcccgccaaagcgtccaaggcggtattgccggtcggaccttgcgccaactggtcgatgatcttccggctttccaccagcatctgcgatgccggatccataaagcatccgagaataatgtgccgttcgatctcaaaatcagggaacgcgttggccgcaaggcgtgtgatggcagcgaacaccgcggatgtttccggcgtgccgctttcgtaattcgaaccgtcgaacagcttggactcgtccaatacgacgttgttctcgcgcagcacggcggcgaaagccgcattcaagcgtacgcgccctgtgaacgcgatcaccgtaccgttttcaatattgcgtccttctttgcgcacctcaaccggatacatgagtaccggcatctggttgcccttccaaatggccacgccaaccaccaaagacagttcgcccacgccgctgacacggcttttcgcctcacgatcgtcgagcacacgctccacacgacgcccggcggcacgcaacatgccgttgtcgcggaacaaggaatcaagttgcacatgcccgctggcgaacagctgcgcgatgccggacggatgcgcatgcgtcatgtcaagctgggcgctcagctgcgtcacgtcctcaagcggcgacggcgatagaccaagacggtacttctcacgccacccccgaatacgatccagcgcggtgacggtctcgttgctttcgctcatgtattgactcacttccctaccgctttgcggtattccgcataccccggattatgtgacagggccgcgtcgatgtctgcattgcccaaagctcccagccatgcgtacaaatcgtcgtacagcgacgggttcatggcaaggaacggcagcagctccggatgacgtgccatctcgaactgcacggtgaaatcgtcggtgcgtttggcatcatccgacgtcagtccgtcgacttcaatggtctgttcctgcttggcaagctctcccttggcgactcgatcgaacaccgatccgggttcaaaagccggtttgaatacgctggtttcgtccggtgtcggctcgctcacaatctgtggctgctccgtgttatgcggcctgaaacgctcgtcgtcggcccgttgcgccgcttcttccggttgaatcggattggtaccggattgttctgcaatttcattgcgctgctcgtgcgttttttccgcttgttgttcaggcatgtcgctgctatccggcaatgccacgataatcggcttgcttggtcttgcgctgaatagtttgctcacgggaatcgtgtcgtgttcgacgtcgttgcctgcgatggcttgcgtccgcgattgggattcgggcagcatagccggcttttccttttcggcggcgttcttcttggccccttcttccgccgcctgctgttccgccacggcatctgcctcggctgcggcgtcggcgaagaggtcacgtggcgcgttatccacgacgtcgttatgctgcaccagcgaaacggatgggagatccccataatccggctcgttggatcgaactggcgcgaaagactgacgttcggagcgttgcatgagattcacacgattggcgacgttgcgcgcgttgaacaatgcggtcggctctccggcacgcagattgagaatgtcgtcgaccgacatatcggcggcgtcgggctcctgcgacgcctcatcggacactgcataggagaacagattagataccggagctgacgtggtactctcggattcgggcatggcgctcacgctgtcacgttcaaaagtgacgcgtacgtcgccgaattgcaaggtcattggcgtggatggcagtttgaaatcctcatccgcgggcagacgcatcaattggccgttgtcggccactacaaacgaaccattggtcgacttgagatcacgtacggaagcgttgccctgcgcgtcgactgaaacaatggcatgccgtttcgacatggatttgttcgtatccataatgtcaaggcgcgcgaatccgtcatccgccagaggacgtaacggcttgcggccgatttccacgctttcgccgctgcccagcttcttcagttcggttccatcaaccttgacggtccactgctgtgccgttcgttgatcttcgctcaccgttgtcggccttcctttcacacataccactacttgtcattgtgtcatgccttgccacgtatttcaggattatgacgcgattaattgacaactttcgcctaattcccccattgtatggcacgatatggaagcattcatgcctaaatcggattttattggatcgtcagcgaaagaaaatcccgtaatatgcggaaaaccccgccgccttgtggcgaacggggtttccactcaagattgtgatatgcggcttcaagccgcgcgaatcacttgagctcgacggtagcgccggcttcttcgagctgggacttagccttctcagcgtcttccttcttggccttctccaggacagccttcggagcgccgtcgaccagagccttggcctcagccagacccagggaggtgatagcgcggacggccttgatgacctggatcttcttgtcgccaacggcggagaggatgacgtcgaactcgtccttctcttcctcagccggagcagcagcgcccggagcggcaacggcgacagcagccggagcggcagcctcgacgtcgaacttctcttcgaaagccttgacgaactcggagagctcaaccagggtcatctcaccgaaagcttcgagcagctcatcgttggtgtacttagccataatggcttcctttcattcttggcgacggtttgattgaagaggtgaccgtcacctaaaacaattatttttcttttatggtcactatcattcacgcggctaaccgcaatgaaatcaggcagccttttcctgcttctcgcggagcgcatcgatcgtacgcacggccttggtcggcagagcgttgaacaggtacgcggccttggacatcgtagccttgatgtcgccggcgaactcggcgagcagctgcgggcgagacttgaggtctgccagcttctgggcaccttcagcatcgtagacggtgccatcagcgaagccgcccttgatgatcagtgccttattggtcttggcgaagtcacgcagggtcttcgcagcttcgatgaagtcacccttcacgaaggtcacagcggtcggaccggcgaggatctcatcgagaccttcgatgccagcttccttggctgcgatgcgaatcagcgtgttcttagccacagtgtaggaagtatcgcggcctagcttttcgcgcagttcagagatctgcggaacggtaagcccgcggtactcggtcaggtagatagcgtcagcttcacggaacttatccgtaagctgggcgaccaccgcttccttttcgggcctcttcatggcgttccttccttagtcaaccattgactgtgaagcaggaacgtttcgccggacaataaaaaagccctgcacgcaggcagagcaacattcgaccgctaagcggaaagcccttggtgggcgtatgttcttcaacctgcgttggcttggcgaaccaaacttcgtgagcgcttgcacgctccaaccaacggtctgtggtttacaggtgaacaacttacggtcatgcttggacttgccgtcatccgggcgtgtcgcgctttacgaaatcttcatgactcactcaagtgttacggttaagccttgttcggaatcccacgattccacaaggcgagtcgcaattctcgccggaacgcgccgcccaatagtcggaacgttcctaccaacccaagagaaatagagatagggaaaaatggaaaagttcttccatcttaaggagaacggcaccaccgtgtccactgaggtcatggccggtctgaccacgttcttcgcaatgtcgtacatcatcatcgtcaacccacagatactgtcgcaaacgggaatgccgtggggcggcgtgttccttgcaaccatcatcgcagccatcgcgggcacgctcgtcatgggcttgttcgccaacgttccgtatgctcaggccgccggcatgggcctcaacgcgttcttcacctacaccgtttgcttcagcctcggcttcacctggcagcagaccctgtgcatggtgttcctgtgtggcctgatcaacattctcatcaccgtcaccaagattcgtaagatcatcatccaagccattccggaagtgctgcagaacgccatcggcggcggcatcggcctgttcgtggcctacgtcggcttcctgaacgtcggcttcttcaccttcaccaccaaggccgacgccaagaacggcgacaccgtgcaggccaccccaggtctggccgtcatgaataatccgaccatctggctgttcatcatcggcctgttcctcgccatcatcctcaccgtgctcaaggtgcgcggcggcatgctgatcgccatcgcggtcaccgccatcgccggcattccgatgggtcagaccaccatggccaactccatctccatcggcgacactttcgcccagctgccgcagacctttggcgctatcttcagcgctgaaggcttcccatcgctgttctccgacatgtcgaagctgccgatcattctgctgacgatcttcgcattctccatgtccgacaccttcgacaccatcggcacgttcatcggcaccggccgccgcaccggcatcttctccgcggaagacgaggaagccctcgaaaacggttccggcttctcctccaagatggacaaggccctgttcgccgattcgatcgcaacttccatcggcgccatctgcggcacctccaacaccaccacgtatgtggaatcctccgcaggtatcgccgctggcggccgcaccggcctgacctccgtggtcgtggccatctgcttcgccctgtccgccttcctctccccggtcatctccgccattccgtccgccgcaaccgcaggcgtgctcgtggtggtgggctgcatgatggcgtcctcgctgaaggaaatcgactggggcgatatctccgaggccgtgccggcgttcttcgcttccgtattcatggcgttcagctactccatctcctacggcatcgccggcggcttcatcacctactgcctgatcaagacctgcaagggcaaggccaaggaagtgcacccggtgatctgggttgtgtcgctgctgttcattctggacttcatcatcaccgcgatcctgtagttctgaacgtcaggttcaacctgaccaccagccgaaattactggttcagtaaataaatttaaattcggcaaatgaaataggggcgattccgctctcaccgcggagtcgcccctattgttgtatcgcttgttttcgtactgctttttagtgaaccgtcttacgcgatgacttgcgagaaggcgtcaaccagactttccatccaggccgtcaaggaatcgtattgttccggcatctgttcggtcagttcaaccatgggcacgtttgcggatttcgcggcattcgtgattttgcccgtcagctcgctttcctcctgcgtattgacgaccaaaagcttgatttcacccgccttcagcgcatcggtgaactgtttgatatccgttggtgtcggctcgctttcgttcgctgtggctcgcgcgtacccgcttggcgttgcgtcggtcaaacccatgtcttccgccagatagcttgccacggattccgttgccgcgtacgccaatccgtccgatttctgtttcacttcggcgattttgctttcgacgttgttttcttcagatttccactgatcgtgcagcttgtcgaaatcactctttttcgcggcgtcggcctgttcgtacgcttcggtgatcgcctgtgccactgccttgcgcacatcggcggagaaccaaacatgcggattttcgccgtcattcaccccgccgactgcagcggcattgacgatagttgcgttggcggattgcgccgctttgaccgcccatgcgtcgtagccggctccattgacgatgatgacttgcgctttctgcagtttggcgatatccgacgtcgttggctcgtaatcatgcgcatccacattggtggaattgatgatgctggttacgttgacgttgccaccgcccaaggttttcgccacggtaccccactgattcacggaagcgaccacttcgatggttccgtttttttcggacgacgatcggccgcttccacacgcagcaaccgacgcaagcattcctacagaagcaagtgcggcaatcgcaattctcacaatacggtacatgatagatcctccctaacgtgatataacaccatcataacttaattgagaatcattatcaatagagcgtgtcgcgatcaggtatcacatacaaaaaactcccgctcaggggaacggccgccacgaatgggatcgaaatggttagcgaagcaaccactttcgaccgcacatccgtgcgacaatcccccgcaagcgggagtaagagatgatttgccgatcagccgcgtgcaattaaggagcttcgcaaagcgaaacataatttgctggctcgctaaagctcgcttgcgttgacccactgggtcaacgctacgctttggcggatcggcttttgccgatcagccaaagcgtcccgatacgtagcgctcggcttcttcgttctgggggttgttgaacatggtggtcgtgtcggtgaagtactcgaggtgacccggctggccgactgccttcaggttgaagaacgcggtgtagtcggcgatacgagcagcctgctgcatgttgtgcgtcacgatcacgatggtgtagtcgttcttgagctcgttgatcagatcctcgacagccaacgtcgaaatcgggtcaagagcggagcacggctcgtccatcagcagcacctgcgggtgcacggccacagcgcgggcgatgcacagacgctgctgctgaccaccggaaagaccaatgccaggattgtcaagacgatccttgacttcgttccacaggttggcgccacgcagagcccattcgaccagatcgtccgcatcggacttcgagatcttgcggttgttgagcctcacgccagcgagcacattctcgcggatggacatggtcgggaacgggttcgcacgctggaacaccatgccgacatcgcgacgcacggcaaccgggtcgatgtccttgtcgtacaggttcttgccttccagcaacacctcgccttcgcagtgagcgcccggaatgatctcgtgcatgcggtcgagcgtgcgcagcaccgtggacttgccacagccggaaggtccgatgaaagcggtgaccttgttggcttcgatgttgatgttcacatcttcaacggccaggaagtcgccgtagtagatgttcagatgattgacatcaatacgttgtcccattttggttccttatatgttgtttctgtatgtaagactaccgctcatcgttccgacttgacggcgaagaccttcgccacgagtcgaccgataaggttgaggataagcacgatgaggatcagcacgagagccgcggcccatgcgcgttccatcgggatggtggtcacgcaggaagcgtcggcggaagccgggcaattcgcgttgagcttggagtactcctggtagacgtacaccggaagggtggtcatctggccggagaagaggttgacgttcgtggaggcgatgtagcctgcggtcatcagcaacggagcggtctcaccaatcacacgggcgacggcgagaatcgcacccgaaacaatgcccggcaaagcggtacgcaacacaatcttcgtaatcgtgcgctgcttggtaacacccaaagcatacgacgcttcacgcaagtcgtgaggcacgatcttcaacatttcttcagaggacttgaccacggtcggcagcatcagcagcgacagtgccacggaaccttcgaaaccgttgatggtgccaggtccaatcagaatcgtgaacatcgagaatgcgaacaaacctgcgacgatggacggaataccgctcatcacgtcgaccagcagggtgatgacgcgagccagcttgccacggttggaatattccaccaagtacacggcgcacatcagaccgatcggaatggagatgatcatggcgccgaacgtgatttccagcgtaccgatgatggcgtgctgaatgccgccgtagccaccggacggcgtcggattgccgccgaccacaccggtcatgttatagctcaggaagttgaggttcagcctcttgacaccgttgacgatggtggtgagcagcaccgagaacagcggaatcagcgccacaatgaacgcaagagcgatcagtacgcgcatcgcaagatccttgcgcttacgtgcagcggtaaaggaacgcgtcggcttgaacttgtcgaaatcgatgacgggggcaccgtccatcggagaagcgttgttattcactgcggtcatcacgcactcgctttctcggtaagcttacgggcgatgaaattcaccacgaaagtaatgaggaacagcaccaggccggtgccgatcagcacggacacgccgagatcgttggcttcaggatactgcgcggcgatgttggctgcgatcgtctggttctgcgaagcctgcagcagcttgatggagtagttgagacctggagacaggatcatgagcacggccatggtttcgccaagcgcacgacccaagccaagcatggaagcggacaccacaccggacttgccgaacggcagcaccgcaagcttgaccatttcccacttggtggcgccaagagcaagcgcggcctcttcctgaaggcgcggagtctgcaggaagatatcgcgggacatggaggtgatgatcggcaggatcatgactgcgagcaccacggccacggtggcgacggtacgggaaggattggcggcaggacctgcgaacagcggaatccagccaagatacttggccacccaattccagaacgggtagatggcgggcaccagcaccaggccaccccacagaccgtagataacggacggaattgcggcgagcagatcgaccacatagctcaaggcggtggcgagcttcttcggcgcgtagtgcgagatgaacagtgcgatgccgaccgacacgaagaaggaaatcagcagtgccagcgcggagatcagcacggtgccgaacagcagcggtccgacgtagccccagaagctggaggccttgccgccggtgaagttgctgatggtgtcgctgttggcctgctgatcgccgccgatcaacggccatgcgcggaacagcaggaacagcgcgacggcggcgagcactacgaggatcagaatgccgcaggcgtaggccacgcccttgaacaccttatccgcgtttttgccgctcaccggctgctgtgccgttttgctttgcgaactcacgggttctccttaacttgcgattgtttgaaacagatctgcgattacttgcgatgactgcgttttttgttttacctgcaggtaccgtttcaggccgcacccgctttcatgttgcggctgcggcctgaaacagacggtcagttgccgttcaccgagagcctatcgcttactgtatcaaagctcacttggtttcgatggcgtcgatggacttgaggaccttctggcgcatggtgtcggacagcggagcggagcctgctgcggaggcagcggtctgctggccttcgtcgctgaccacgtaggtgagccaggacttgacgaacttggcggtgtcggcatccttgtatgccgggcaggcgatgtcgtaggagacaagcacgatcgggtaggcgccagcctcggtggtgttgtggtcgagcttgacgaccacacggttgtcgccagtggcggattcgtcgagcggggaagcgtccacaaccttggcagcggcttcagcggagaacggcacgtaatcgtcgccgaccttcactgcaacggtgccgagctcgccagcctgggaagcatcggcgtagccgatggtgccgtcagcctgctgcacggtggagatcacgccggaagtacccttagcgccctgaccaacctcgttcggccagttctcgccgagctcgtagctccaagcgtcgccagcagcatccttgacgtagctcaggaagttcttggtggtaccggacttgtcggagcggtgcaccacggtgatgtcgagatcaggcaggtcgaccttcgggttctgctgcttgatggcgtcatcgttccacttggtgatcttgccgtcgaagatcttggcgatggtgtcggcgtccatgttcagggtcttgcccttgccggaaatgccgttgaggttgaagaccacggcgatcggggagacgtagaccgggatgtcgaaggcgttgccggaagcgcacacgctcttggactgctcgacctcgtcattggacagggcggcatcggagccggcccatgcggtggcgccggtcagaaaggtggaaacgccagcgccggaaccagacgggttgtaggcgaccttggcatccgggttggtgccctggaagccggcgatccaggcttccacagcagtctgctgggaggaagcgccagcgccggagaagttgccggacacggcttcggtggtcttggtgtcggtgctagccgaagaatcagtgttggaagcagtgttgtcgccgcaagccgcgacagaagccagcatcacaatgccggacacagctgcaatggagcgtacgagaatggaattacgcattattcttttccctctgtcaacattctgatggcgtatgtttctgacatttcatatgctgttgtcgccatcgttcttcatgacactgtcaagcctattggtggtttgggtcccgcaaaaccaaaatcggtgaacggaagatgaacactctacgacacttcggacgttttcgtcatttccattcaccgatcttcggcgactaccgtgataccacggtcttacattcagttatcaattaataatcaattattcggaaacttacgatgattactggaatcgcagtgttttatcttatatatttccatctatcgcgatatttccgctttattccgcaggaacgtcaattttgtagcccaaaccgcgcacggtggtcagatatttcggatgcgccggatcctcctcgattttggagcggacacgcttgacgtgtacatccaacgttttggtgtcgccaacgtaatcggacccccaaatgcggtcgatcagctggtggcgggtcatcacacggcccttgttctgcatgagatattcgagaagctcgaattccttcagcgggaagaacacgttctctccgcgcaccatcacctcatgctggccgatcttcatggaaatgtcgccgcagatcagcggaatatcgtcatcggaggattccgtcgcgtcggccaccatctggttgcgtcgcagcaccgcacgcacccgcgccagcagctcgcggaacgagtacggcttggtgatgtagtcgtccgcgccgatttccaaaccgaccaccttgtcgatttccgcgcttttcgcggtgagcatgatgatcggcacgcggctttgctcacgaattctgcgacatagcgcggtgccgtcaagccctggcagcatcagatcgagcaacaccaaatcgatgccgcctttggtgaacagttccagcccttcctcgccggtggccgcggcggacacgtcgtagccttcgcgggtgagctggtagaccagcggctctcgatacgattcctcgtcctcgacgatcagaatacgtgtcatcagtgcttctcctccattgctctgttgatgggaacgttgcttgttatttgctgtattcggtttagctcagattattcggattactcggattgcgtagtttcgatgcgttcggtttcgcccgtcacttccatgcgatccgcttccgcagtttgtacgtttcccgcagtctctgcagtttccgctgtttccaccgcttgcgcctgaggcagggtgatggtgaaggtcgatccctccccctcacgcgaccacacggcgatagtgcctccgcaatcctgcacgcaatgtttggtgatggccaaacccaatcctgtaccccctgtttcgcgggaacgtgcgggatcgacacggtagaatcgctcgaaaatacgatccagcgaggattccggaatgccaatgccctgatcgacgacacgaatcgcaacctcgtcatcgccactgccgatgccgactgcgacggtggtgtgttccggagaatagttgacggcgttttccaccagattcttcaccgccgttttgatggtttcatgatcggcgttgatgaacagatcatcctcatcgacagcgtttacggcaccctcgacgtgcaccagcttctgcttgccattcagcgaaagcaccagattgatatgcttcgattcggccttcacctggttttcgacgatcgcctcgcgtaccaacgcaagcacggaaagccgttccgcgttcagcaccgcagccgcgctttgcgccttctgcaagtcgatcaagcgatgcaccaattccgtcaatcgttcggattccttggaaatgcggcccgcaaaatacttcaccatgccgggatcgtccgcagcgtcgccgatcgtttcggcaagcagggaaatcgcaccggcaggagtcttcaattcgtgcgaaacgttcgtcacaaaatcgcgtcgcataatctcaaaacgacgctgctcgctcatatccgaaatgaaaatcgcaaaaagatcatcggagatctggccgacccgcacatgcagatacagcgtgtcggaaggacggaacttacctgcctcaatgcctttgccgtcggtgtttttcgcggccgcacgggcggctcgatccagcggaatcgacaattcgcgttcgcgcaccacgctgtcggtcgacaccaatcgcagaatatcgcggatttcggcaagcgtcatcgcactgtcctcaacaatgccgaaacgttgcgcgcccggggaaacatatgtgaccgacgccagtgaatcgacgacgatcaacgcctccggcatgacggcgatcagctggcgttccgtggactgcacgggcacgcgcggcccgaacagcgacatgttcttctgcgcgccgaacaggcttggatcgttcgggtcgatctcatcctcccccaattgcacgccacgggcacgccccagcaaaaaggcgaccacagcgacggcaacaaccacaatcgccatcaccacgtgctccagcgtcatacgttaaccttccgataatccgtcattcttcttcaacagtagcggttccggaaagcgatttccgtgcgcgattccctcacgccatcggaagtttccccgcagttcactttcgtgagattcgccataccgaaatatgagacggcccgtccagcaaccgatgcgttggacgggccgtctttcatgcgcttacatgcgcttgacgatgttcaccgcgattttcgccgcggtgtcggcatattcggaaatgtcgaattccttgaattccacgtaatccgtgtcggcattgtcgctcaacgcgcggatgaccagcacgggcaggccgttgcgcgccgcgacatgcgccaccgcggcgccttccatttcgaccgcgtccgcgccggtttcgcgaatcacctgctccactttcttcggatcgtccacgaaatagttgcccgtggcgatgatgccggtgatgtgatgcacgctcagatcggtcagcaccttatcggcgacttcgatcagacggtcgtcggagtggaattcctccaccggctggtccgcagtgcctggcttccactggccgacgagacgcatgtcggtgtcgaggtagcgcaacgtgccgccaagcaccacgtcgttgatgtgcagatgcgtgttgagattgcctgcgatgccggagaagatcacggcgtcaggctggtccgcgtcgatgagatgctgcgtggtggcggcgatattgacggtgcccatgccgccgaccgttgccgcaacgttgacgcgagtgcccttgttggtttcgatggtgccgcgtgtcacgctgacgccggcttcctccgttacggtgatgtcgctcaatgcggatgcgatattggcgacttcctcgtccatggcgccgatgatggcgattgtgctcatgcgttcgttcctttcgattgcttcacgcttttcgctcggtttcgcttattttcgcttcgctcacttccagcggcgcttgcccacagcttgcgcaagttcgcgcagcaacgcttccgtaatctgccagctcaagcatttgtcggtgatggattgaccgtacgtgagttcggcgagcggtgccggtttttgactgccaccttcgatgaagctttccatcatgatgccggtgatgccttcctcaccttcggcgatacggcttgcgatattacgtaccacttcgacttggcgatgttcgtctttgccggaattgccgtgcgagcagtccacgatcagaccgtgtgccgccgcggattcgaccggcatttcctcacggatgagcttcatggcattcgccacggattcggcgtcatagttcgggccgctgctcgaaccacgcaataccacatggcagtcgggattgccgagcgttttgactacggccgcacgacccatatgatcgatgccgaagaacgtatgctgctgtgccgacgcaaaacacgagtcggtcggcgctttgatggaaccgtcggtagcgtttttgaagccgatcggcatcgacatgcccgaagcgagctggcggtgcacctggctttccgtattgcgagcgccgatcgcaccccagctgaccgcgtcggaaatgtattgcgggctggttggttccaggaattccgtggcggtggccaaacctgcgtccaatacgccaagcagcgtacgacgggccaaaagcaggccttttttgatattgcagctgccgtcgatgtcgggatcgttgatcaagcctttccaaccgaccgtcgtacgcggtttttcgaaatacacgcgcatcacaatcagcaattctccgcccagctcgtctttcaacgcggccaagcgacgggcgtaatcgagtgcggcagccggatcatgcacggaacacggaccgacgatcaccagcaatcgatcgtcctggccgtacaggcaggcacgaatctcatcgcgtgaataggcgacgatctcttgcgcctgatcgctgagcggcaggtcccccaacacctgcgccggcgtgggaagcacctcgaattcaagcaccctgcggttcacgatgcggctgatgccgacctgatcttcccagcgtggcacatccgtagccaccagcggattctttccctcatccatggcctcgcggatggcgcgaagctcttcaggcgtgttcagctgctgctgcatttcactgctctccttgacaatcacctatctccccaagaatatcaatcaaatggcagtcgctatgcaaaaaccgtgcgattacgcagttacgcgtattccgcacggttagttatttgcgattatttgcgcttatttggcgagtgcgcgacggctttcgaccgcatcggcaagcgtgtgcagcaactgttcggtacgttcccacggcacgcaggcgtcggtgatggacttgccgtactcgagctggtcgagcggagcgggcttctgattgccggctttcaggaagctttccatcatgatgccgctgatgcccgactctcccgttgcgatgcgggaggcgatgttttcgatcacttcggcttcgcgcacttcgtccttgccgcagttgccgtgcgccgcgtcgatgacaagaccgtgttcgctcgggccggacgccttggaaaccttcagatcggccaacgccttcgccacggaatcggtatcgtagttcgggccgtgcgaggagccgcgcaacaccagatggcaatcgggattgcccttggtttcggcggaaatcacacgaccgtcaagattgatggacagaaaatgatgctcgaaggcggccgcgaagcaggaatccgctgccggcttgatcgaaccgtcggtggcgttcttgaagccgattggcatcgacatgcccgacgcgagctcgcgatgcacctggctttcggtgttgcgagcgccgatcgcaccccagctaatcaggtcgcagatgtactgcggggtgatcggatccagccattccgtggctgccgggagtccaacgctcagcacgtcggtcaacaccttgcgtgcgagccacatgcccttgcgaatattgaactggccgtcgagatcgggatcgttgatcagacccttccaaccgatggtggtgcgtggcttttcgaaatacacgcgcatcacaatgaccagttggtcttccagttcttttttgaccgcggcgagttttgccgcgtattcgtgcgccgctttcggatcatgaatcgagcatgggccgacgatggcaagcagacgatcgtctttgccgttgagcacatcgcggatttcctgacgggacttcaacaccagatcgctcatctcgtcggtgagtggaatttccttcagaaaatatcggggagccggaatcgggtccaactgtcgaatattgacatccacggtctccggaaacacggcgttatccaacaactgcgcatccttcgaactatctggaccgcgaagacctgacatctcttctgctcctccttatacctgcatacctgcttcatgcatactgtgcatggatgataatcaccgaagttaccttaacggataaaagtggaataacacgaatgccgactgcatgctggactttttgcgaagtcccatgcagtcggcattcgtcaatcggtttgtcggtttacgtatcagtcagccagagcgcccatcggatcccatgcggggagcatggtggctggctcgtcaagagcggcctgatattcggcagggagcagcgccttcggcacggcgacctcgtacacgtattcggtgaaccagtcgtcgctcatagtgaagtagcccttgtctgcgatcttgtcgccccaagagttctccacacgccaacgacgggtggtcgtgccgtcttcggccacgtccacgccgacgaacgccatagcgtggttcatcgcggaatcggcgaaacgcacgcgatcttccttgttcagatcgaagtcgacgccatacaccttgccgtattcaaacagatcagtagcccaagcgccgttttcacgatccatcatcgggtggcagtcagcaccgaaccatactggaatgccctgctcttcgagaatctgacgcacgcaatccttcatgaactggttcggcacgttcaggtattcggtcgggtctcccccggccacattacccaagtgctcgataccgatcttcttgcccttcgcatgctcctgacgaggatcgtcgaccaggcacacgtagctttccaaatcagcggaaccgacgtacttctgccagaattccacaggcgtgacctcaccatcgcggtggaactcgccgtccttgtcggtccactcccagtcgaagctcttcggcggctcgcccaagtgaatcgtcagaatgcggtgtccggcggcggtcgcttcggcgattaccgattcgatcgaagccggatcagcatacatgtgcgcgacggccgtatgcagcaggcgacgcaattgcacgttcatttcgccggtgttcttggaagattcggtttccgggaacagatccttcggaacggcaccgtacttcttgtacacgttcatggccatggtccactggccgccgtcgcccatcacgtcggcgagcagatgctggatcaggcgggagtcggacggctcgccggccttcaccagttcggccacgtcctgcaggaagtagttgacgcgctcgagcttgtcgtagtacatggcatagttctgggagaactcgaattccttcagccccatgttcttcttggccacgaaacgagccacgttcagcgagctgaacagccagcaacggccggaacgatcctgatgggtggcggtgccattgtcgacaatggtggagaatcggcgctgcatcaggcgggcgcggtcatagttgcgtgccaccttgttgatgccagccgcggtgaccgcgttcatggccatacggttgtggtcgctggcttcgaaatcctcaaccagcgttgccaatgcatcagcgctcaacggcgtgatgtcagtcattgttctgttcctcctgtgcttcttcgccctggtcagactgctcgtcttcggacggttcttcaaaatcgtcattattctgctgttcgtcggagacaacatcctcgtcgaaggtcacttccggttcgcccgcaacagtttcgccactctcgtcgtgcgattccgccggagtttcagcttcagctgcggaatcatgctgttcgccgtcgatggaattgaccacggacaggccgttcgcgccgaaaccggagaacgcgttggcaaacatggcacgcagttcactgacacgctgcgtgatctgcgcctcacgggtctgcaggtcggcgatgcgctgctgcacaccttcaagctcgctcttggctgcctcacgacgctcgttgatctgctcgtcggcctcttcggtggcctgcttgagaatgctggcagcctgcttgtcggctgcctcacgcttgtcggaagcgtatgcctcggcctcatcgcgcgtatgctgcgcttctgaaatcagctcgtcggactgcttcttggcgatttcacggcgttcgttcaggtcggcgagcagctcgttgaccttcttcgtagcctcatcctgctgggcggaaatgtcggcgcggatctgctccacctcggcattgacctggctgatggtcttggtgcgatgcacttcggcctcgtcggtgatctcctgtgccttggctttggcggtatccgtgatttccgaggcacggcgctgcgcgtccgtcatcatcttggacacctgctcacgcacgtcggccagcttcttgttggcttcggccaacgcggattcgatctggtcgttggtctcgcttttcatgcggttgatctcgtcattggcgttcttgcgctgcgccgcgatctgctcggtggcttcggcgcgcagatcggagagctcgcgctcctgcgtggcgcgctccgatgcgagacgcttgtcatgctcctcacgggagttcgtcaattccagatcgacggtctggcgctgcgccaccacggccttctgcgcttcgccacgcagctggtccgcttcgcgctgggcgttggacttcaacgtgtcggcatcattattggccttcgacagcaccgcttcggccttggcgttggcctcgtcgagaatacgcttggcgtcgagcttggcgttgttcagcagggtttcggcctgaagctgcaccgtggcgcgtgccgcggaagcgtctttcttggcacggtcgagcagctcggcgctggtttgttccgcgctggcgagcatctgctgcgcgttggcgcccagagacgcgaacgaattcgggttggccttcttgtttttctcttcctgcagctgtgcctgcagttcaaggatggtctgatcgtcggccttgacctgatcacgcagacggtccaccgtctcctgagccaaagcgaacgcctcatcgaccctttccttgtcgtaccccctcaacacgattgggaactgctcaaccatggtattcctttcacgaattcccttccatcgcgcatcttgcccgcgcctatccgttttgaactttagcgcagaacaaacgttcggcacacggcagtcgcataattctcacagagagcacagaaatcgttcgaggaaacgccgacgccgttcagccgagcagaatctcacttgaggatggctgcagataataacgcaccgattcgcggatcacatcgttacctgcggcgatttgctgcgcgattgacagtccatgttgcggatgtggctgctcgttgacgatcggcaggcttacgaaacccgacagaatgcgcttttcctgcgctgcagaccagtcgagcaaatggtagaacagcgaattgcagacgaacgtgcccgcatccgaactcaacgcggcgggaatctcatgtttggcgaaatcgcgcagaatcgaacgcaacggcaggcgcgtccaatatgccgcaggcccttccggattgatcggacggcgaggcggaatcacattgtcggcgtcaggcttggccgcgtccatcagattcgtggcgcatcgctccaacagcacgccgcgggccgaacgcttcaaaccggtggcgatgacaatatcgggattcgcctgttcgatggcgttcagcaacatgggccaggcattggcgaaactgaccggaagcgtcaccgtcgtcacgctcatggaaacatcctgcagaagatcgtcggacagcgccacggattgagatggatcattccaatattcggcgagcgccacgggaacaagtacggccggattcacgtcgatgccgtcgtacggggtgaaacctgagatgacgatgttgatctgctgcatgtgttccagtgtacgtggttgaaagatgggttcgtttacgatcagtgcttatgcatttgcgagaatgcttcggcgaacaccgcgtgcatgcgcgctttcgcttcttgtttggcatgttccgggtcgagactgcgcgcgatgttctcggcgatcggcatgtcggcctgtgtggtgattttgagattcgtttcggatccggcgacgatggcgaccggctcgttcggcagatagtccaccaccacgcgggtgtcgtcggttgggtggaagtcgggatcggcggtggcgagctcgtaggctttggtgatggtaccgaaacggaaggcctgcggggtttgcgcgcggaatgcgttcgtacgatcaggcacggagcgcaccaccttgcgctctccaagatcttcggtcagtagaatcgtgtcagtggacgcgtatgccacggtcgccgcgttgaactggtcgaggctgtcgatgcagccgtcgatggattgctgttcgacgaacggtcgcacggaatcgtggatgaggattttcgcgccatcgggaatgcctgcctgcttgagcagatcaagcgcggagcgggtgctgtccacacgctcggagccacccggaatcacggcacgcaccttggtataaccggcttcgtcgatgagcatgttcaccatattgctgacacgctcgttgaccacgacgatgatgtcgctcacgcgatcgttgcgttcgaacgcctcgatgctccagcagacgattggcttatcccccaccgaaaccaactgcttgggattgttctcatcgaatcgcgtgccgaaaccggccgccaacaccacggccacaaccggcatcttctgttcctgcatctgctctctctcactcatacgtcccaccgtaaacccccgaatcggtttgcagcgcgttttgccttacgttctgcacgcaatccgcaatagcgcgccgctctcccactattcgcgcacgatcagcgcaagcatacgaccttcgtgcgctttgcctgcgatggtggcacggcgatgcgagaaccagagcggattttccagcgtgcacaggctacggcggattttcttgaaacgttccgcgagctgcggttcgccttcgccatcggcctggcagatttccgccaattcctcgtcttcggaaagatactgggtggctgcgttgacgcgggcgcgggaggaaacgacgttatcagccggaacaccagctttggcaagctcctgcagcgcggcggccgcaatatcgatgcccggctggccgaaacggctcagcgtgaaggttccggggaactgcgcgtcgaattcgtcggcaatgtctccgcccacctcgtagcagtcgccgcagatgcacgggcccagcgtggcgacaatacgctccggcctggctcccttggacaccatcttttcggtggtggcgccgatcacaccgttctgcaggccacgacggccgcaatgcgcggcgccgatcacgccagcttccggatcggccatgagcaccggcaggcagtcggccgcgaacatgccgagcgccacgttcttctgagcggtcacctggccgtccgcttcaaccactgccggctcatccgcggtttcgcccacctgctgagcggtttcgcccttgccgccagacacgtcgaaaccgaacggacggttcatggcgaacaattcgtccacatcgacggcaacgccggaatgcacctggctgaccaagctcagcttcgcgtcgatggcgttggagagcgccacacgattggcgagcacatggttcggatcatcgccggacttgcctccgagattgcagtgcgcataatcgccttcgctggtgccaccaagtcgcgtggtgtacacgactttgacgcccggcgcaagcatgatcggaatggtcaccgggattggattgccgtccacgtcggtcgggtcgatcgcattgctgtcaagaatcgcgtcgtcatactgcttgtcagtcattttttgttttccttgattgttctacgattatttcaacttatttctgctgattttctgcgtctacacgatgtttttcgcaattattccgctttgagcgtcggctttttggtacgagatcggatggctgcgttcacgggcacttcctgcgggcatggcatggagaagacatgcgccggattgttgatggattcgacccaatgtccgtcggcgtcacggaatccgcctgcgggaacggtgtaggcgagcggcgccgcgcccggtagcacgaattcgacttcctgaccggcttcgattttgttgcggctcataatggtcacacggccgccgtcttcttcgctccacgagagcacttcgccaaccaccagccaagcgcggaaatacgcggaacggtcggtgctttgctgcactttgtgttccggatagtagaagccggtggaatagtcgcggtgcgccaccttgtctggctcgtccagcaaccagtcaggcagggacacgtgttccgccgggcgcactccggcgtgataccagccttccggcaggatttccgcagccgtgttcgacttacgcctcgtactacgcgcatggtagctcagatcatccggttcgccggcggaagcgactggaacggttgcaatatccggcttccccgcgaacgcgccatccgcatgttccataatcaaatcggtggtttccggcttgccgtaatccggatcagacgggcgaatcacacggtcatggaatggcttcagcacagtgccatcctcgtcttcaaaaccgcgttgcaccatgtatgcgtcaacggcggtcttgtaagcgttcgtcatcgccgcaatatagtaggcgctcttggaacgtccttcgattttcagactggtcgcacccgaatcaagcagatcgtcgatatgcgcaagcatgttcatatcctgcgaattgaacagatacgcgccttccttagtctgttctatcggaaaatactggccggggcgcttttcttcgacgatggaatacttccagcggcacggttgagcgcattcgccatgattgccgtcacgtccggtcagataattggagaacagacaacgaccggagaacgccatgcacatcgcgccatgcacgaagcattcgatgtcaagatcgtcgggaatgcgtgcgcgaatgtctcgcacggcctgcagatccatttcacgggcaagcaccacacgacgtgcacccaactggtagaaggcgttcgctgcctgatagttggtgactcccgcctgcgtgctcacatgcagttccaggttcggcgccacttcgcgagccatgagcatcacgccaatgtcggaaacgatcagtgcgtccacgccggtgtctttgagctggccgatgtattcgcgcatcgcttcgacttcattgttgcgcggcaacacattgcaggtcacatacacgcgagcgccacgctcatgcgcgtaacgggagccttcttcgaaatcctccaaactcaggtttttcggcgccgaacgcatgccgaacgccttacctccgcagtagacggcgtccgcaccgtaatcgacggcggttttcagtcctcgcagattgcccgcgggagccaatacttcaggcttgtttcttctttgcacgcttgttcctcttactcgatttttccgctctatattctcgactattcacgggacacttctgccgcatccgggaaatacatacgaggaaaaacacatgcggaaaaacaaaggcgtccatcgtggagacggacgccttgacgcaaaacgttgcgaatctgacactcagccgagtttggcgagttcctcttcggtgagttcgagctcgtcggccttgagggaatcgagaatggtttccggtcgatgggcgccgggaatcacgaacatgtggtcgcccttggccagctcccatgcgagcaccacacgctggtagctcacgccacgggcttcggccacctcgcggaacggatcgaacaggtgctcgtcgtacgggtgacggtagccgcccaacggactccagcacacgaacgccagaccctgctcggcgcaatagtcaagcgtatcttgggtgtccagatgaatcggagaatactggttctgcacggccacaagcttgtcgccgaggatctcctgcgcgatcttcaactgttcgatgctcacgttggaaacacccgcccactgggccacgccctgatcgagcagcgccttgatgccttcgcaggactcgttgtacggcacttccggatcatgacggtgcaggtacagcagatcgatgctgtcaacgccaagcgccatcgcggactgcttgccgtattcgatcagatgctccggcttgccgtcacgcggccaaaccggcttgtcaccctcccaagcgcggcgcaagcccaccttggtggccacggtgacttcctcacgcgggcccttccacgagtcaagcgcctcacgcaccagcttttcgccggtctgttcctcttcgcccggcgtgtagtacgcccaagcggtgtcgatgtgacggcatccggcatccaacgaggcgtgcaatgtttcaataccgacatcgtgaccacgattgttttcaatggtcaacggcatttcaccatggccgatggccgtggtgcggaacggtccaagattacggaacaaagccatcccgatctccttcaacaacgtacagagtgtctttccgaatgcaaccttaccagccgacccgcctcagcagacaacaaacccaccaaacatgcgcgtaatgccgcagatcagcgaccaccgaagctgccgccgccggaaccaccggaggaaccgccgaaaccaccgccggagaagctaccaccggaaccaccgtaactgctggacggagatgccgcggcaatcgtcgattgaatatcagcaaaacctgattccaactgcgcgccaatatcaccaaaattggcgctcggcgagaaatccatcgaattcgtatcacacgaagcaggaccggcgtaatgatgattgaaataccatgaacggtaactccagtaaagcagcgaatcggaagcgttggcatcaagccaattcgggtcggcaagctgcgggtacgccttgagcagctgcttcatcgccttttcggaaatgccgaacgcggtggcgtacaccatgtagcgaccccacaacgtcagatcagccacaccacgatcacggaagtcgctgaaatcctccatataccgtttcaaaccgaccacctgaccggcaagacgctgaccattgtcgttaagccccttcaatttgaggtagctcagcgcaaacacggacgcgaacatcatcggcgcggaaatcagcacgcccaacgcaagattgccgatcacgccaaaatacactatggaaaggaacgccaggatcgcggcgcagatgcctgcggcgaacgctcccccgccgcatgacgaagtggcacccaacatggagaattcgctactgcacgcattcgtaaacttttcctgatacttgtagcccttcgaccaatcggagaaattcttgtccatctgtttcagatcgaacaccggagaaccaatgcgttcggacgccttcaccagcaggtcgagcgcggtacgttcgctctggctcagcgccaatgactgcgggttatcgaacaccaccggcagtatcacgatggtgctggttttgcctgcatcacgcgcacgagctggatcattggaaatcagctgcgcgatatcggcattgcgagaccgactcatatcaatgccccgatacatggcggccggccccgggtaaatggcgattgctccacgcgaagcgagcgagagcacggaagccgacatttttcggctcgacagtgttttcgaatgcttgttgtcaacgatatgcagcagttccgcagcgctggcggggctcatttccggctcgtcacgccaatactcgatgtcaccgtggtattgcgaacgatcgaaactgtgcaatgcgagcacaacggcgatcacacacaagatcagcccggccacggcaatggcgatccacgtgatcaggcggatacgcgcttttgtgcgctgccggtcacgccactgctgctcctgttgggcctcgctttccataatgccgtttttgatggtggtatcacgagtgcgtgccacaccgctggtcgcaccgacgtcgaacatggcgaccacgtcaacatagtcgccggcacgaacgtcgtgcacggtgaactgcaacgaccccttatcaccacgttcggtggttgacgtacgttcggtgtgcagccaggcccatgaattatccgccgtaatgccatccgggaacgtgacggttccggtgactttgccgatgggaatctgattgctcacgccgagcggctcccattggaacgtggccacgtcttgataggcggtggtcacgccctgcatggtcatggtcacatcgaatttcaggctgctcgccgacgtggtggcgggaatattccagccgatttcgattttcttggaacgatcgtcggtattgtcggcaacaagaccgtcttttgcgggatcgaacggctgcggattgctgtcaccttgcgaaacatcggcgatataccactgccccgcatgttctcgattccattcgtcggtgctatagctgcttgggattgcgatatcaccctgctggtaggtctctcccgtcgtcgcgttgcgcacgctgatatcggtgatattggccaggttgctttccttcagcgtgtactgctggtacagctgcttccacggatggtcgccgtcgtcatcgctgcggtcggcgagtttcatatcgatgtgttgggtgattttcaaatcgccattgctttgcacctgcacatcgtagtcgagcgttttgtagctcagatcggccctaccgtcatccaatgcgatggccagcaatatggccgctacaacgccaacggtgacgacgatcgcgataccgaagctgcgcaccgctcgcgacgcatgctgtttggccgtcataatccctctttctcgcttcttcttccctcagatggccgtacaacagatggccgtacaagccgaattgaacagtaaagccccatcgtcatcggacggggctttacatgcatgtcagaacttaacttgcggaacctgacgatccgcttcgtccacctggaagtagggggcctgttcgaaatggaacaagccggcgataatattggtcggcacaacctcggtctgggtattgtacttctgcacgacatcgttgtagaactggcgtgcgtaggcgatcttctcttccaacgattccagctgattctgcaaatccatgaaattcgtattggcctgcagctgcggatagttttcggatacggcctgcagattgacaagtgcgcggctcagctggttttccgcagcgatgcgctgcgccacgtcaccgctttgcgcggcctgcaccacgccggcacgggcctgcgtgacctgcgtgaacacttgggattcgtgggccgcataacctttgaccgtttccaccaggttcggaataagatcggtacgctgcttgagctgcacgtcgatctgcgcccaaccgttcttcacacgattacgtagcgtgaccagcccgttgtaggcgctgacggcccaaagcacaataagtacaacgatgacggcaatgataatgccaacgaccatgacgactccttcgttaatggctcttcacaccattcttgcatgcgcccaggtacgttatgacaaaactcatgcccccgtgtctcattttcatgcaatctgcatggaaacgcaaaagtgccccgtaccttccggtacagggcacttcagtcagtcagctatgctgcgagggatcctttttgaggcgtcagtcctcaaaaggatcaaagtcgcggcggacgcggcggcgaggacgctcggaacgctcttcgcgatcggcacggtactcgtcgtagttctcgtcggctgcgtaacgcggattgcggtcgtcgcggcggctgctgcgacgacggtcggaacgacgatcatcgcgatcgtagtcacggtcatcgcgatcggaacgacgacgacgcggacgatcatcataatcacgatcgtcacgatcggaacgacgatcatcacgatcgtagtcacggtcatcgcgatcggaacgacgacgacgcggacgatcatcgcgatcgtaatcgcggtcatcgtcacgatcggaacgacgacgacgcggacgatcatcataatcacgatcgtcacgatcggaacgacgatcatcacgacggccacggctgccgcgacggtcatcgcgatcggaacgctcacggcgcggagcggaggattcctgatcttcgaagcctggaatggccagggagatcttgccgcgatcgtcaacgccctgcacgactacctcaacggtgtcgccttccttgagcacgtcttcgacggcgtcgatacgctcgccgttggccagattacggatctgggagatgtgcaacaggccgtcggtgcccggggtcaggttcacgaaggcaccgaaggaggtggtcttcacaaccttgccgttgtaggtttcgccggcttcaggaacgtgcgggttggcgatctggtcgatgatctgcttggccttttcagcgccgtcgccaccttcggaggagatgaacacggtaccgtcatcttcgatggcgatctccgcaccggtctcttcctgaatctggttgatcatcttgcccttcggaccgatgacttcgccgatcttgtcgaccggaacggtggtggtgatgatgcgcggtgcgtacgggctcatctcggccggaccatcgatgcactcgttgatgacttcgagaatggtggtacgggcttccttggcctgctgcagagcagaggccagaatgtcagccggaatgccgtcgagcttggtatcgagctgcagagcggtgatgaactcggaagtaccggcaaccttgaagtccatatcgccgaaggcgtcttcggcgccgagaatatcggtcagggtcttgaagatgtgctggccgtcaacatcgccggacacgaggcccatggcgatgcccgcaaccggggccttcagcggcacgcctgcggcgagcagcgacagtgtggacgcgcacacggaacccatggaggtggaaccgttggaaccaatggcttcggagacctgacggatggcgtaagggaactcttcgcggttcggcagcaccggcacgagagccttctccgccagcgcaccgtggccgatttcgcggcgcttcggggagccgacgcggccggtttcaccggtggagtacggcggcatctcatagttgtgcatgtaacgcttggactgcggaccggacagtgcgtcgatctgctgttccatcttgagcatgttcagggtggtgacgcccagaatctgggtttcgccacgctggaacagtgcggaaccgtgcacgcgcggaacgatgtccacttcagcggacagggtgcggatgtcacgcaggccacggccatcgatgcggtaatcctgggtcaggatgcggcgacgcacgatctggcgctgcagctccttgaacgcattgccgatctccttttccttctcggcatcgtccatgtcggtgaattcaccggcgagcgtggccttgacgccctccttgatctcatggatgcgatcctggcgaggcagcttctcggcaatggagagggcttcgtcgagatcggcgtgggcgatctcatcgatacggttgtacagatcttcggtgtactccgggaagagctggaattccttggtttccttcgcagcgatcttcttgagttcggcctgagcctcgcagatcaccttgatgaacggcttggcggcttcgagaccaccggcgacgacttcctcgtccggcttggtctggccttcgtcgtagatgaggtgccaggcgttcttgcctgcgccggcttcgatcatggcgatggcgacgtcgccgttttcgacgacacggccggcaaccacgatttcgaacacggcgcgctcacgctcgctccaacgcgggaaagcgacccactggccgtcgatcagagccaggcgaacgccggaaaccgggccttcgaacggcagaccggaaatcatggtggaagcggaagcagcgttcagagcgataacatcgtaggcatcgtccgggttgacggcgagcacggtttccacaacctgcacttcgttgcgcagcgtgtgcgggaacagcgggcgcagcggacggtcgatgatacggcaagccagaatcgcctcggagctcggacggccttcacggcggaagaacgagcccggaatcttgccggcggcgtacatcttctcttccacgtccacggtcagcgggaagaagtcgtagttctccttcgggctggaaccggcggtggtggtcgacagaatcatcgaatcatcgtcaagataggcggcgacggcaccatccgcctgctgggcgagacgaccggtctcgaagcgcaacgtgcgcttgccaaatgaaccattatcgattacggcttcaacagccttgatttcgggaccctccatagggttcctcctttttcttttcttttaccaactatcggcagtcctcttcagcggactccaaccgatttctgcatgcgtgacgcgacgtcaccttcgtcgcttcctcatctttagattctagacctcatgcaccctaaaccttgggctttcaaactgtcttttcctcaacgcggctgtcatgcaaaaacgcccgaacgccaaggaaggcattcgggcggaagaatgtaactatcggcgcagacccagacgctcaatcagggagcggtaacggttgatgtcgacgcgcttgaggtaatcaagcatacgacgacgatcgccgaccatcagcagcagaccacgacgggagtggtgatcatgcttgtgctccttgaggtgctcggtcagatcagcgatacgcttggtcagcagagcaacctggacctccggggagccggtgtcaccctcgtgggtagcgtaagtcttgatgatttcctgcttttcctcagccgtaagtgccacggcatcctccttatattgctgcgcggtgctgccggcccaataccggcgcgctctctatccgcgggcgaaacacgccaaggggaaatcatacacgaagggcagaccaaatcgaatccacaacaaatggcggatcagaccacgttcagcagacctccgaacaacaccacggcgagcgcgatgatctcaatcgcgaagaacagcaggaacgatgcccaactgcgcgtcagcacattgaatttcgattcctttttgatgcataccagcaatccgacccagagcaccgcatagaaggcgacaccgcatccggctgcgataatgccaaggttcgccgcgttggccagccctgaggaatcgccgtacatcacgtaggtggcgttccaaaagttgaagctcagcagacatacgccggcgacgaactgttcggcggcgagtcccaccacgaaaaccgtgccccacagccatttcttcacatccgcaaccatcaatcccaaaccggccatcgccataatggtgaccgtccacgaaatcagcgccacgcctttgggatcgaggaagctgagattggccaccatccaagccgcatccttgactgcgatgacacgtccccaccagtaaggcgcgatcaaagccaccagcaccagcgcgatgaacagcgcccaatgccccggatgcgatttgcgccgttcgatatcggccaaggaaagatcggacgcctcaatggatgccgttggatgcttggaaacgtcgacctgttcgaccacgccgtcgacgacttccgtcaccttgttgccttgcgtttgtgccatacccgctccgttgtattgcgattgtcgcaccgctgtcacgacacgtccagcatacccagtcgtcgaagcaatcgtacggcaggtatgcaaaaggcgtgccgtcaagcacgcctttcttcttctctaacgattgtgtggagcggatgacgggaatcgaacccgcgtaatcagtttggaagactgaggctctaccattgagctacatccgcgtaccgtctatgccagccgaagccaacacgaaacgactcgagccattatacacactccctcaacaatcgcaagtcgaaatcgtaataattatttttcgaccacgcaaacctggtacggctccaacgcaacttcggcaggaagctcgatatcgcagtccgaatcaagacgcgcgatctgacgtgcggacgagaaattgaacaatcccaataccgtacgtccttcaacgtggcgcaccaccgcaagaaccgcatcattatgcgcatcccaagtagtgacccatgcttccggagcgaacgcgggatcgtcgcgcatctcacgaacgctcttcaaaccgtcccacatctgcttctgcagcgtgcccgcctgcttgcgcttggccgcattctcccaattgaaggggctgcgatgcagattgcgcgaatcctcgacgcgatcgggatcctccttgtattcccagccgttgagctgcacgatttcgtcgccgcagctcagcatggggaagccacgcaggaacgacatggcggaatgcatcatcagatcgcgtttcatcgaaatgtcgagcagcggcttgtcatgcgtgatcagcgcacgttccacaccgcacaggctggccgtggtgccgcagctgcgcgcgtccttcgatgcctcgtcgtagttgtacagctctcccatagcccagctgccaggcaccgatccctcgtagaagtggtacaggaattccttatgcttgagcgggtcgatgccgaggctctcctccaccggctcgtccaagccccagccgatgtcgtcatggcagcgcaggtagttgacgaaccagcagttctccggcagcgcgttaagcttgtcgagctggtctttgagcaggcgcacgtccccactggcaagcgcactccacagattcaccatgatcgacacgttgtaaagcatgtggcattccggcttttccggcgtgccgaagtaggcggcaagctccttgggggccatcaccacttcgcccttcagcactacggccgggcagacgcattcgagcacgatgcgcagcatacgcacgatggcgtgcacttgcggcagattgcggcagttggtgccgagttccttccagatgtaaggcaccgcgtcgatgcggaacacttcgacgccaagattggcgaggccaagcacactggagagcaccgacacgagcacgctcgggttgcggtagttcagatcccactggaacggatagaacgaggtgagcacccacttgtgcatctgctcgttccaagtgaagttgccgggcgcggtggccggaaagacttccggcaccacggcgtcatactggtcggggatggtgcggtcgtcgtggcagtagtagtagtcctgatatttcggatcgcccgcttgagcggctttggcccagcgatggctggatgcggtgtggttcatcacgaagtcgaggcacaggctgatgcccgccgcacgcagtttcttggtgagcgcggcgaggtcttcgttggtgccgagcgacgggtcgacggtgtcgaaatcctccactgcgtaaccgccgtcattctgcggatgcggcattttcagcagtggcatcaggtgcagataggtgagtttctgttccttcaggtacggcactttgtcggcgagtttcttcagatccccggcgaacagatcggtgtacatggtcataccgaacatgttgccgcgcttgtaccattccggatcggcgagacgcttggtgtcgagacgcttcagatcggcggggcgcgcatcgtgggctttggccatcagctcggtgaggttgcggaaggcttcgtcggcctgctccccatacagatccgtcaatagttcgcgcagttcctcactatattgtgcgacgcgctcgtcaaatgctttgtcggatttggaccgtgccattccttgactcctcttcccagggaacttcgttgttatgagttggattccgcagcgttcgttgccacgacgttggcaccagtgtagcgtgattttacggttttatcaaaccggttcgaggtgttgtcgcgattgacgtcaatcgattgacgcaatcacttgcggtcacgcttctatcgtcaccaccgcggatgcgacggatccgtcatgactcatggaaatatggattgcgcacgattgatcatccccatcaaccggcaatcccaacgattgccgcaacttgcgtcgcacctcgggcgagagcatgacacggggcacgccgtgggaatcgtcaagtatttcgatgcgcgcccaaggaaaatcgtcgagcgtgtacggataggcaatgtctccatcggcatttgccctgcgtgaaatcgcttcgcaccacgccttgagaaaagcctccttgcccgcccatcgggccgcaagatgcaccgcctcaccgtcccttttgacctgcacacgttgagcggtctgccatagctcgcgcatggagaacaggtttcgcatgcgcgaccccggttcgcccagttgctcggcgaacgcaggcacatccacgacgtcatgccctaaacccagcattttccagcctttcgaaagttttcaggaagaaacgaaccatgtcgacttccgcgaaacaggcgggcgacacttcgctttcatgcaaggacaccatcctacctaagcgcttcatcctctgccacccgcattgcgcgcccctcgtttcgcgtctgcacaagtgaaaatacgacaccaaacggaaatcgtgcagacggaaagtagagtgattcaagaatatgaaaatcccgtatctgccgcgaaatactgagattgcgacagatacgggattttgatgatcgtgcgtctgagcgccagaaatttcaggcgctcagacgcgggaatcaggcttcgaagtagccggaggcgcccaggcgcgcgttcgggtcgagcaacatggccttctccacctcgtgcgcgttgtagccgcggctatcctcatggaaacgacggttgtcgatcggctcgtagagcgcggcgcggcccatcatgccttcctcgaggcgacgctggccggcagccaaacgctcgttggcgcgatcacgccatgcattcagtgcctcgacgcccgcggtgttggccactgccgcttcgaacgcgcccggattgacgatcgcagcgaagccggacacgtggccgaaaccgagcgacgtggccaggcccgccttgacggagccgaccttcaacggttcgcgcagccagaccatgtggtcgtcgcgcatgagcttcggatcaacgcagtcaagggcggcattggccggaatcacgccggacttgaacagctgggtcagaccgttgacctggaagatgcaggcaccgcccttggcatgaccggtaagcgtcttctgcgagatcacgaacagcggattgccgtcggcgcggccaatggcgtgggccaacgtgttgtgcagttcggattcgttcggatcgttggcgttggtggacgtatcgtgcttggaaaccacggcgatgtcgtccggggtgacgccaagacgggccagatcgcgtaccagcttggaatccttgccgcccatgcccgctgcaagcgcacccaagcccggagccggaatggaagtgtgcgcgccgtcggcgtaggagtgcacgaatccgattacgccggcaaccggcaggccgagcttcaacgcgatatcgccacgggtcagcaggatggtgccgccgccctgggattccacgaatccgccacgacgacgatcgttggcacgggagaagaagcgcgcgtcgatgcccttggcgtacatttcctccgaattggcggtggcgttcatgttgccgaagccgatcacggattccacgccgatgtcgtcgatcgcaccggtgaccacgaagtcggccttgccgagcgcgatcttgtcggcaccctcttcaagggagacggcagccgtggcgcaggcggaaaccggctggaccatattgccgtagccgccgatgtaggactgcatcacgtgggctgcgacaacattcggcagagcctcctgcagaatgtcggtcggaatctcatggttgaggaagcgattcaagtacagcttgcgcatggacgccatgccaccgaaaccggtgccctgcgtggaggccaccatcgacggatgcaccgcctcgaggatttcggtcggcgtgaagcctgcggacaggtaggcgtcgaccgtagtaacgatgttccacaaggcgatcttgtcgacgtcgccgaccatggaagccggaatgccccacttgaccggatcgaagcccttcgggaactggccgccgaccgtacgggtcatggccgcgcgacgaggcacgcgaatcatggagccggcatggcgggtcacgttccattcgccggattccgcatcggccgcgaagctggtgtgcgcttcatcaagcttgacgtactcttcggcaatctcacgagtcggaaccgagaaggtcacatcgtggtcaaggaacacctcggcctcttcctcatcggtgccgtccttgtagtcgttgcccatgccttcgtcgaacggacgcacgccggaacgggccacgacctcgtcatggtaacgttccgcgatatcctcctcaggcacgaggttgccatcaacgtcgtaccagcccggcttgggactatcgttccacgtcagcaggcccatattccatgccagttcgagcaccgcgccggcagacagatccacctggccgtcggaatggatgccgagttcggcttcgaaacgggtgcggccggagccccatgggccaagttcacccacggacacgatgacgatttcgtcttccggacgtgcactgacgttctgccaatcggcaagatcgaccttggcctgacgcggagcacgcgggcttggcagcgccttgatgagcgtcttggccgcggtatcggattcgttgcttgcgattgcgttcttggcattcgccgcttccgcttgggccgcgtcttccatggcttccgcacgcagtgccttgatgtcgatcggctcgttgccgagtccgccggtcagatccacgtcgagcggggccttggctgcttcgatacgggattcgcgggtggaaaggttcagcagttctaccgcgatttcggcggtggaataggtcttcagaccgtgacgctccaccacttcgaccagcggatcattgccgcccatcaagcccgtgccgcgcacccagccgatcttcggatgggcgaaggtcacacggctcgaccacaccttttcggcgcgagcacggttcacaatcgcatcaaacgcgctcttcacttcgccgtaggcaccgtcgccgccgaaaataccgcggttcggcgatcccggcaacaccacatgcaacttatgctgcacatcggtgtcggcaccgatcttcgcaagtccggcaatcgcacgctcaacaccccacagcatgaggcgagcctgggattcgaacagttcgccggaatcggcgaggctgccatgcaccggcggagccgcgaacgggaagaacaggctcggctcgtaagcaggtttgagaatcgtggtggtcgcaccggaagtcttcttctgcacattgccgacccaagcgaccaacgcgtccacgtcacggtagcttgacaggttcgcaggaaccagccacaacttggcgtcaccggccgcatgctcacggtaggtctgcttggcccatgccttcacgcttggcttgaagctgtgcgaggtggccaccacggtagcaccgcctgcaagcaggccgttgaccacctgggctgcgatggagttcggagccacgcccgtcaccacggcgatatctccagcgaaacggctggtttccgccgattcggaagcgttttctcctgcttcggcagcgacacgattgaatgcggccttcagatccgcgttgtcgctcttgcctgcataccaggcggcttcgtcggcaatggtcttgccgagaccgatgaagctaccgttcaatgcggattcatcgttgttgtagtaggcgcgtgccagatcctcacgtgcggatgcccaacgatcgtcgaacagaatggccttgcgctcgtcgaaacgaggttcgacctgcttcggccagtcagcaccgagttcggcttcgaccgcagccacaacagccgcgttctcatcagcagtttcttcggcaaccggagcggcaacgcccagctggttcagcacgaacttcgccgtggaagcgagcacgccatcggcaccggtcaccttggccgcgaacgcgtccaaagcggcggaatcaaccacagccccgccagctgcgccaccagcgctcggcatggcaacggcgatgcccttgtcggcggcaaccttctgcacggccgcatcgatcagcgcgttggcagcggccgcattggaagcggcatccgtgctcaacgaggcaagatcaccgccacgagagctggtcccctcacgggtttcgagcacgagcgcagccaccacatgggaagcccacccttcaccaagctgccatgtatcggtcacacgcttggtgatctggccgagcttcacaccggcggcaccgaacatgccacgcacacggtcgcgcacgatgtcagacagcaccggaccgaacgccttgtagttcggagcgaccttgttgaccaaagcgctcagcgccttgaccgtcgcttcggcggcaccgtccacggaagccacgcccagttcggagctgatgtccataagcaactggttacggcgggaagacacgccattagtcagcgtatcggtggtatcgctttcgccgatctgatcggggcgaaccttggccgagtaagccagcaatgtggcgatcgcatcggatgccttgaatggaatatccgcaacggcggcaccagacggagcgccagcggaagctgcggcaaccggaacttccgcaacggctgcaggagccgccgcaggagctgaggcaacagccggagcagcagccgcagaagaagccgcagccgcaactgcagaatcgtcggcatcttcttccggaaccaacgaatcggaatcggtcatatatacgcggccctcatcgcgaccaacgttgtacaccgtcacatcgcgaccggcaaactgtggcagacgcaacgtcttggcaccaagattggcgagtgtcggagcattgccgagaccaacctcaacatactcttccacaccaagaccgccctgctcggcggaaccgaacagcagagcctgcgtctcaatccaacgcaccggggaggcgaactgccaagacagcagttccgtaagcagcaatcgaccgagcttctgatcatcagcagcataggaatcccaaatctgcggatcatccaaagcggcctgaatgcgctcggacggcacgacttcgagaatcttggccgcgaattccttcgtcatttcgaacggagccgcaaccaggttcggaatgtagcgtccgaccaagcgaccacggtaatcgatggtctgcggcaggagcgcgtcaagcttgtcgcggaattccggcacacccttgcgcaacagcgtggaatggaacggcacatcgatgcccggcaccagcatgaatgccggcttgccgccatattcggccacgcggcggtcggaatcggccttcagcgccttcagaccggcgatggtgcctgccacggcatactgctggccagccaggttgtagttcacgatctgcaggaactcgccggaagccttcgacacggattcgacgtattcgcgtacgccgtcgtcgcccacaccgaactggttcggacgcagcgcacccatgcggtagttggagcgacccttctcgtcacgcggaatgaggtggtgcatggtggaaccgcggtggaacacgagttcgatcacggtttccagcggaatcacgccggcgaaggagctcagggcgttgtattcgcccagcgagtggcccgcgaaataggccggccaaatgtcggcgccggcttcgcgcagacgtgcggtctgggcgaatgccacggtggcgagcgccacctgcgtgaactgggtcaggttgagcagtccttccggatggcggtaggtcacgccgttggcggtcagttccttcggattgtcacgcacgacggcgaggatcgagaatccaagcttctcgcaggtcaccttgtcggcacgctcccacacgtctcgtgcggccggggacttggcacgctcgtcgagcaccatgccctgctgctgtatgccctggcccgggtagacgaaggcggacttcggcgcacgtacgatggcggtgccacgagacacgatattgccgtcgatgcggctggtcacttcgagcaccatgccggagtgtgccacgcgtccgacacgctcgacggagatttccacttcgtcgtcgagctgcaccatgccgtacatgttgtaggtccagcctgcgatttcgtagtgcgcgcccttgccgtcaagcgcctgcaccgcgtattgcgcggttgcggagagccacatgccgtgcacgagcggtgccgcaagaccggaaacggcagcgccacgatgcgaggtgtggatcgggttgaaatcgccggaagtacgggcgaaggcggtcatctcgtgcggagcggtcaccttgacgcggcgcagcagtcggcgcggagtgctttcgatttccgcttcgattccgccgtagtccggcgcttccggcggcagtgcgtcggaatatgcgcggccacggatggcgaaacgctcggtttcgttggcaagcacggtgccgtcttgtgcgctgtgggtgacgtggatggtcaccacacggccggatgccgattcgaagtagttttcggcccagctggtcagtgcgatctgttcgccagtgtgcttgagcagctcgtcttcgctgacttccagttcgatgagatggtcgagatgcactgcgttgagcaggccttcgatcaccgggaagccgttgacgtatacggatccgagggccgcgtagatggcggtccatgccggtccgacgagtgcgtccggtgcgatgcgcgacggcaccagattgctcggcagcgcgccgccggtggccgcttcatggtcgaagccgaggttggcggacagcgtgtaactggtatgcgcctgtccgaacggataggcggctttgtctgccacctgctcaataacgggcatggcggtgagcttgtcgccggtgatggcggtattgccgatgcccgcggtgtcggcaagcatgcgatacacgtgttccggcaggcggtcgcggtcgaccaccgggaagagcccggattcgttgccgtccacgttcagcgggatgacgatgtcgcgtacggcgtgcttggatgcgccaccgtcaggatcgttgtcccagtaagtatcgagatgaatgtcgagatcgtacttttcgatgcttccttcgctggaaatcttgcggatttcgtagttggcgtcaccgttgctggtaccgtacgccgggtttgccatgagatggcccacccacgagatgttcggggatttgcgaatgaattcttctgcggaagatgccgcgccgagctgggcaaacgcggttttgtctgcgcttggcgattcggcggaaacgcgcttgaccatggcctcttcgaaacggccaagaatgtcggcgaccggttcgtcaacggtggtgatgcccgcaacggagatcggaccaggaataatacgcacggaatcggcggagtaacgggagtcttcggactgccacagctgatcctgaccccaccaacgcagcaggtcgttgtcgatgacgggcacgaacggcattggcttcgggtattcacgcacgagcaccgggaaccaagcttcatccatcggggtgacggtcagttcatcagcttgcggataggcttcggcaagcttggcgatggccgcatgcggatcggattccacatcggcacgggatgcgaacagcgatgcgaattcgccgctttccttcgtggtgacgcgggcttcgatacgctgtagcaagtgcaggaagcgatcggcataggtttcatctacccacgggaaagcgagatcggcgaaacgctgcgcccatgcgagataggtcatggccttcaggtcaccgaaatacggcttcgcggtggcgttcaacgcatcgatgatttcctcacggcggctttccagctcttccggatgcttcatcacgcgcaccagcaggcgtccgcaacgcgcggaagagttttccagctcgtacatatcggcatgcaggtggctcaggccggaggtgactccacccttggcttggccgctcggcacccactgttcgcccagcggagcgaacggatcgacgtcttctcccttggcgggaatgcctggggtgttgacgagcatctgcttgacttcagggctggtgtgcgcctctttggcggtcatcacggcggtgccgacaagcacgccgtccaccggcatgagcgggcgaccgtattcggcggaccattcgccggtgatgtagtcggctccgcgttccggcgtgccgatgccgccgccgaccacgagcaccagattggcctgttcacgcacttcggcataggtgctcagcagcagatcgtccaatgattcccacgaatggtgtccacctgcggaaccaccttcgacttcgatgagcaccttgaccggagcgacggccttggcgatgcgcaccacctggcgaatctggtcgacggtgcccggcttgaagctcacgtacgggaatccgtcggcgttgagagtgtggatgagttccacggcctcgtcaagttccggaatgcccgcggacacgaccacgccgtcgatcggggtgccgctggcacgcttcttcggcacgatgcgctgggatccgaactgcaggttccacaggtagcggtccatgaacatcgcgttgaattcaacggtacggccttcttcaagctcttcttccagcttggcgacatgacggtcgaacacgctggcggtcacctgaccgccgcctgcgagttccgcccagtaaccggcgttggcggccgccgccacgatttccggttccacggtggtcggggtcatgccggcgagcagcaccggcgctttgccggtcagttcggtgaatgcggtacgcaccttgtctccggcggaggtgtggatgatgcttggtgcgaagcgggtccagttctgggtgcgttcaggcagggtttccagcgtggagagttcgccgcgatcggccacggtggaggcttccaccacgccgacaccggtgccttgggcaacggtggagaacagcttgccaacggtggttcccgggccaaagtccaacacccacagggcgctcggatcggtggatttcatgagcgcacgcacgcgggcggcccaatccacatggttgagcagcacttcggcggcgagctcgcgagcgtggtcggcgttgattccgcaggattccgcccatgaaacagcctgtgaaacagcctcggccataagcgggctgtggaacggcagggtcacgtcaaggtattcgagcaccggttcgaacacgcgaccgccacgcaccttctcttcgcgcagcttggcctggtgcttgtgctccttggccacttccacgccgaacgcggccagatcctccgggtagccggagagcacataatgcgtggcggaattggtgactgccacggcgatcgggcctcgggcaccggaaacacgcttgatcagcgcatccacctgggcgcgggtgatgtccttgacagacagcatcggcgtggcttcgccgtgacgtgcggcaaggccaagctgacgcgcctgacgggtgccggcaacgccgatcagcgtggcaatcgcaagaatttcatcgatttgcgcggaagccgcctcaatggaacccgcttcgacgatcgcctgcaccatgtgcatggcgagcacgccttgggagtgaccgagcacggcaaccggcttggcaacggcgggattgtagccgagggaagcagcatcgagcagcgcacccaactgggcgagagcaatgcccggaacgctggcggaagccgctgcggcagcgccgagtcgtgccggattcggctcgaatccaaacaggtcgaccgggcgcccggtggtggcgagcaggtcggctgacaccgggtacagcagtgcctgggctgcgtcggcgtgggtatgcagggcttcgtcgagcaccggattggcgctttggtcggcgagcgtcaccggccatggggtggattggcctgcgaaggcgagtgcgtgcggctcgctgttcagtcggtcaagaaaaaaggtgttcatgatgttccttacttgtttcaaaaatcttgcgatgtgttcttgcgtttacgtttgcttacgattcatccgcgcacttcgcaccggtcacaacggctggttgccgtggtgtttggtggttttgcgcacgcgtttcttgctggagagcagtttgagcgattcgatgatggtttcgcgggtttgctcggggtcgatcatggcgtcgatttcgcccatttccagcgatagattcgcgttgacggtggtgcgttcgtagtcggccacgtatttggctcggagcgcttcgacgtctttgcctgcgtctttggctttctgcaggtctttgcggtggatgatgttcaccgctccggccgcgccgagcactgcgatttggctggatggccacgcgtagttgaggtcggctccgatggctttggatcccatcacgatataggctccgccgaaggctttgcgtaggatcacggtgaccagcggcacttgcgcgttggcgtaggcgtagatcactttcgcgccgcggcggatgatgcccgcatgttcctgttcggcgccaggcttgtatccgggggtgtccaccaaggtgacgaccggcaggttgaacgcgtcgcacagacgcacgaatcgtgccactttttcggaggaatccacgtcgaggatgcccgcgttgacgttcggctggtttgccacaatgccgaccggatgcccgttcacgcaggcgaatcccaccactgcggagcttgcgaacagctcgtgcacctgcacgaattcgccgtagtccacgatgcagcggatcacgtcgagcacgtcgtacggctggcggtcgttgtccggcacgatggtggcaagtcgcttggccacgtcacggtcggcgcgggttgcggcgtacgcgtaggtgggcggctgcaggtcggaattggacggcaggtaggcgagcacggttcgtgcgtagtcgatcgcgtcggcttcgtcttcgcccaggtagtgcgccacaccggaggtggcgttgtgcacgtatccgccgccgaggtcgtccatgctgatcacttcgcctgtggccgctttgaccacgtcaggaccggtgacgaacatgttggagttttcacgggtcatgatgatcagatcggtcagtgccgggcagtacacggctccacccgcgcatgggccgagaatcagcgagagctgcggcacgaaaccgctggcgtcgcaggttttacggaacagatgcccgtattgcgtcagcgcggccacgccctcttgaatgcgggcgccgcccgaatcgataagcgcgatgatcggcactttcaagtcgagcgctttgtccatcaatcggcagatcttgcggccttccgcgactcccagcgtgccgccgcgcacggaaaagtcctgtgcgtatacggccactttgcgtccgaacacttcgccgaaaccggtgatgaccgccgctcccgcgcgtccgccgttgatgtcgccgccgcagaatcgtccgatttcctcgaaggaaccggtgtcaagcagcaggtcaagacgttcgcgcgccgtcaacttgcctttgacatgctggcgattgcgggcatgatcttccgcttcgtgcgcgagttgcgccgcacgaagcacggatgcgcggattggctgggatgcgcccggcaggtcggccgcggagacggttgtggccgcggagacggcttcggccgcgtttttgccgagtcgctcctgctgttccattacgatcttcacggcttctttgacggccgggcttgcgatgatatcagtcatcacttacccccttccatagttccgtcggttgcggttccgtcaacagcagcgccagttgcgccgttttcgccggcttccgtaccacccgctccggtcacgtcgatggtcatcaatgtttcgccggcttccactcccgccgcgggtcccacgaaaatcttggtgacagctcccttgaccggcgcatacacgtagttctccatcttcatggattcgagtacgacgagcaggtcgcccttggccacctgctggccttcggccacgttgatgcgtgttacgacggcctgcatcgggcttgcgatcacgccggattggccgtcgttgctttgctgtttcttctgtgcatgatgcagtccctgcccgcgcagcggctggatggcgcgtttcgcgtcgcgtgctttggcaccgcctgtcaggttggcgacgatgtcgttcggcacggtcagcgacactctgcgattgttgacttcgatgacgaaggtttcgctggattccttcttgtcgacctcggaagcgccagacatggacgccggctgccctccttgcgatgatgcggcttccttgttgaggtacttgcgttccagccatttggtgctgacatcgtatgcaacaccatgttcggcggtgaattcgtcgtcgttgaaaatctgttcgaacaagcttgccggagtcggcacgccttccaccttcagctcgctcaaggcgcggcgcacgcgggccactgctgccgctcggtcagatgcggtgaccacaagtttgcccatcatcgaatcgaatttcggcgaaatggtgtcgccttcgaccacgccggaatccacacggatgcccgggccggacggccagcgcaacgaggccagcgtgccggagcttggcgcgaggttcttcgccggatcctcgcaggtcaggcgcagttcaaaactgtgtccacgaagcggatggttcacggtcagttccccaccgttggcgatggtcagctgctcgcgcaccaggtcaagtccgcagacctcctcgctgacggtatgctccacctgcagacgcggattgacttccaggaagtacactttgccctgttcggtcaccatgaattcgcaggtgccaagcccctcgtaatcgacggcttcgaacagtcggcgagagtaggtttccagctggtcggtcacctcggaggaaaggaacggtgccggcgcctcttcgacaagcttctgattgcggcgctgcacggagcagtcgcgcgtggaatacacggtgaagttgccgtgcgagtcgcgtccgcactgcgtttcgacgtgacgtcctttgtcgatgaatcgttccacgaaatattcgttcagatcaccgccctgcagcgcatcatgattcatgtagaaaccgcgcagctcgtcatcgttgtgcacgagcgtgatgccgcgaccgccgccgccatcggtacgcttaagcatgagcggataaccgtgcgtatgcgcgaaatccagcagcaatcgcatgtcggaaatcgactgggaaatgccgggaaccggcggaactttggcgaacgtggccacacgacgtgcggtgatcttatcccccaaatccacgagggctttcggattcggaccaacccaagccgcaccagcatcgatcactttctgcgcgaaagtggccacttcggaaaggaatccgtagcctggatgcactgcgtcggcaccgctgcgctgcagaatgtcgatcagcagatcctcgttgagataggtgtctttatacgtgtctccggaaagcagatatgcgtcgtcagccatctgcacgtattgtgcatggcgatcctgctccgcgtacaccgcaaccgtgggaatccccatctcacgggcggtgcgcactacgcgaagcgcgatttcgccgcgattcgccaccagaagtttgttgacatttttaggcataacgtcaagtttggtcgcgcgaacgaaaaatcgtgaactcgtttcccacaaaagacacgcaatctttttgtaaggctccacaaacgttaccgaaacttggcaagcctacgattgggggcataagttgacaaaccttgcattttcgtcactttcgcgcttgccatcatttcggctgtcaacaatcgtcgattcatcaacgtaatgcaatcacatccaaggagaattaccgtgcgtaacgcaatgctgacactcaagaccacgctgaaaaccgccaccagcggcactgtcggatccatcctcaagccggcgctgttcgccgtgctcatgtggaccgcctccgcggccggtgccgtgccgattccgggcacgccggtgccgatcacgctacagacgttcgtggtgatgctggccgcgctgatgctgccgtggaagcaggccggcgccgcgatgctcatgtatctggcagccggcgcggtcggtctgccggtattcgccggcggcgcttccaccatggcattggttggcccgagcgccggcttcctgatcggcttcctgccggcggccatcgtcacgtcgctgctgaagggtgaggcgcgcaccgattcgctgaagcatggcgcgctgaccgccgcacgttacctgtttgcctgtgtcgccggctgcattgcgcttgactatctgcttggtttcatcgtgcagtccgccattaccggcatcgcactgccgattgtggccgtggcttccatgggattcgtcgcaggcgatgcggtcaaggccgttatcgcttccgccgtggtcgcaggtcttgccaagctgaagtgagattgcggcaaatttcagcaatcaagtaattttttacttactgagcacgcctacgtcggccgtgctcacccgatgcaatacgccttcctgatcctcaatggtcagggaggcgtcgtcgtttaacgcgacagccctgccctgcaaagtggttccgtccacaaaatgagcctcgcactgcttgccgagcgtccagcagatcggggtcatcgcttcccgggcgcgcacagcctcacggtgagggtcctcttcgaaatcagccaaccgcgagcgcaatccttgcacccaacgtgcggcaatcgcatcgcgcaacaccatcgcatcaggcagattgcgcgcaaccaactgcaacgatgtggacttatctatcggcaatcgttcctgagcgacggcaagattcaaaccgacgccgatcacaatggcaacgcgatccccgcaatccggaatcggcaccatttcagcgagtacgccaccaagtttcttgccgcccgcaaaaatatcgttcggccatttcagcaaaacatcttcatcgagcgtgccgccgaaatcgcataccgcaccaacaatcgcctcacgcatctcgcaaccggcaatcatctgcagccaaccattgacggacgaatcgcgcacaatcgcaaccggcacgctcaccaccagcgacacgatgaatgactcccccggcacactggcccacgtatggtcgagccgcccgcgaccggccgtctgctcgttcgccgcgacaaccacgatctcacgcccgctccacacgaggttccctgcaatgccgtccatgccatccatgccgaacagccgacctgcacgcaccaaatccgcggcatacgtgttggtggatcccaccgtatccaaaacaagcacctgatccgccgcaacgcatgtacgcggcatgatcgcagccgaatccaaaatcgccatcattacctcctacctactacagcgcggcgcgccgacgcaatgtcgccgcaacgcaacagctcatgcagcagccaacgcagccgctactcgtcctgccgcacctggctggcctcatgcgcactggccacgttcgcgctggcagccgatcgcgcattacgcgactcgcgccagaattgcaggcatacgaaaccgaatacgaacgcgaccggtagcatatgccgttcgaaattgttggccggagcggtgatcatcacgcccatgagcagcagcaggggcagatgccatgacagcgagcgccatcgccgcaacaccacttcggcagcgccgaccagcagcatcagcgttacgtacagattgccgtgcgtcacccagccgatcacgggaatattgccccaacctttcgcgaagccggccaccgcatcgcgccaatcgtggttatacaggtggatccacgcattgtcgttctgcacgtaatcgttgttcacgtagtagtccatcgacacgtatggcaggtcggtcacgtcgaaatagccgaagcattcggcgaaaaacgcgtcgagcgcgataacaggatttgcgacaacgatttcaagccaggcctcgttgaagtttgtcatgtcgtcttcggtgacggtgcgccacttgtagctgactttcttcgattggatgccggaggatttcaccgggtcggcgtcctgccggaagtacgcttcggccatctggtcgaggttgaagaccggttcaagctttttcgccgcgtccgccggaatgcctttcggattgtatttggcgacgcgcgcgatctgctgcagttggatgccacggctttcgatggggtcgccgccgatgatggcgcccgtgttggtgaggaacacgatgccgccatgaatgaggatggttggcagcagaagtgccacaagataggttttccaacgtttgcgatcgttgataagtgccaggatcagggtgaagagaatgatgtaccacgcgtatttcgcgctgatcagcatcacgcagcttgagatggtgaaggccatgatcgagcgtttgcgtaggtacgtcggcttgccgttgatggtgggcagcgctttgatatgcgtcatgtgcagttcgtaccacacgccgaaccaccatacgaatgcgaaagcgaacagcggtgatttcgtcagggaaatcgtggcgaataccgcaagcgggcacaccatgaagaacagcagtatcatgaatcgtgttttcgcaccggcccgcagtctggaggggcgtgccacaacgcctgcttcaggatgcgcgtaatcgcgcatattccagcaatcgtggcgttccggatgcgagaagtcgaacgtgccgacgccaagcctgcgccacggcaggttgaagaaccggttggcggtggccgaacagcagaatgcggcgaacagccattgcaaggctgcgagcaccacgatgcccgcatcgttggagtcggtgaagtagcgcgaaaccgccgctgcggcaccgtagaacacggtgagcacgacattgtgctggtcggtcagatatgtgggattgtccggccacatgtaatgcgcggtcgggtaaatatccatgggcacgaacgagaagaagccgatatatggctgtttcaagcccgtccactggttcaaggcccagctgaattcacggatctgcgagcgaatgtcggcgccgaacgcggccaatagcgtggttggaatccacagccagccgattacgaacaccagcatgagtttccaccaacagtcggtgcagcgggtgagtttgcgccccgtccatacgatcactgcatgcagggcgcgccctgggcggctgtgcgcggcatcatgcaagtgtcgcaacataatgccaagcacggtggtcggcgttcctgcaatctcgttgcatagtttttcatgccgtcgtgcgaaatattgcggaagtacgcgacggccgcggccgaatctgaccaatgcgacgactatcgaaaaccatatcgcgaaagcgaccaccaaatacagcacattcagccagccgaagtcggaaagcccatcgccgaaccaatacaacggcccgatcgcgcaacaccatgccacccaaaggcatgccagcacggccagcatccagctgaggaatgtgccgatacgctcgctacgctttccagtttgtttgacttcgctcataagcggcataatagcggcactccccgaatgaacttcacctcgttgacgctttccgttcagcgattcgccagttgggcggctacacttgacgcttatgaactccgatcaggcagacattctcgaccttctggcagggcacaccgacgattcaaccatcgaacggctcgctttcgaatgcctgatgacttctcttacggatgatcgcgtcgcctcgttgatgaatgtgcttggttggcgtggggatttcgattgtttcgcgattggcggcacaccggaaacgagtcccgcttcggcttcgctcgttgcgcgtaaggcggtgcgcgatctgggcggagaacatgtgattgttggcacatacggcagttttctgctggcgcttgtctgtcagagtggcgccgccactgccgaagtgacctgcacgtcgattatgcccgctttcaaagatgacgaatcggtgtatttgagtccggtgcgttccggtgtcgccggcgcttcgcacgtgttgcgtgaaaccctgttttccttgcaggcggctcccgctttggcgtcgccgtcccgcccgttgcgtgccgatgagttgctgccggaacgggcgctgttgggcgatgattacgctcgtgaagagttgtatcagaacgtgtatcaggtgcttcatggcgagaatcccgacgatccgacgtttgtgacggtttccacgtttttgcgcaacggcagttcgttggaaaacacggcgaaggaattgaatgtgcatccgaatacggtgcgttatcgtttgaaacgtgccgcggaaacgaccggttgggatgcgaccgacccgcgtgacgcatacgtcttgacgacggcgcttgcgattggccgtatgcgcgaccgttgaaatcgtttttactgttctatttattttttttgaatatatctgatatctgacctgctcaaatttctttgatattcagatgattgcagaatcttttttacaaatgagatagataatcgcaagatatatgtgaaagacccgcatctgcgatgaggcaggatgcgggtcttttgcaagctatatagaagctatctgcaagctatattgctcaggcgatgaccgtcggatcaaccgggacgcccgggttcatcgtggaggtgatggtcgccttggtgacgtagcggcccttcacggtggacggcttcagacgcttgatttcgtcggcaacagccttgaagttctcgtcgagagcctgctcggtgaaggagagcttgccgatgaggaagctcaggttgccgttcttgtcaacacggaagtcgaccttgccgcccttgatgtccttgatggccttggtgacgtccatggtcacggtgccggtcttcgggttcggcatgaggccacgcggaccgagcacgcggccgaggcggccgaccttgcccatcatgtccggggtagccaccacggaatcgaagtcaaggaaaccgtcggcgaccttctgcacgagatcgtcgtcaccgacgatgtcggcgccagcctcgagagcctcggtggccttcgggccacgggcgaacacgagaaccttggcggtcttaccggtgccgttcggcaggttgacggaaccgcggaccagctggtcggccttgcgcggatccacgttcaggcgcagcacggcctcaacggtctgatcgaacttgtactccggcatgctcttgacgagagcgatggcttcgttggcggtgtaaaggttgttgcgatcgatcttttcagccgcttcgcgatacttcttggaacgctttaccatttgtccctctcctctcagtcggtaaccgtgatacccatcgagcgggcggtgccctcgatgatcttcatgccggcttcgacgtcgcgtgcggacagatcagccatcttgatttcggcgatctcacggacctgagccttggtgacggagccgaccttgtgggtcagcgggttttcggtacccttctggatgcccgcggccttcttcagcagagctgccgccggcggggtcttcagaatgaaggtgaaggaacgatcttcgaaaacggtgatctcaacagggatgacctggcccatcttgtcctgcgtggcagcgttgtactgcttgcagaagtccatgatgttcacgccatgggaacccagtgccgggcccagcggcggggccgggttggccttgccagcctgaatctggagcttgagaagcgccgagactttcttcttaggagccattgtatggttcttctttctgtagaagcggtggtagcggcaccggagtaggtctcccgcgtccggttccttccgcaacgtatattgctgtgctgtgctagcaggttccgcgccattcaggcacaataaaccctccagacacaagcttttccattatgcccactccgccagacaaaaaaagaccccgcaaacgcggggtctttcaaagacttatcaggccaatttctctacttggttgaagcccagctccactggcgtgtcgcgaccgaagatggacacgagcaccgtgagcttctgggtggtgggctcaacgtcggagacaacggcggccatggtggtgaacggaccatcggtgacggtgacctgatcgccaacggcgtaggagacttcgaggacgcgcttcttgttggcggctggcttgtcaccagccttcttgagcgcttcggaagcgatcatcggagccatcatggagacgacttccttgcggctcagcggcgccggttccttggtcggaccgacgaagccggtgacgccttcggtttcacgcacaatacgacgggcgttctcatccggaagcatgcgaatcagcacatagccgggaacacgcacgcgggtgatgaccttcttgcccttttcggtgtgcttttcgacttcttccatcggaacttcaatctggaagatcttatcttccatgccgaagcttgccacacgggattcaacgttggtcttcacgcgcttctcatagccagagtaggtgtgcagcacgtaccacttgccttcgagggtgcgcaggctgttggagaagtcttcgacggccttggcgccagcatccagctcttcgccgccctcgtcctccgcgggctcttcggaagcagcttcagcagtcggctcggcctcagcgacttccggaacgctttcaccctcggcctgcagcgcctcaacggcagctacggcctcgagatcagcttctggagcttcgtcgaggttgtcggaaaacacttcgtcagtcatgcagtttcaccttcaagtcgttgatcagccgaagatccacagggtcagcttgcccagaccgaagtccatgccggtgaccagtgccatcaggagcagcacgaagatgaacacggcgagtgcccagaagaacagctctttgctggtcggggtcacgaccttgcggagttcgtcgataatctgtttgatgaacaagccaagacgcatgaagatgttcggcttaacggccttttcgctattttttgccttcgccataataatcctccgctgagcttgttgtaagaagcttggcagggaaggcgggactcgaacccacaacctacggttttggagaccgttgcgctaccaattgcgccacttccctaggtgtactctgccgtttctacttgctggcgaggattttgtgcgaaaaaccacgcaagaagtaagcggcaaaaccgccaagtcgaaataatagcgggtatttgcgacttagtccaaccggtttttcaagaaatgtcccaaaaccgctatttttcaacgaaaaaaagattcgcacccggcatgtcaccgcggtgcgaatcgtgtgaaaagtctcagtcaggccagtatcagtcctcgacccactgcttcatacgcttcatgccctcaacgaggtcgtcatcggcaagcgcgtacgagaatcgcaagtagccgggagcgccgaacgcttcgcctggaacggccgccacatgaccttcgtcaagcagtgccgcagccagttcggacgtgctcgcataagcggttttgctggtgccgagcggcttgttcagcagtgcgctcacgtcggcgaacgcatagaatgcgccggtcggcgtcgggcagttcacaccttcgatatcgttcaacgcggcgacgatggtctgacggcgcctgtcgaacgcctcacgcatctcgtacacggcgtcaagagatccggacacggctgcgatcgcggcacgctgggagatattgttcacgttcgacgtcatatgcccctgcagcttggatgcggccttcgccacgtcgagcggagcgatcatccagccgacacgccagccgggcatagcgtaggttttggccacgccgttgagcaccagcagctgatcacgcacttcaggcactgcagcgccgatatacgtggtttttgcaccatcgtagttcagatgctcgtagatttcgtcggagatcacccacacatggtgttccacagcccattcgccgatcgccttgacggtttccggattccacacggcacccgtcggattgttcggcgtattcacgatgatggccttcgtacgttcggtacgtgccgcttccaggtcttccaagcttggctcgaaattgcggtcagctcccgcgaacacttcgacaggcacgcctccagccagtttcacggcttccggatagctcgtccaatacggcgtcggaatgatgacttcgtcgccgtcattgagcaggatttgaaaggattcgtatacggcctgcttgccgccattggtcacgatcacctgattcggatcgactccataccccgagtcgcgcaacgttttgtctgcgatcgccttgcgcaattccggcaaacctgccgtcggagtgtaacgatagttcttcggatcctgcaccgcttcggccgcagccgcgacgatcgcagccggagtcggaaagttcggttcgcccgcaccaaatccaatgacgtcgattccttcagctttcatcgctttcgctttggaatcaacggccagagtagcgctcggagccacgcggttaatacgttcggaaagagtctgccagtcagccatagtcatgtttgccatgctatccctcccgcccgaaaaacaacagccttttagcacattttggaattccttttccctgttgaccggtaggggcggcatattgctatttacagggcaccgaacaaaagagggaaagggattaaaccaagacgaggttgtcgcggtggactagggggtgggcgtattcttcgccgaggaaacgcttgagctgggcggtattgcggccgagcatttgcgggatttcttcggaatcgaatcctacgaggccttttgcgaggtgattgcccgcttcatcgtcgatccacaccgcgtctccggcggcaaaatcgccccgcacttcgagtacgccggcggcaagcaggctggcggcccctccgcgtaccgcattggaagcgccggcatcggccacgagcgtgccttgcgggtgtgctgcgaacccgatccataggcggcgtgatgatccacggtcgttgatgggggcgaatgcggtgccgactgggtcgcccatcatggccgggcctgcgtttgccgcgcaggtgagcactgcgggaatgccggagaccgccgcaacacgcgccgcttccattttggtgaccatgccgccggtacccacgtttgatccggtgccgccgacctgcactttggcgagcgcgtcctccacgttcggcacgtagctgatgcgtcgcgatccgggttcgcttgggggtgccgtgtagagcgcgtccacgtcggtgaggagcaccaaagcgtcggcgactacgatgttggcgatcaatgcggagagtcggtcgttgtctccgaaacggatttcgttggacgcgagggaatcgttttcgttgatgatcggcaccgcgccgaggtcgagcagccggtcgagggtgcgtcgcacgttgcggtattgctgtggggcgatggtgtcggacacggtgatgaggatttgcccgacgcgcagtccgtattgtgagaaagcgttctcgtattgggccatgagcaggccttgtccgacggccgcgcacgcctgctggtcagccacgtcggttgggcgtgagtcgaagccgagggagccgaatccggctgcgatggcgccggaggagacgagcaccacgcgcccgcccatgagtcgcacgcgtgcgagggccgccacgagcgcgttgagtcgttccggatcgaggtggccacttggtttggtcaacgagctggatcccactttcaccacgatggtttgcgcttcggcgatggcgcggcgcacttgggcttgcgatggcgtgttcatggttcctccaggcgttcgaatggccgaaaagaaaacccgccgacatgccaatcggcacatcagcgggcgttttgctgcttctattgttccacgttttcggaatcggtggtttcaccgcgtccgaagaggctggtttcgtcatggcggtcgtcgtccacggaaggatcggcccagtgtccggccttgcgttcggccatcatggcttcacgcacggcttggcgcgcatccatcatttcgtggtactggcgacggcgttccgcgttggtgcggcgctgcgaacggccgtcctgttcctgcagtcgcaggtcgacgcctcgtgcgccaagctgggcgccgtcgagcatttccgcgcccgcagcaatggtcggatcccaatcgaattccacggctcgcgcacccttgccgatgcgtacttcgtcgccaggcttggctcccttgttgcgcagctcgtcttcgacaccgagtttggcgaggcggtcggccaggtagccgactgcttcgtcgttgtcgaagttggtttgcatgacccaacgttccggcttggtgccgagcacttcgtaccagacgtcgccgttgccggcttccttgcgttccacggtgaagtcaagcgcggtgccgccttcgtcgttgcggcgacggcggttgcgcggctcttcgagcggcttgatgaccacgcgcgcttcttcttcggcctgttcgcgttcggcgacttccttgcgcatgtcggcgaccatggccgccaacgcccagttgagttccttcaaaccttcgtgggatgcggtggagatgacatacacattgagaccgagtttttcgaattccggtttgacgaattcggccaattccttggcttccggcatatcgaccttgttgaggatgatgattcgggggcgttcggggattgggattgcgcccaacggcagttccagcttgtcggcatattcggcaagctcatgttcgagcgccttgtagtcgctcatcggatcacggtcaggttccagcgtggcacagtcgatgacgtgggcgatgatttcggtgcgttcgatatggcgcaggaattcaaggccgaggcccttgccttgggatgcgcccggaatcaggcccggcacgtcggcgatggtgtaccgcatgtctccggccataaccacgccgaggttcggcacgagcgtggtgaacggatagtcggcgattttcggcttggcggagctcatggctgcgatcaggctggatttgcctgcggaggggaagcccaccaaggccacgtcggcgatggatttgagttcgagaatgacgtcacgttcctcgcctggttcgccaagcaacgcgaatcccggagcgcgacgggtgcggttggccaatgcggcgttgccaagaccgccgttgccgccggccgccaccacgaacttgtctccggcatggcgaagatcggcgagctgctcgcccggatgcttaggcttgccttgcggccctttggcttcgaaaatcacggtgcccacaggaacgggcaggatcagatcggcacctttcgaaccgtctttggtgtctcccaagcccatggtgccgcttccagcctcgcggtggggcatgaaacggtaatccaacaggctgttggcgttctggtcggccatgaagatcacggaaccgccatcaccaccgttgccaccgttcggtcccgccaacggcttgtatttttccctacggatgccggcggaaccgttgccgccgtcgccgcccttcacatggacggtcacgcgatcgacgaaatcactcatgtatctaccttaatcgtttgttcgaaacggtccgattattgtccgtttgatatgtcttatgcaactgtatgcaacgttacgtgacgtttgggacgggctgaaggaaaccaatcctcagcaatcatcaaaataaagaaaagccgcgtccataacgggcgcggctttatcttgtaagcgttaattgcgcgtatttcaggcggcaatcacgtcgacgaccttgcggtcacgacgtacgccgaacttcacgctgccgtccttgagggcgaacagggtgtggtccttgcccatgccgacgttctcacccgggtggaacttggtgccacgctgacgaacgatgatgttgccggccacgacggcttcgccgccgaacttcttcacaccgaggtattgcgcgtttgaatcgcgaccgttgcgcgagctggacgcgcccttcttatgtgccatgtctgttcctttcggtccttgactctaaccctgcgccaatcaggcgatagccgtgatcttgacagcggtcagctgctggcgatggcccttgcgacgagcaacgccggtcttgttcttatacttcatgatgctgatcttcggacccttggcctcatcgttgacaacctcagccttgacgctgacgttggcgagatccttggcaccgaggacaaccttggagccgtccacaacgagagcaaccgggaattccacggtttcgcccttcttagcctcgagacggttgacgtagatgacgtcaccgacctcaaccttttcctgatggccgccggccttcacaatcgcgtacatatccgttcctttattaacttggaaagcttactgcccggcacgttcgagcctcgcggccagacaccagcaatctaatctacacatacccgcgtacaaccgcaagtctgtttccggcgtgtcaggttgacagaccggaataatcatttattcttctacgcttcctcgcccagttccgcattgttggcggccacggcagccgccgcgatctgtgcgagtttggccttcacgtccggcgaggagcctttcggcacctgcacgtccgtgccgtgaccatgcttgttggttttgacgaacgggtcgccgcccttcagggcgtacggatcgtcataatccgcggacacggtcggctcgtcatcccgttggtcatcgcgttcctgtgcctgcagaagtactggcagtccggccttgccgcaggcgccgtcaaggaatgaatttgttaggatagttgacaaaaaaacaaaggagtggatatgactcaacgtagagcctatcgttggccgcagccgttggctggacagcaggaacgcatctggtacggaggtgactacaacccggaccagtggcccgaggaagtgtgggatgatgacgtccgtctgatgaagaaggcgggcgtgaacctcgtgtccgtcggcatcttctcgtgggcgaagatcgagacgagcgagggcgtgtacgatttcgactggctcgaccgcatcatcgacaagctgggcgaggccggtatcgcagtggacttggcgtccgccaccgcgtcgccgccgatgtggctcacccaggcgcatcccgaggtgctgtggaaagactaccgcggcgacgtgtgccagccgggcgcccgccagcattggaggcccacgagtccggtgttccgcgagtacgcgctgaagctgtgccgtgcgatggccgagcattacaagggcaacccgtacgtggtcgcatggcatgtgagcaacgagtacggctgccacaaccgtttcgactattccgaggacgccgaacatgcgttccagcagtggtgcgaggaacgctacggcaccatcgacgcggtgaacgacgcgtggggcacggcgttctgggcacagcgcatgaacgacttcagtgagatcgtgcctccgcgcttcatcggcgacggcaacttcatgaacccgggcaagctgctcgacttcaagcggttcagctcggacgcgttgaaggcgttctacatcgccgagcgcgacacgcttgccgagatcacgccggatctgcccctgaccacgaacttcatggtgtccgcgtccggttcggtgttggactacgacgattggggcgacgaggtcgatttcgtgtcgaacgaccattacttcattccgggcgaggcccacttggacgagctcgcgttctccgcgagcctggtcgacggcatcgcacgcaaggatccgtggttcctgatggagcattccaccagcgcggtcaactggcgtgagatcaactaccgcaaggagcccggccagctggtgcgcgactctttggctcatgtggccatgggtgcggacgcggtgtgctacttccagtggaggcagtccaaggcaggcgcggagaagttccattccgcgatggtgccccacgcgggcgaggattccgccgtgttccgcgacgtgtgcgagctgggcgccgatctgaacaaactgtccgacgagggcattctgggatcgaggctcgcgaagtcccgtgtggccgtggtattcgactacgagtccgaatgggccaccgaacacaccgccacgccgacccagcacgtgcatcacgtggacgagccattggcgtggttccgcgctttggccgatcagggtgtgaccgccgacgtggtgccggtgcgcggcgcctgggatgactatgagatggtcgtattgccgagcgtatacctgctttccgaggaaacgacccgcagggtgcgcgattacgtcgtgggcggcggtcgactggtcgtgacctactacacgggcatctcggacgagaaggaccacgtgtggctcggcgggtatccgggctcgatccgtgacgtggtcggcgtgcgcgtggaggaattcatgcccatgggcgacgatttcacgggcgtgccggatcgcctcgagttgtcgaacggcgcggtcgcgcacgatatcgccgacgtgatcggctcggtcgacgggacggccaccgtgctggaaacgttcaaggacgatccgtggaccggcatggacggcgctccggcgatcgtcgcgcacacgttcggcgaaggtcgcagcgtgtacgtgggcgcgcgcctcgggcgggacggcatcgcgttgagcctgccggaaattcttgattcgctcggcatggccgaagcgggcggaaacgacggccgagtgctgcacgtcgaacgtgagggcgcggacggttcgaggttcgtgttctcgttcaaccgcacgcatgagacggtccgggttccggtggaaggcgaagtcgtggtctcctcgttcgcggacgtggacggcgaaacggcctcgattaaaccgaacggcgtgatcgtcactaagcagtaagcggacagcaagcaaataatcgcaacattatgggtgtcggcaggttgatgattgtcaatctgccgacacccatttaatttatactattcgaataaaaactaggcgtggaattccactgcagcccaactgattgctggcaaagtgcagtgaactgatccattgtcgattgttgcatgaagctcttggggtgtcactgcggttgggtcgtctgcggaattacgctgatatggattgtcgtcatgcagaataatggccttgtctatatggaagtcggatatgtcgaaatacggcagttgagacagagaagccgtaaccttatgtgcgtcggatgcgtcgcgattcaccataagcagaagaccggaatgattcgtttcgtcccaagtgattactgaatcaagggcattgaccaagccgaaagattcagtctctacgttgggagagtcgatgactggactgtaggcaatgccatgggcgtgttgtgcggcttcggcaaacggatagaagacagtttgacgccatgcgggaccgttcttttcggccatgattggcgcaatcacattgaccaactgcgcgcgcgaggcagaacgcactcggtcgcagtgcttaagcagagtgatcatcagcgacccttctaccactgcatcggctgcattgtagatatcttcgagcagacgcggtgctttcggccatgactcatgatgaagatccttgcctgattgggctttccattcagcttcctgctgattccagacgtcggaataccagacgccccactcatcaaatgacagtgctatatcatgatcgcctgtgtgggcatttttggcttcgtctgcacatgccgccacggtggagatgaacgtttgcatgtcttgtgaacttgccagataatcttgcaacgattttgccccacgtttgtagtagtaggcatggcaggagacgaaatcgagattgtcgtacgctttggtaagcacgctgcgttcccaggatccaaacgttgacatatgggcgctggaggagccgcaggccacgagttccaagcctgattccgcgagtttcatggcgtgtgcgactcggtccacggctgcggcatactcgtcagggctcatatgtcccacctgccaagggccatccatttcattgccgatgcaccacattttgatgtccattggttcggtgattccgttacgtacgcggcgatcggcaagctcggtgccgggcgctccgttgacgtattccaactcttccagtgcggccttcaatcctcgggtgcccatattgacggcaagcatgatttcggtaccggtcttcttgctccatcggtagaaatcgtcgataccgacttcattggtttcggtgctgtgccatgcgagatctcgtcgtattgggcgttgcccccgtggccctgtgccatcctcccaattgtaggcagagacgaaattgccgccggggtaacgcacgcaggtcacaccaagttctttgactagattgatgacgtcttggcggaatccgttttcgtcggctgtggggtgacttggctcataaatgcctccgtagacacaacgtccaagatgttctacaaatgatccgaaaatgcggggtggtatatcggcaattgcgctgtttttttgcactgtgattgtgctggttccggaagtcatgccgttcctttcgatgagtggtctgatgaaatgtctgcgttgcgcgagcttcgacggatatgcatacgtctagtatgcaatcatatcgtgtttgcgtagctaaacaaaatatgctaggtaactaaagaaatactgtaaaatcaacgatttgcctatttgtttgcgtaaacataacttttgtgttatcctcatgactgtcggaagggtcaatgaatgattcatagccgataatgttggtcgatgtaggaggtcggccatatttaaaggaaggaagaacgatgaagttcactgcatccaagaaaacaatcgctctggttgctgctgctgcgatgctgactagtgtcgcagcctgcgggagttcctcgaattcgagttcttcgggggtgacagagggtggtaagactgaaattacggtatggtcttgggattccactttgccgcgtaccgtgaaggattttgaaaaggccaatccggacatcactgttaaggtgaccaatgccggcacgaacaagaccgaatacacggctttgaacaatgcgctttctgcaggtaaaggtgcgccagatttggtgcagattgagtattatgcacttcccgaatatcaggttcgtggagagattgaagacctgagtcagtttggtgcgggcaagttctcggatttctatacgccgggcacgtgggcttctgtgaaacttaatggcggtgtgtatgcactgccgatggattccggaccgatggcatggttctataacaaggatgtgtttgataaggccggggtcgatccgactcgggtgaggacgtgggatgagttctacgatgctgccaagaaggttcgcgcaacagggtcctacattacgtccgattctggtgatgctggcttcttcgattccatgacatggctggcgggcgcgacgccgttctccactggttccgatggacagtccgtcaccatcaacctcagcaatgattccaaggtcaagacttttgttgatttctggcagaagatgattgatgatgatcttatcgataccaagaccgcaggctggagtgatgattggaacaagagtttgaatgacggctctatcgcttcgctgctgaccggtgcttggatgccgtacaacttgctttccggtgctcctgacggtgaggggaagtggcgtgttgctcagatgccgactccggatggatctgaaaccaattccgagaacggtggttcttcgctggcgatggtcaagacggatgacaaggccaaggccgaagctgcatacaagttcgctgaatatgcgtgccacaatgccgaaggcatcaagactcgcgtcgctggcggcgcattccctgccgataacgacactctcgcttctgatgacttcctgaacatgacctctctgactgattccgatggcaatgcgcacgaatacttcggtggtcagaagttcaatgaggagctcgccaaggctgcggccaatgtttcgactggctacaagttcctgccgttcgaggtttatgcgcgtggcgtatatagcgatgatgccggtggtgcatataccgacaagtccgtcacccttgctgaaggtgttcaggcttgggaaaagaatatcaaggattatgcatctcagcagggctacaccgtgaagtagctgcatgattccatagtggaatcggtaaatatgagcgtctgtggattgagggattgtcaatcggcggacgcttttttgagctatcagtggattgcgtggctgaatcgaagagattggaggattgtacgctggctttcgggtgactgacgtacactcgaatgcgtatgtctgtacgtacgttttcgtgtgggaacatcaaacggaaggaatcggcttgaaactggtgaaacgactcatcgccatctgctgtgcggccattatggcagtcagtgcggccgcttgcggagccaacgtcgattcccgcaccgaaatcaccgtgtggtcgtgggagccgagcatgaaacaggtcattgccagcttcgaaaaggaaaaccccgacatccacgttatttggaagaacacaagcggttacgacaatctcaacaacgccattcaagacggttacggcattcccgacgtggtgcaattggaatactatgcgttgcgccagtacgcggtaagcggccagctggtggcgatcaccgggcgtacggaaggctacggcgatttctacacgcccggtacgtgggcttcggtgcagctgaacggccgtgtgtacggccttcccatggattccggtccaatggcgttcttctacaacgacagcgtgttcgagcaggtaggcatcgatgcctccaagattcgcacgtgggacgactattacgaggcggccaaaaagctgaaaagcatcggcgtgtacatcgcagccgattcgggtgacgccagcttctacgacacgatgatctggcttgccggaggccgtccgttctccacctccaacgacggcaaaaacgtgacgatcaacctcaccgacgatgagggtacgagaaccttcaccgaattctggcagaaaatgatcgacgaaggtttggtcgccaccaatctgaccacatggtccgatgggtggaaggaagccgtgggggaggggaagatcgcctccatgttctccggtgcttggctgccgtcgctgctcatgtcgaaccttcccggaaccgcgggtttgtggcgtgtggcacagatgcccacgccggatggcagttataccacgtcggaaaacggcggttcggcgctggctgtgttgcagcgttcgcgcaagcccgaagcgtcatatcgtttcatcgaatacgcatgccataacgcggaaggcatcaaagcccgtgtggacggcggtgcgttccccgccgataacatcacgttgtctgatcgggaattcctgcgcaaaaccacggtgaccgacgaacgtggcatcgaaataccgtatttcggcgggcaggaatacaatcgcgtgctttcccaagccgcggaaaacgtgtcgaccggttaccagtatctgccgtttgaagtgtatgcgcgaagcgacttccgcactaccgtaggcaaggcctacaaatggtcgagccggttgcgcaaagagcaggacaggctgaatatcatcgcggccggtggcaaagtgtccgacaaatccgccatcggcgacgcgttgaaggaaactgattccgctgatcgtctcaaattgaaaagcggtattgcgctgtggcagaaggatttgaaggaatatggagccaatcagggcttcactattcaataaatattaattattcatataagatgtcagactataacctgaccgcagacggctacggcatgacttctgccctaaatgccagaaccgcagccgacgccatccgccagcgggaatttgatttagcgctgctggacatcaacctgccggatggaaatggttttgagatgtgcaagctgataaagccccaacacccagacaccatcgtgattttcctaaccgccaacgatcaggagagtgaccagatacgggggctatgaggcgggcgcggtggactacatcacaaagccctttgtaatcggggccttgcagcgaaaaatcaaagccatgttcaccatgctgaaacaccacagaccggccaaggatatttacgacgacgggcggctgtttctggacttcccggagcagacggcttccttaaacggcaagcccctgaccctatccccgatggagtacaaaatgctgaacctgttccgcaaaaatccccggcaagtgctgacccgcgggcagcttttggaaaaactgtgggatatagacgaaaggtttgtggacgaacacaccctgacaacctccatcagccggattcgcagcaagatcgaagccgacggcggcgcaccctacattaagaccgtttacggcatggggtatcgatggacgggaggcgaggcaaaatgaagtttcaaaacctctcagtaaagcggctgtttggccgggtggcaatagggttgtcctctccgtgtccgggatcaccatagccctgtttcttgtgacaaaacaggttgcggtgctgctgacgggcggggcgccgctgcttgtgcgcccttgtggggatttttgtactgacgcaggcgtttggaaagcggttgtcacagtttaccgctgacctgtgccagactttagaccacatgatcgccgggaatgaagcgccccagcgcccagaggacagcgaaacccagcttgccagaatcggacaccggctggcaaggctttaccagatcatgcaggagaaccgccgccgggtggacgagaaacggcaggagttacaaacccttgtatcagatatttcccatcaggtaaaaacgccggtaagcaatctgaaaatggcgacggacaccctgctggaaaagcccatgaccgaggtggagcgcaccgattttatccggggaatccgcagccagacggataagctggactttctctttcaagcccttgtgaaaacctcccggctggaaacggtcgtgatccagttggataagaaatcgggccgcctctttgataccgtggcgcaggccatgagtgggatcgtgtatgcagcggagaaaaaggaaatcgccgtgtctgtggactgcccggaggatttgaccgtttcccatgacagcaagtggacatccgaagccctctttaacctgcttgacaatgcagtgaagtacaccccggcaggcgggaagatctctgtgtcggtggtactgtgggaagtgtatgtggagatcaaagtgaccgacaccggcaagggcatttccgaaagcaatcaggccgccatcttccggcgcttctatcgtgaggaagaagtacacgagcagcagggcgtgggcattggcctgtatctggcccgcgaaatcgtaacgtggcagggcggctatatcaaggtgatttcggagccgggcaaaggttcgaaattttctattatgctccctacaaaatgaaagtaaatgagcgaggtgtttctattatgaatgaacgagaaaaaacgatccgactgtggtttgatatgtggctttatcagaaagatatgggtattgatgatatttttacagaagatgtcctctatacagaaagttggtgtccccagtatagcaatcgtaaaaccgtaaagcattggtttcaggaatggaatacccgtggaaaagtggtaatttgggaaatcaggcaattcttccataaagacaatcaaatgattgtagaatggtatttcaaaaatgaaatgaataatggggatatagaggaatttgacggcgtttctttggtcgaatggacagaggacaataaaataaaagcattaaaagagtttgggtgtaaccgtaatacttataatccctatcaagaaagcgacatccctcaatttagaaatcaaaaggcgaattggttttagaagtgtatgaagttctacgcaattcggagaggcttgtattttcttaaaatacaaaaataatgatggttgtcttgtattcgattgaaagcaagacaaccatcattattatgtactgagattgcacatatctaaaatataagattttctatcgtacgttacgctcgtaaatatgcagcatgcctttgaaaatcagatcagggtcataaatgtcgatcatgtcggtatcgtcggcgaacacgcggcttaatccgcccgtcgcaaccacgcggaaatcctcgtcgatttcacgatggaattgcgcgatcgtacgttcgatgccgccaaggaagttgtaatacaggccggcctgcatggctggcctggtgcttttcgccagaatcgacgaggggcgcgtgatctccacttccggcaactgggccgtggcatcccacaaggcggccgcgcctgtgcgaatgccggtggtgatgagcccgcaaatcaccgacgcatcggcggtcacatagttgaatgtggtggccgtgccgaaatccgccaccagaatcggcccgccatactcgtagtaggctcccgcacagtcggcaatgcagtccgcgcccatattctgcggattgtccatgcgaatattgatgccggttttgactcccggtccaacaatcatcggatcgatattgaggaatttcacaatgctggcacggaacgaatgcatgaccttcggcaccaccgacgtgatgatcacatcgtccacatcgcccggcgcatagccgctcagccgcaggaattgcgtgatcatcaggccatattcatccgacgtgtggttcgccttcgtggtgatgcgatacgtgccggcgatatgcccgtcatcgagaaagccgatcaccacattggtgttgccgatgtcgactgcgaccagaagcatgtcgaattctccttacgattgctgtattgacgctatttcctgtgatgttggttgatagttacgatgcttgcgattcagcggattcggtattgcgcaacgctgccaattcggtgaggatgcgttccgccaattcctgcttgctcatcttgttccaatgctcgatgatcggttcgtcggtggtttcgccgggtttcagcacggtcaccacattcgtatccaccgcgaatccggcgccgggagtgttgagattgttggccaccagcatggaacaatgcttggatgtgagttttttcgctgcgttcgattcaagatcctgcgtttccatggcgaaaccgcacaaggtttgaccggcggttttatgcgcgcctgcccatgcgagaatatcgggattcgaagtgagccgcagatcgatattgacgcgcccgttcttcttgattttctccgaagactgctcaatcgggcggaaatcgccgacggcagcggccataatcgtcaaatcggcctgcgtgaaatgctcttgcaccgcgttgaacatttgctgcgcggtgatgacatgaaccgtatcaatgccgcggggagcgctcaatgtgacagggccggataccagcgtcacatccgcgcccatatcgcgtgcctgctcggcgatcgcatagcccatttttccagtggaatgattggtgaggtagcgcacgggatcaagcggctcctgtgtggggccggcggtgacgagcacatgcaatccgtgcaatggcaacgtttctgcgggctggttcgcacgcagcagatcagctacggcagcttcgatcgcagcaggctcctccatgcgccccttgccaacatcctggcaggcaagcataccggatcccggctccacaatggtccatccaagttcacggcaggcattgagattgcgttgcgtcacggcattctcatacatgtgcacgttcatggcagggcataggattttcggtccctcgctataggcaagcacggtacttgtcagctggtcgtcggcaatgccgcatgcgattttcgcaatgatatcggcgctcgcgggagcgatgacgagcatgtccgcccatttcgcatcatccacgtgattgatatgcagcggatcggatggcgtatgcgcaacatcgccgtcattgcgctgtgctgcgaacatggacgtgcgcgtctgcgtatgcgtgagcgagctgaacgtcaacggggtgacgaactcctgcgcggccgcggtcatggccacgcgaacctcatgtccctgcttgctccagtcggaggcgagatggcaggccttgaatgcggcgatgctgccggtcacgccgagaagaatatgcgccatagccgatattgtccttcccttgacgttggcaagacttacgaaaactgcgtcaagtatatatcgaaccggctgaggcatgcggcattgcggcattgccgtcagatgaatcctgcgggcatggcggattgtagaatcagactttggtgatcgacccgtacaggcggtcaaccagaacaaacacataatcaaacaggagcaatcatgtcgcaatcttcaggtgcgtacggcgaagccgacgcaaccgaacagaagaacgaacaacacaacaatcagcccgcaaactcggcaagcaccgacgcaactttgaacgcgcgtgccaaatcaccgaaatccaaggggcccaacaagtggatcatcgccatcattgcagtgatcgcagtggtcgccatcattgtgggcgtcgtcgtgttccgtaacaacaacgcatccagcgataccgcggaaaatggcacctccaacaccgtgaccattggactgaaactcgcccccgtaagtctcgacattcgccaccagtccggatcggcgatcgaacaggtgctgatcggcaatgtgtacgaaggactgctgtcgcgcgattccgacaacaaagtgcagccgggactggcgaaaagctgggatatttccaacgacggcacaacgtatacgttccatctcaacgagaacatgaacttctccaacggagacacgttggacgccgaagatgtggcctggtccattaaccagctcaaagaacagcagtattacaacgccaatcaggtcgaaagcctcgaaaaagccgaagcggtcgatagcgacaccgtgaagctcacgctcagcacccccgattccaacctgctgtggtacctgaccggacgccccggcctggtgttcgataaggacgccgaatacaacgcgaaaaccgaagccgtcggatcgggcccgtacacggtggaatccttcgattccgccagcaaaatggcgctcaaagccaacccgaagtattggggaagcgcacacaaggccgcaaccgaaaacgtgatcatcaaattcctcaccgacgataacgcagccgtcaacgcgctgaaaagcggcgaagtcgacgtgctttccccggtgaacgccacgctcgccaaatcgcttgacaccaacacgtatcaggtgtccgcggcggacggcagcgacaaatacgtgctcgccttcaactgcgcgaacagcaagcttgccgacaagcgcgtgcgtcaggcaatccgttacggcatcaaccatgaggaaatcatcgcttcgcgcggtaacgtcgactatgcgctcggcgggccgatcccatccgtggacccgggctatgaggacttgaccgacctgtacccgtacgatgtgaacaaagccaaggaactcatggctgaagccggctattccaccgataatccgctgaaactcaccctcacctacgccaacacgtacggcacggaactcggcgaccaactgcgtagccagctcgccaaaatcggcattgatctcaacatcaactacgtggaattctccacatggctgcaagacgtgcacgccaacggcgactatgaactttcgttggtggaccacgccgaaagccacgacttctacaagtggaccacgcccgactactacttccactacgacggcaagcaagcccaagaactgtatgccaaggcgctcgccgccaccgatgaggaatccagcgcaaactacctgaagcaggctgcgaaagcagtaagcgaggatgcccccgctgactggctgttcggctatcgtgtgacggtggcataccacaagaacgtgcagggattccccagcaagctgagccagacggtgctgccattgtggcagatcaccaaggcgcggtgaatcgacgaaaaacgatggaaaatcggcggaaaacaagtgatgaaaactgatgtgtggcggtgtttgcagcggcatcgttgcggcaccgccacacgttggcgcgatattgttgggtagggtaatgacggtgaataggtgcgtatcgctgcaaacgcacggatcgagcgatagaccaatggtggttcaactatgagatttgtagtcaaacggctgggactgttcgtcgtggccctgttcggtctgtcgcttctggtgttcgtgctgttgcgcatgctgccgggcgatgtggctgcggtgatcgcaggaacgaacgcagcccctgaacgtatcgcgtcgcttcgtaccgaacttggcttggacaaatcgtacgtggcacaatacggcgattggatgctgggattgctgcatggcgatcttggtgtgtccaccatcggaggcaaagcggtgtcggcacaggttgcgtctcgtgcttcggtaacgtttccactgatcatcgtgagtttgctgatcgcattggcgattggcctgccgcttggttgcgctgctgtgctgacccgtaatgcccgcttgcgtgggctttgtcacggtattgcgattgttgccggcgccattcccgcattatggggcggattgctgttgattctgctgttctcacgcggttcaggactgttgggattgctgcctgctcaaggttttcccgataatggctggggcgcgcccttgcaggcgttggcttctttgatacttccggcgctcgccaccggcgttaccgcaggcgcgtccattatgcgttacacgcgtgccgccgtgggggacaaggcctcgtctcaggcggtcgacatggccatggcatgcggcatgacccgcaaacaggcggtattgcgcgtcgctttgcgtcttgccacaccgcaattggtgtcggtgatcggtttgacgttcgcccagatggtcaccggtgtaatggtggttgagaatctgttcgcgcttccggggcttggcaccatgctggtcaccgatgttggcaatcgagatctgattgcagtgcagagcgaattgttcctgttggctacgttcttcctcttgcttggattagtggttgatgtggtgcatcgtgcgcttgatccgcgtctgaaagatgccggattggtgtcgggggaggtgcttgcatgatgaaacagtctgctgagaaaactacttcgaaaaacgctgtgaaaaccgtgattccctccatatggcgtaccgctggtggcaagtattcgctgatcatgcttgcgatatggctggttgtgtcggctatttcgctggtgtggacgccatattcgctgcttgatactgacggattcaacacgtgggcttcgccgtccggcgctcacatgttgggtactgatggtgttggcgctgatgtgttgagctggctgatggccggttcccgtacgaatcttgcgatcgcgctgcttaccgtggtggttgccgcggccatcggcctgctgctggtggcggccatggtgtctcgccatggcgcattggcttccacgtcggtggttgtggtggatgcgttgatttccattccaacagtgctgatcgccttgatgctttccgtgccgttcggcgcgtcggcagcggtgatcatcgccgcatgcggacttgcatacgggctgaatttggcgcgtattctacgccccgcggccatgctcgccgcacgttctgactatgtggaatcggctttgtggtcgggtgcgagttcgttacgcgtgtttttcacgcatattgtgccgaatacggttccggtgttatgcgttcagctgtcgatgagtgcgggcacgtcgctcttggcggaggctggattgacgtatctgggtgttggcgtcggtgcgggagtgcccagttgggggcattcgcttgccacgtccgtgaaattcatcagcatttatccgatggctgtggtgtggccgggattggtggtcaccttgatggtgatagcgctgaatctgtttggcgatgcgttgcgtgacgccatcgatccgctgacgaatccggcattgcggcaaggtgaagccacccatgttgaatcggaggaacgcgcatgagcgtcagcatccgtaatctcaatatcgtcatcgatggaatgccgattgtgcatgatgtcgatatggacatcgccgacggtgaacgtgtcggtttgatcggttcgtccggttccggcaaatccatgatcgccaaatccatcatgggcttgctgccgctttccgcgcaggtttccggcagtattgacatgggtggtactgaaatcgtcggagcgtcggatcaagcgatcgccgatctgcgtggtcgttatgtgggcatggtgttccagaatccttccgccgcattgaatccggtgatgaccgtggcgcagcaggtcgcgctgccactgcgtttgcattacgatctgacccgtgacgaacggttggaccgtgtcaaagcaatgttcgccaaagtcaggctgccggaagatgtgctgaacaaatatccgcatgaactttccggcggacaacagcagcgcgtcggcatcgcggccgcattggtcacgtcgccgcgcctgattatcgccgacgagccaaccaccgcgctggattcgatcacgcaacggcagatcgtcgatctgctggcatcgttggtggacgattccggcgcatccatgctcttcatcacccacgatttcgcggtactcaatcatgcaaccacacgctgttatgtacttgctgatggacgtgttgccgaatcaggacaaaccgccgatatcctgcagtcgccgcacactaaagtcgcttcgcaattggcgacttcggcacgtgcgctgtcgttgcggatcgatgccgaaaccaaataaggagaacggttgtgacgggcgaaaacgaaaaaaccacaatgctgcaaggtcgcggcatcaacaaatactacggtgcgaaacaacagcgtcgtcaggtgctgcacgatgttgatatcgacgtacgttcgggggagtgccttgcggtgatcggcggatccggatccggcaaaaccacccttacacgagtattgctggggctcgaacacgctgaaacgggcgagattacgtatttcggcaagcctgtgcaaggcgaagtcgccggcgaactgcggcgtagctgcggattggtgttccaaagcccattcggctcgttggatccgcgttggagggtcggcagatccgttgccgaaccattgcggttgcatcaccctgattggtcgcaggaacggattgcggaacgcgtgtcggaagccttccgcatggtgagtctcgaccctgccgcatatgaaaatcggttccccgtggacctctctggcggtcagacgcaacgcgtggccatcgcacgtgccattgcggatcatccgaaagtattgcttgccgacgagccgatgagcgccgtcgacgtggccgcacgaacgcagattctcgcatcgttcgctgcgattcgtagcggcgaacctgatatggcgctgatcatggtgtcacacgatttgggagtggtgcagcatatcgcagatcgcattatggtgttgcacgatggttgcgttgaggaatgcggacttacggaaaccgtgttgcaccatccgaccagcgattacaccaaacgattgctggacgcggcttcgctctgatttgtgacactgcgcaaaaagcctgcgatcatgttgaaatccgcatgattgcaggcttttttgccgctatatgaacaggtaagacacgccgatgtcgttacgtgtgctattgtgtgagccatgttcaatttctcttgttgttgctgtcgctgaccaaccgcccgaggggcgcgtggttcatcgaagcataacttgagacagggcattctttttcggcatacgcaacttgcgttgcatgccagagtatcgcagaaatcatcccataaccagtgccttacgcggttggtattacgcggcatatgtggatgaaccgcagcgaaaacaccatcacaggtcccgtttcaaatcattgcaagtgataaacgcgagcttctcgaaatcaaaacaacgaaatcattcatcggaagccaacggaaatcactcttcgcaaggaaacgacatgaccatccacaactccctttccgagctcatcggcaacactccgctcgtcaaactcaaccatgtgaccgacggcatcaaagccaccatcgcagtcaaagtcgaatatttcaatcctggcggctcctccaaagaccgcattgcggaacgcatcatcgacgcggccgaacgcagcggcgaactcaagccgggcggtgtgattgtggaaccgacctccggcaacaccggcgtaggacttgccctcgtggcccagcagcgcggataccgcaccatcttcaccctgccagacaaggtttccgaagccaagcgtgcggtactccgcgcatacggtgcagaagtggtggtaacccctaccgatgctggtccggatgatccgcgctcctactaccaggtggcggaacgcctcgccaaagcgattcccggcggataccgcccgaaccaatacgacaacccgaacggaccggaaagccactaccgcaccaccggtccggaaatctgggaagccagcgaccatcaggtcacgcatttcgtggctggcatcggcactggcggcaccatttccggcaccggacgctacctgaaggaagcttccgacggcgcagtacaagtgatcggcgctgacccggaaggatccatctattccaatccgaacgacgtgcatcagtacagcatcgaaggcgtgggcgaggatttctatccgaaagcgttcgaccgtgaacttcccgacgaaatcgtgcaggtcaacgatgccgaagcattcgaaatgacccgccgtttggctgcggaagaaggtctgctggtcggaggctcgtccggcatggctgttacggcagcgcttaaatacgcacgcgagcacgatttggacgaagaccagctggtcgtggtgttgctgccggattccggtcgcagctatatggaaaagatcttcaacgacgattggatgcgtgccaacggattcgccgacgttgtggaacgcacgtccaagccaagtcttgcggaacagtatctgtaaaccgccaattcatatctcaacatcatgcccatcattcgttcaacccaaaccattcgatattttcaaggagttcccatcatgaccatctcgaccaacaccgaagccctgaacgccactgcactcgccacccgcgccattcacgcaggtcaggaacccgatccgaccaccggagccgtggtcactcctatttatatgacatccacgttcaagcaggatggtgtcggcggcctgcgcaacggttatgattacagccgttccatcaatccgacccgcaactctttcgacgagcagctcgccgcggtcgaaggcgcgaactacgcgctgagcttcgcttccggactggccgccatcgacgtgctgttgcgtgccacgttgaagccgggcgacaatattctgctgggcaatgacgtatatggtggcacctaccgtttgctttccaaggtgttcgtgccgtggggcgtcggtcttgacgtggtggacatcaccgacacggcggccgtttccgcggcgctcagccagaagcagtaccagtacatttgggtggaaaccccgtcgaacccgctgctcaacatcaccgatatcgcagccacgtcagcggtcgctcacgcgcatgacaccaaagtggtggtagacaacaccttcgcatccccggtattgcagcatccgttgacggatggcgccgacgtggtcgtatattccaccaccaaatacatcggcggacattccgacgtggtcggcggagctgtggtgctcaacgacaaggaaatccgcgatgaagtggcgttcctgcagaacgcggccggagctgtgccatctccgttcgactcctggcttgacattcgtggcctcaaaacgttggatctgcgcgtcaagcagcacagccgtaacgccatgaaggtggcgcaatggctggaaacccgccctgaagtggaacgcgtatggtacccgggactggaatcccatccaggccacgagatcgcggcacgacagatgcatggcggcttcggaggcatgatctccgtacagatcgcagccggattcgaagcggccaagaagttcgccggtgctacggaagtgttcactttggctgagtcgttgggaggcgtggaatccctgattgagcatccgggcgccatgacccacgcttccgttgccggtaccacgctggaagtgcccgccaatctcgtgcgactttccgtcggtcttgaagatgctgacgatttgatcgcggacttggagcaggcatttcgtcgtgtttgagataagatcgcagcctcgttacggttttgtgtaatccgtcaaaaaggcaaaacgtgcataaatcctcgccatcggattcgccaaaagcgtatattatgctatttcgaatctgcttatggcgagggttttgccatataatactttcgacaacgttcgtgttcatctaccagcgcattctctgtggaatcgaacgcccatgattatcgagacgaggcggcatgctgcaaattcaaggcatctccaaacagtataaaaccggcgacttcgtgcagcgggcgctggataacgtcagccttaacctgcgtgacagtgaattcgtggccattctcggaccttccggctccggcaaaaccacactgctcaacatcatcggcggacttgaccactatgattccggcgatctggtgatcaacggcatttccaccaaacaatacaaaagccgcgattgggactcctatcgcaaccacaccatcggtttcgtgttccagagctacaatctcattccccatcagaccattctgtcgaatgtggaacttgccctaaccatttcgggcgtatcgcattcggagcgtcgagagcgtgcgcgcaaggcgcttgaacaagtgggtttgggcgagcatgtcaacaaaaagccgaaccagctttccggcggtcagatgcagcgcgtggccattgcgcgcgcgttagtgaacgatccggacatcgtgctcgccgacgagccgaccggtgcgcttgattccgatacttccgtgcagatcatggatctgctcaaagaggttgccaaagaccgcctcgtggtgatggtgacacataaccccgaactggcctaccagtatgccacgcgcattgtggagctcaaggacggtgtgatccgttccgactccgacccgttcgaaccagcccagaacgaaacggccaccgctcccgtgcacaagaccatgggccgcgcatccatgtcgttcggcacgtcgttggcattgagcttcaacaatttacgcaccaagaagggccgcacgttccttacggcattcgcaggatccatcggcattatcggcatcgcattgattatgtccgtttcggcaggcgtgaacacttatatcgacaatattcagcgcgagacgatgactgcttacccgatcagtatcgacgaacagaccttcgacctgaccagcatgatgacttccggtcagcagagtgcggacaatcaaggcaagaagcataagagcgacgcgatttatccggatgatgccgccatcaagggcaccgcttcgatgaccagcagcattaccgaaaacaatctgagcgcgttcaagaaataccttgataataaggacagtgacatcaatcggtatatcggttccgcgggaatccagtattcgtatgatacgaggttctccgtattctcacacgatccagacggcacgcttgtcaacgccgatggtgtgacggtgggcaaaaccggcaccaaatcgatggccgaccagatggcggatggttcgctgatgtctgccgactcgtccacctttacgtcgacgcgcgtgagcatgctcacgggtaaaaccgaccagaatgctgcaccgagctcgttccatgagatcatgccaagcgctgatggcaaaaagaacgtcggcaaggtcatttccgacaattatgaggtagtcgaaggatcctggccaaagaacaagaacgaggttgtgctcgtacttgacgagaacaattcattgtcgttaaccgctgtgtatgagctaggcctcaaatccgccagtgaataccacgatatgatgaaccagctcaattccggcgacgatgtgaaaaccgataccaagaagattgactattccgacgttatcgaccgcacgctgaagctgctgccggcctgcgaccagtatgtcaaaggcgataacggccattggacgtacgtgggcgacgatgtggaccagattaatgcgctgatcgactccgacaaggccatcgatctgaagatcgtgggcgtggttaagccggtagaggatgctgacgcaaccccgctttcctccggtgtgggctatacgcgtgctctgaccaatgagctgatcgaccgtgccgaatccagtgaaatcgtcaccgaacagcagtccgataaagaccacaatgtactcaacggcatgacgttctcgccatccgacgatgccaccaaggcccaggatgcccgcgattacgtcgcatccctcggcgtaagcagcaaggcgcagatggcgcagaacatgatggcggccgcagacgcatccggaggtgactcccagcaggccgcggccatggctcagatgggcgaacagcagctcgccgaccaattcgacgcctatatcgccaccgccgacgaggccacgctggtcgccatctacaaccagtacgtgtccaccggctcctacaacgataatctcgctgatttcggcgtggtcagccgtgacgcaccaagctccatcaacatttacgtcgacagcttcgaagacaagaattccatcaacgacgccatcgacgaatacaataagaccgccaaggaaaaagacaagatcacctacaccgactacgttggtctgatgatgaactcggtaaccaccatcatcaacgtcatcacctatgtgctgatcgctttcgtggctgtgtcattggtggtctcgtcgatcatgatcggcattatcacctatatttccgtactggaacgtaccaaggaaatcggtattctgcgcgccatgggcgcatccaaacgcaatgtgtcgaacgtattcaacgcggaaaccggcattatcggcctgctggccggtctgatcggcgttggtgccaccgtgctgctcaacttcccgatcaacatcgtgctgcaccacttcatgggtaccaccgaggtcagtgccgtgctgccggtcggtaatgccatcgctctggtgattctcagcgtagtgctcaccctgatcggcggcctcatcccaagtcgtggcgcctccaagcaggatcccgccaccgccctccgcaccgagtagaggcggtggatactagactgctgcgtatgacagagtttacgtcggcgcgtgacgccctacgcacctacttcggatatgacgccttccgtcctggtcaagaaggcatagtcaatgcgattatccaaggtcgtgatgcgctcggcgtcatgcccaccggtgcaggcaagtcaatctgctaccaaattcctgccacgcttcttccgggcatgaccgtcgtcatttccccgttgatctcgttgatgcgcgatcaggtcgacgcgctcaacgacgtgggcattccagccgcattcatcaataccacgcaaagtcccgacgaacaggatctggtgttcgtgcaggcgttgtcgggacggatcagactgctgtatgtggctccggaacgtttggaaaccgaacgtttccgcacgttcgccagtcgtgtgccgatttctctggtcgccgttgacgaggcgcattgcgtgtcgcaatggggccaggatttccgttcgtcatatcttggtatcggcgattttctgaaggcgttgccgacccgtccgacggttgccgcgttcactgcgaccgcgacggaacgggtgcgccgcgatattatcggaattctcggattgcgtgatccgtccgtcaccgtcaccggcttcgacagggccaacctgtatttcgacgtgatcaggatggaaaggaaacataaggcttcgtgggtggcttcgtatattgcggatcatcctgacgaatccggcatcgtgtattgcgcgacccgcaaggaagtggagtcacttgccgaatcgttgaatatcgccgtgcgcgagctgcgtgcggcgaaaggtgaggatgcgacgcgaatcggcacggtcgcggtcgcctatcatggcggtatgtcggccgaaacgagggatcgggcgcaacgtgatttcgtaaccgaccgtgtgcctgtggtggttgccacgaatgcgttcggcatgggaatcgacaagtcgaacgtgcgttatgtgatccaccataatatgccggaatcgatcgaagcgtactatcaggaggcaggtcgtgcggggcgtgacggcgagccgagccggtgcacgttgctgtggaatgaatctgatattgctacgaggcggaggctgcttgattcggattatgagaacgagcgtttgaccgctgaagagcaggaggttgtgcgtgcatcgaaacggcgtctgctcaacgctatgatcggttattgccgtactacggattgtctgcacgagtatatgaccaggtatttcggcgaggccgggggagcagccgtccgcgatgacggcgcatgcgtgggaggatgcgcgaactgcgggaatacgtttgaaaccgttgacgtcacggatatcgcgcgggccatcagccgctgcgtgcatgacgtgaaccagaaggtcggttcggggaagatcgtcaaagtgctgcgagggtcaaaagcgcaggatttaaactatcttcatcctgtcgatctgccgacgtacggcatgttgagcgcgacttcggaggtacagattcgtgacgtgctcagccagatggcgacggatggttttctttccatttcggaaggctccatgccgatcgttcgctttggtgaacgtgcggcggaaacggtagcgccgaattttcattatgaaatcaagaagatcgaacggaagcacgctacgaaacgtgcggaatcgccgtccgtaggctctcaggccatgggatcgtatgtgccgggcgacggagacgaggaattgttcgccaaactgcgcgcgttgcggcttgacatcgcccgcgaactcggtaaacccccgtatatcgtcttttccgataaaacgctgcgcgacatggtgcgtatcaggccggtcaccggcgagcaattctcgcaagtcaatggcgttggtgcgctcaaattggaagcgtatggcgaacggttcatggaagtgatccgcgatttcgttgcatgaatcaggtgacgtgtcagcttgaggaataagcgtatcgattattgcaaaatcatacgttttatatgatacgtaacacgttatcggcaacatgtatggcggtgaggttgacgtatgccggcaaaacggcgacagtagagacgaacagttgttgaagaaaggattgatgatggcagaagacaagccggttgtggaaagcttccagctcgaccacaccaaggtgaaggctccgtatgtgcgttatatcgacacgcagaccggtccgaatggcgatgtgatttccaattatgatttgcgtttggtgcagccgaatgagaatgcgattccgaccggtggcctgcacaccatcgaacatacgattgcggtgctgttgcgtgaacgtatcgacggttatatcgattgttccccgttcggctgccgtaccggtttccacctgctgacgtggggcgagcattccacggaagaagtggctcgcgcgttgaaggaggcgttggaattcatcgcatacgaggccacatgggatgacgttcctgccaccaccatcgaaagctgcggcaattaccgcgaccatagcctgttcacggcgaaggaatggtgcaaggatattctcgccaagggcatcagctctgacgcgtttgagcgccgtctggtctgatttgcgtgcgattgcacgtcttttttcgggcatattgcgaatactgtgccgtgggcatggtatttttgacgctcggaagaagacaaggtgatgcaaaggtgaacgagatgggtgaggagagcgtcattacctctgaacggcggttccgtcgcgccactatggctgatttgccgaccatgctgaagatttatgagcatgcccgcaagttgatggcctccaatggcaatcccacgcagtggggtgataagttccctcgtgaggaagtggttcgtgacgatgtcgaatcgcaacgcaccgtgttgctggtcgatacggttgatggcgaggaacgtgtgctcgcccagttcgcattgtgtccgggcatcgacccgacgtatgtgaatatcgatggtgcctggctggatgacgatccgtatgtgaccatccaccggatcgcctcgtcgggtctcgccaagggtgcggcgaaggactgcatcaactggtgcatcgaacattacggcaatgtgcgcgcggatacgcatcccaacaacaaggccatgcagcatgtgctcgaatcgaatggtttcgcgcgctgcggcttgattcagttgcttgacaggccgtccgacaccacgcgtatcgcttatcaacggcatgaatggtgagatttgcggatttatatggattgatatcaatcaatataaatttcagcacaaataatcgcaaataatcttcgatattgagaagcaaaaatcccgttgaatatcgtatttcagatgttcaacgggatttttatatccgattgtgttgctttcgatatatcttacgaaagatatatcgaaagcaaccgtatcgtcggtttttagaacagtcctggctcgttcaatgcggaatgcttgcggctgtacacgaaatacacgatcaaaccaagggcgaaccagattgcgaaacgcacccaggtttcccaattcaaaccgcaaatcaggatgaagcagaaaatgatcgcgcagatcggcgtgaacggcacgcccggggcgcggaagccgcggtgtgcgtccggctgggtcttacgcatccacagaatgcctgcggacacgatgatgaatgccgacagcgtaccgatgttcaccaattcgaacagcacgttgatgttgatgaaaccgccggcgatggccgttagaataccgaagaaccatgtacctttgaacggggtgcggtatttcgggtgtacttcgccgaagaacttcgggaacaggccgtcgcggctcatggcgtagcagatgcgggactggccgtacagctgcaccagcatcaccgtggtcatgccgatcagagcgccaagattgacaacgaacgccagccagttgagaccggtttcgagaatcacgccggccaccggagcgtcaatgaagttcgcgaactccttgtatggcaccacaccggtcatgatcagcgtcatgacgatgtacagcacggtggacacggccagcgagatcagaatgccgcgcggcagtgtcttgttcggattgatggtctcctcggcggaagaggacaccgcgtcaaagccgatgaagctgaagaacacgatcgacgcggccggaacaatgccgtacggctgcgtcgagcccggctggaacgtgtaaatgccgtacggggagaacggcttccaattggcgggattgatgtaccagacggtgcacacgatgaacagcacgatgatggccagtttgatcatcaccataatatcgttggttttcttcgtctggttaatgccgatggacagcacccaagtgatgatgagcacgatcacgaaaccaggcagattgaagtatgtggtcacgcctggcgtggtgccgtatgccgcagtcagttcaactggcagatgcaagccgaaaccttccaacagtttgttgaaatatccggaccatccggcggacacggtggccgcctgcaaggcgtattccaaaatcaaatcccagccgatcacaaacgcgatcagctcgccgaacgccaaatacgcgtacgaatatgcggaaccggacactggtgccatcgcggcgaactccgcatagcacaatcccgcgaaaccgcagcagaccgcggccagaaggaaggagatgcacaatgccggacctgcggtgagggcgcccttgccggtgagtacgaaaatgccggtgccgatgatggcgccgattcccagcatggtaaggtcaaatgttttcaatgtgcgtttcagcggagtcgactcggatacgagctggtccactgactttttgcgaaaaagatccatggtcttaattccctaaaaatggttttatatgggctggaccggacggatttccgggactctggcacgcctcaaacgccagaaatcaaagaagggctgaacgcctcatatacgggaggtgtacgcgccttatgtaaggagagtgtaaaaacctggcacggacaaaaccgtgaaaaccccgtgaatcgtctcgctaagtgtgcgcgcctttccgaagccgtcacgtgggagcgcaacaatagagccatgactttcaacgctgcccgtgaatggcaattctcatccgaacaaggcaaggccaattatgaggccgcccaaaagcaatatccggcgcaggccatcgtcgatatggccgcattgcgaaacaacatgcgtcatctggtgagcgtggttggcggcccgaattccggcaccgccgtgatgggtgtggtcaaggccgacgcgtacgggcatggtcttattccggccgcgctcgcggcactggcgggaggtgcgacctggctgggcacggcgcaatcacatgaggcgctgctgctgcgcaaggcgggcatcgggccggaccgctgccacattctgacatgggtatataacggcatggctgtgccttttgacgagctgatcgacaatgatatcgatatttccgtcggatcattgccgggcattgacggcgttgcggctgcggcgcgtcgtcttggaaaaaccgcacgtgtgcatgtgaaggtcgattccggtttcggccgcaacgggttcacgcccgccacgttcgacgcggcgctcgccaagctggtgccgctcgccaaggagggtgtgctgcatatcgtcggccagtggagccatttggcggtggcggacgctccggacgttcctgaattcgtggcatccaccgacagacagatcgagaatttcaaggatttcacccgtcgtatggagcaggcgggcattgcgccggagattcgtcatctcgccaataccgctgccacgctttcacgttccgagattcattttgagctgacgcgcccgggtatcggcctgtatggttatgaggctgatccggccatgggcacgccaggtacatacggtttgacgccggccatgacgttgcaggcgcagcttggtacggtcaaggatgttgaagcgggccatggcatttcctatggccgcacgtacctgactccgtccgatacgtccaccgcgatcgtgcctgtcggctatgcggacggcattcaccgttccgcttccggttttgatatggaaggcgcgaagcatgtggtcaagccaggaggcccggtgcgtgtgatgaccacggagggtccgcgcctctaccgtgtgtccggtcgcgtgtgcatggatcagtttatgcttgacctgcacggttccgcggaaaagcttggcgtgcatgagggcgacaccgtgcagctgttcggaccgggtcgcggagaggattatgccgagccgaccgccgacgattggggccgtgccgcaggaaccatcagctatgagatcttcacctgcctgtgcaaccgtatcccgcgcctgtacgagcatgcctctgacgtgctgtcggtcgaagatctcgccaaactcgatcccgcaaccctcctataaagaatcaggcgtgcgatgggaggcacgccgtgaaagtcaatatggtgggcgcggtacgttcgatggttggtcaacgtgccgcgcttgctgttaaggtggtgagctatgccaggaatgattctgaaggaagatatcgaaaaagttcgcgccaccgccgatttgtacgacattgtgtccgcaacggttacgctcaaaccttcaggaactggcacatacgtggggctgtgcccgtttcatgacgagaaaacgccaagcttttccgtgcgtccggcgctcggtgtgtggcattgcttcggctgcggtcttggcggagacgtgttcggctatgtggagcatcaggagaacgtcgactttcgtgatgccgtcgagcttttggccgaccgataccatatcgaattgcgttatgaccagtcgaacgccaagaaggagcataccggttcgaaacgtgcccgcctgttggaagccaacgaggccgcgcaggagtttttcgtctcgcagctgatgaccaaagacgcgctcgccgcgcgcaaactgcttgatggccgtaatttcagccaggccgattgccaacgattcggttgcggatatgctccgcaaggctgggataatctggtgcggtacttggcaggcaagggcttcacacagcaggaaatgttggacgcaggtttggcccgtcaaggccagcatggggtgtatgactatttccgtggccgcgtaacatggccgattcgcgattcaaccggacgcacgcttggtttcggcgctcgcaagttgtatgaggatgattcgattagcgcgaaatacattaatactcccgacacgcagttgtatcggaaaaaccaggtgctgtatggcattgatatggcgaagtcggcgattgtgaagaaacgtcaggcggtgatcgtcgaagggtatacggatgtgatggccatgcatttggccggcattgataccgcgatcgcgacatgcggcaccgcgttcggtgccgagcatgccaagatcgtgcgtcgtctgatcgccgacgattcgttgggtgcggtacagctggttggtccgttgaaggttgaaggacaggcgttgagttcgcgtatcgtgttcaccttcgatggcgatgcggccggtcagaaggctgcgattcatgcgttcggcttggattccgctttttcgacgcaggcgttcgttgctgtggccgacgacaatctcgacccgtgcgatttgcgtatcaagcgaggtaatgaggcggttcgcgcgttgatcgatcatgccgaaccactgtatgatttcgtgatcaaaaccgcgatcgggcgtttcgacaccacttataccactgggcagatgggcgcagtcaaggcggtggcgccgttgatcgcacagattcgtgaccgttccctgttggatttgtattcacgcaaggcggtgcgccagatcggcgtcgacttggatatcatgcagcgtgaagtgcgtgacgcacgacgcaaactgcaggtgcgggacgaagatgcgtacgctccgaaacgtcgttttgcaggcaatgccggagctgcggtggaaccgcgtatggaacaaggcacgaatccgtatgcgaatccttccgcgcggaaggcgttggaacatcgtgatgcggcggagcaatcctactatcgcattgatgatgccgtgttcatttgcgaacagcagttcatggcaaccctgattcaagtgccgcttgccgttgatccgacactgttcgccagtcttacgctgtcgagcttcatgacccccgtattccgcacgttattccaagcggtcgcggcggcggggggactgccgtctgctgataccccgcaaggattgtggatgcacaatctcaccaaagcgggtggtccgatgttggaatccgtcatcaacgagcttgccgtcatgccattgccgcttcctccgagcgatactgacgcagaacgtgcgtcgcaacaatcgcaggaaggcaacgtgcaattgcgcaagccgaccgatgacgaacgcagatacgcgtctgaactcatcattcgactgcttgacacgggcatcatgcgcaaaatcggcgcggaccagcgtcgcatggcgcaactgccggacggtgccgagaaaatcgagctgcttggccagattaccaagctggaaacgttgcgcaaggatctgcagacgagggtgttcggcaataacgtcgcctgaatatttggtgtgccggagcgtcaacccccgaacgtctttgtcgttcacctgaatttgccacatgcctgagtgcggtatgaacagccggcgaacgtgtggtgaacgcaggaagaatacttaacgaattcttggctggtgcacggtatccttcggcgtgttttgcaattgcaaaacagttttgccggtttgcaaagtcagggaacagtaaggcgcatgggctgaaaaacgttggaatggtcggaaaaatagtatgccaagggtatgtggtacgcgatttttcgggtaaagtgaatacggcgtttcttgagtaaatcgcccgggtctgcaaacggtttgcaaactggattcacggaggaatgaatgcgacgattggtcatcaaaatcctgaaaaacgagaccattctcgtagttgcttccatacttgctcttatttcatgctttatcgtgcctcctgacaaggagtatgccggatatattcatgccagcaccatttcgcagctgatctgcctgatgctggtggtgtgcggtttccagcgcatcggtgtgttccgcatcatcggttcgcggttgctgcatcatgtgagcaccgcccgcggattggtgatcacgctgatttcgctcacctatttttccggcatgctgattaccaatgatgtggcgctggtcacgttcattccattcgcgatcgcggtgctcaccatggctcacatggaggagcatgcggtgctggtcggcacgttgatgaccgtcggtgcgaacgtgggcagtatgttgacgccgatcggcaatgcgcacaacctgtatttgaaagcgttgacgggcatgccgtccgctgaaatgatcggcattatggcaccgtattccgttgctgcggcggtattgctggtggtcatcgtctgtgtggtgttcggtaagaaacctgtttccgaattttcctctatcgacggcagcggcatcgaacagaatgtgctcgctccgaattccgatcagccgcagccggatgagattcgtgtgaccggctacggcgcaggttacggtggttggcgcacgatcgtatattgcgcgctgttcatcgtgtgtttgctggctgtgagcgatttcattccgctatgggccatgtgcgtgatcgtggtggtggcgttcctgttctgcgatcgccgcgtgttccgcaatatcgactggggattgccgctcacgttctgcatgttcttcattttcatcggcaatatgaaacgcgtgccggaattctacgagctggccgcctccttggtgggggcgcatccgctggaagtgtccgtggtgtccagccagttcatctccaacgtgccgaccacgttgctgctgtcgggcttctgcgaccagtggcgtgcactgattattggcaccaaccttggtggcatgggtacgctgatcgcatccatggcctcgctgatcggatacaagaacgtgacgcgtaagtaccccgataagaaggggcgctatttggccgtctattcggcggtgaatgtgctgttccttatcgtactggtcggtttgagctggattatcgagccgtgaacccatgctccccggtcttgatgacttgcttgtttgggatcggggagccgttggttccatggttttgccgtcggtatgatcgctgctcagcgcgttcgagttggcaagaacgtgcgaactggctatactgattcaagtttggccctgtagctcagctggatagagcatgtgacttctaatctcaaggtcgggagttcgagtctccccggggtcaccatcaagcccttacgtcagtaggcgtaagggctttcgtatatcgataggcggctgcttcggctgtcgcttgggcagcgggaggaacccatgaagcgaatcgtcgcgggcattctggcgcatgtggacgcgggcaagaccacgttgtcggaggcgctgctgtacgctaccggccaagtacgcaaactcggccgcgtcgaccacggcgacgccttcctcgacacggacgccatggaacggcagcgcggcatcaccatcttcaccgagccggccgtcatcgccacgcccgacctcaccatcaccctgctcgacactcctggacacgtcgacttctccgccgaaacggaacgtacgctcgccgtgctcgactacgccatcctcgtcatctccggcgcggacggcatccaaggccataccgaaacgctgtggcgactgctcaatcgctatcaggtgcccacattcgtcttcgtcaacaaaatggactcgcccggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgttatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaaacggcaccgcgcacgccggcgacgcggatgtggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgccggcagtccggtcctccagccggtgctcacgtacacgctggaaccgggggagtgcgacattcacaaatgtctcgtcgccctacgcgaactggaggacgaggatccgctgctgcacgtcgtctggcagtctcgcctagaggaagtgcacctgcagttgatgggcgcggtgcagctggagatcatccagcagatcatgcacgaccgtttcggcctggacgtcacgttcggaccgggcagcatcctgtacaaggagacgatcgccgcgccggtcgaaggcatcggccatttcgagccgttgcgtcactacgccgaaacgcatgtgctgctcgaaccgctgccgcagggctcgggcatggcatacgccaccgtgtgcagcgaggacgtgctcgaccgcaactggcagcgcctcatcatgcagcatttccaggaacgtgagcatctgggcgtgctcaccggctcgccgatcaccgatatgagaatcacgctgctgacgggccgtgcgcatctgaagcacacggaaggcggcgatttccgtcaagccacgtatcgtgcgattcgtcaggggttgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtccccgaattcatgcacctcgactacgcctggcacggcgaagaggcgtaaaacatgtagataggctgccgacgccggactgtgcaaagttctgcgtgtcggcagtttttttttaaaaaaaaaacgcgagtggagtagatgtgtgagaaaaagaaaaccccacacgaggtggggcttggtggagcggacaacgggactcgaacccgcggtctcaaccttggcaaggttgcgctttaccaactaagctatgtccgcaaagaacttccgccgtgagaagcggaaattcagtgggtgatataggaatcgaacctatgaccccttccgtgtgaaggaagtgcgctagccgctgcgccaatcacccgtgggataattccaccggtttcccggcttcgttacccgcttcgcgtgggcgatacaagattcgaacttgtgaccccttccgtgtcagggaagtgcgctacctctgcgccaaccgcccgaagcgagtgctagcttacgtggattctcggcggaatgcaaatcgtcggcgtgtcgcggttggttgggcgggctgcgacacgcgcgtcaatcagtaagtggcacgacggggatctccatggtgatcgcatccggatcagtgtcgccggaggcgttggaatcattggactcaccggtggtgtgggctaacgtcagacgcatctgatgccaagccacattgccgtgtgtggaagccgacatgccttcgtccatgaatcccaagcgggagtaaaagccaacaagacgttccttacaagtcagcacaatgcctttgcgtccggcaatcgtcgaatcaaggatcacacgacgcagcagatagctggcgcaaccgcgatgctggtagacaggagccacatccacgccgaaaatcatctgccaatcaccctgctcgtcatgcatggaaacatcctcatacatgacatcagccaaatctttctcattggtcgtcatgccattgacgaaaccaaccaacgtgccatcttccacggaagcggggaagcaggcgtcgtcatcggcgtcagtgttgatcaaaagccagaaatgttccggatatgtggcgacgcgtgcggtcaggctctcgttcgttgcggcctccgcaggcgggaagcaggcagcctccacagcctcaatcgcgtccaaatcctccatcgttgcatgtcgaatgagcatgtgcatactctctcgcaaggcatacccaatcttcacatttcgatatgagctgacggcggaaagcgccgacgtgcaatactgtggcaaggattaccgggaagcatttcttgaaggttaataaacgcttatacgaaaaaccgataacgacgtggcctgttccgtgattatcgcgcggtacgatggggcgcgttcaaggctaaagcttggaaacagcctgagaaggcttcaaacgatccgcagaacattcgaaaacctagcgagaaagaggggaggcgcgtgtgttcgactggacattcgtgacgcactacgcgccgttcttcgtcaacggtgcggcgatgacgttgttcatttccgtattcggcatcgtgctttcgattgtggtcggtctcatctgcgcgggcattgaaatcgcacgcatcccagtgttgaagcagattgtgcgcgtctacatcgaactcagccgcaacacgccgttgctggtacaactgtatttcctgtatttcggtctgccgaagcttggcgttgtctggtccgcggaacaatgcgcgatcgtgggactcggctttctcggcggctcctacatggccgaagcgatgcgtggcggcctcgaaaccattccgaacgtgcagcgcgaatccgcatacgtgctgggcctgagccaatggcagaccttgagccgcgtggtgatcccgcaggccatcggcacgtccatcccaggcattgtggccaacgtgatcttcctgatcaaggaatcatccgtcgtgtcggccatcgcgctcgccgacgtgatgtacatggccaaggatctgatcggcatgtactacagcacgtacgaatcgttgctgatgctggtcgtcgcgtacttggtgattctgctgccgatttcattgttcggcacttggctggaacggaggttcgactatgagcggcgctgagattctgctcgagccgggcgtgttcccgcgcctgctgcagggcctgtgggttacggtatggatcgccggcgtttcggtgggtctttccattcctgtgggattggtcgtcggctggctgatgacgatgaaaaatcccgtcatccgtgtgctgaccaggatttatttggatttcattcgcatcatgccgcaattggcgttgctgttcattgcgttttacggtttcgcccgtgcgtggaattggaatttggatgcgaccggcgcatgcgtgttcgtgttcgtgctgtggggcggcgcggaattgggcgatttggtgcgtggcgcgcttgagtcgattccgaaagcccagtatgagtccgcgtatgtgcttgggttgagtggctggcagacgttcgtcacagtgattctgccgcaagcgttgcgtaggcttctgccggcttcggtgaatctggcgacacgaatcgtgaaaacgacgtcgttggccgtgcttctcggcgtggtcgaggtcatcaaagtgggtcaacagatcatcgacgcgaaccgtttccaatacccgaccggaaccctgtggatctacggggtgattttcttcatgtacttcatcgtgtgctggccgctgtccatcgtggcccgccgactggaaaagaggtggtcgcatgactgacgcagcgggcaagcagactcaggcaggccaagcaagtcttgggattgcgcatttggtcaagcagtacgccaatgccgacaggccagtgctgaacgatatttcgttcgacgtgccgcatggcaaggtgtttgtgatcgttgggccttccggttccggcaaatcgacgttgttgcgcaccatcgcaggccttgagccgattcagggcggcaccatttcgctcaacggcgaagtgatcgaaacgggcaagccgggcactgagtccgctggacgcagcaagcgcagcagcgaactacgcacccgcgttggcatggtgttccaaagctacgacctgtttcccaacaaaaccgtgcttggcaacatcacactggcgccgaccttggtgcagaagcgagataaggccgcagtcgagcaggaggcgatcaggcttctggaacgcgtcggccttgccgaccgcaaggattcctggccgcacgagctttccggcggccagcgtcaacgcgtggccatctgccgtgcgctgatcctgcatccggaagtgctgctgttcgacgaagtcaccgccgcgctcgatccggaaatggtgcgcgaagtgctcgacgtgatgctcgaactcgccgattccggccagaccatgctcatcgtgacgcacgaaatgcaattcgcgcgagccatcgccgaccaggtgatcctgcttgaagatggcggcattgtggaacggtccgacgatgccgaacgattcttcaccaatccgaccaccgaacgtgccaagcagttcctgcatacgtttgaattcgaccggcatcgcaagtccgccgagcaatccgaacggtccgaacagtagcgcgaaatagtgcgaatcggcgaaacccaagattttgatagcagtcatctttgcaagagaggagaaaccatgaccgcatcaatcatcaacaaaacattcaagagcatcgtggccgcatcggccgcgttgatcatggcagcctccgtggctgcttgcggtccgtccgcggccactccgagcgacgaaggctccacgggtagcgattccagttccagcagcagcgccaccgcccgcactctggatgagatcaagaagtccggcaagctcaaggtcgccgtgttctccgacaaggctccgttcggctacgtcgacaaggacggcaactatgccggctacgacgtctacttcgccgagcgcttgggcaaggatcttggcgtagacgttgaatacacctccgttgacgccgccgcccgagtcgacgtgctcacctccaacaaggtcgacatcacgctggccaacttcaccgtcaccgacgagcgcaaggagaaggtcgacttcgccaagccgtacatgaaggtggcgttgggcgtcgtttccccggaaaacgccgaaatcaccgacgttgaccagctcaagggcaagaccctgatcgtgaccaagggcaccaccgccgaaaccttcttcgagaaaaactaccccgacatcaagctgcagaagtacgaccagtacgccgatgcctacaacgcgctgctcgacggccgtggcgacgccttctccaccgacaacaccgaggtgctcgcatgggccaagtccaacaagggcttcaaggtcggtatcaccgaactgggcgataaggacaccatcgctgccgcagtgcagaagggcaataaggaattgcttgactggatcaacgacgaaatcgacaagcttggcgatgaaaacttcttccacaaggattatgaggagacactgaagccggtgtatggcgacgaagtcgatcctgatgaaatcgtggtcgaaaaaggtgtggtcgactgataactagttaatcaaactaaatattttgaaccttccgtcgcttcaggcggaaggtttttctatattcacataatcatatttacatacaaatatatgattgctgataacgctatataaaaaacaattattacgattcgcgccttccataaaaagcgtatatagccacgccgatgttgccatgttgtttttccgatatcttgtgattgtcggcttgaaaaacaagcgagatgttttacgagagaggagcgcggaacatgaagtacgcagtgatcggtgccggcggaatgggcatccagtacggtgtgctgctgcaggaattcgcgcacaaagacgtcgacttcgtcgatacatggaagccgaacgtcgagaagatccgcgagcagggcggtgcctacgtgtcgcaagacggtgaagaccgccatctcgtgccgatcaacgtgtactatccggaggaatacgccggccagccggacgtgtggatcgtgttcctcaagcagatgcagcttgacggcgtgctcaagcgctgcgcccatctgttcaatgagaagcagatcgtgttctccgccatgaacggctatggacacttcgaaaagctcaacgaatacttctccacagaccgcatttacggcggtaccgcactgatcggtgcctacgtgtacggccccggcgatttcaacttcaccggcggagtacatgccaaggccatgaacctgtgtgcctacgcggatgatgtgactgacgaggtgcgcaaacacgagcaggcgctgtacgaggatttcgcaacggccacgctcaacccgaccatcgtggacaacttcatcggcatgtgcatggcgaaaatcgtattcaactcggtactgaacacgctgtgtaccatgtaccagattcgtttcggcgaattccatgcgcatcccgacgcacgctggctcaccgaacagctggtcgatgaagcctacagtgcggccgaagcagccggataccaactgttgggcacgcgcgaaacggaagtcgaaaccattctgcacaccgcgggcgtggcacatccgctgcactatccgtccatgtatcaagacctgaccaagggacgtccaacggaagtcgactacatcaacggctatatcgccaaagtcggacgcgagcatggctacgaatgcaagctgcacgaattcctaacccgcgaagtgcatctcgccgaacaagccttcgccatccacaatccagacatcgtcgcacaggccaaagccgacgtcgaagccagtaagccggtaacggaataatcgtattttttcaaaacaagtaggagagggaaaacaaccatgaccatcgctattttcaagaggccggacggcatcaaacgaatcgttgcagcagtacttgccgctgcaacacttatttccgttgcggcatgcggttccggcaacggcgcatccgcatccaaggaaagcctgaacaccacgaagggcaaaaccaccacaatcaccgtcggcgtgtgcgcaggaccatacggcgacatggtcgacaaggtcatcgcgccactgctgaaagatgacggtttcaaactgaaaaccaagctgttcaacgattatgtgcagcccaatcaggcacttgcatctggttccattcaggcgaatcttttccagcatggcaattatctgaagaagttcaccgccgacaacaatctcgacctgaccgcccttggacagaccccaacccttggcctgggcatctattccaacaagtacaagtccatcgatgacatcgaagacggagctacggtcgcaatcgcgaacgatggctctaacctggcacgttctctcggcgtgctccagcagcagggtctggtgacgctcaagggcgaagtcgatgccaccaaggccacggtcaacgatatcgcatccaatccgaagaacctcaaaatcaaaacgatcgatgctgcacagctggcccgttccttggacaccgttaatgtggctctggtgccgggcaactactcttgggctgctgatctgaagcctgccgacgcgctcgccatggaaaagcaggatgatggcgtgatcgaagtgttcgtggtccgtacccaggacgtcgattccgacttcggcaaggccgtcaagaaactgctcgtcagtcagaaattcaaggacgccatcgccaagagcgagttcaaggatttcggcaagccgaccacttggtgaccgctgcagcgcggcgataggtaatatgcaaaggcccgtatgaattgggaaactcatacgggctttatgcaaacgagattcatcaaacgaaacgtatcaaacgaaacgtatcgaacgaaacgtatcgaacgaacgtaaacacgtacttgaacggaatgaggaacgaaccatgagcgttattgaactcaacgacgtgtccgtgacctttcatgaaggcggacgaaccgtcgaagcggtcaaacatgtgaacatcagcgtggaaaaaggcgaaatcttcggcatcgtgggcttctccggagcaggcaaatccacgttggtgcgcaccatcaacctgctggaacgaccgacgggcggtcatgtggtgatcgacggcagcgacatcaccgcactcaaaggcggtcagttgcgcgacctgcgcaagaaaatcggctttattttccaaggattcaacctgatcaccaatgtcacggtcggcaagaacatcgaattcgcgctgaaagccggcggatatccgaaagcgcaatggtcggcacgcatccgcgaactgctggcactggtcggtttggaaaacaaaatcgacagctacccgtcaagcctgtcgggcgggcaaaaacagcgtgtatccatcgcacgtgcgctcgccaacaagccggaaatcctgctgtgcgatgaagctaccagcgcacttgacctggaaaccacggaaggcattctggcgcttctgcaacgcatcaaccgcgaactgggcattaccatcgtgttcatcacgcatcagcttgacgtggcgaagcagattttcgaccgagtggccgttatggaaaacggtgtggtagtggagcaaggcaacaccttcgacgtgttcagcacgccgaagcatccgaccaccaaagcgttggtggaacgctatctgggcattgcggtgccgccgcagctggtgccgtcgctgccggccggcaccatcgtggaactgcgatacaagggggatgcggcactcgaaccgctcatcagccgggtcgcgcaggattacggcgtgagcatcgacgtgctgcatgcgaatgtggagtatttcggttcgcaggccatcggcattctgattgtgctcgtttctggcgcgggggagccgctggtgcaggcgttgaatacgttgagaacgcatgtgttcagctatcgggaacttgatcgtgggcagctggttgtggccgccgaagctgcggataatcaggaggcgtgagaacaatggaagaaactctggaaatccttcaagacaatctcggtcaggcgttgatcgacacggcatacatggttgtggtgtcggcgattatcggcgtggtgttgggcacgttggtggcgttgctgctgtatttgaccgaaaatcgtttgttcacgccgaatcatgcgttgaacgttattgtcggtttcatcgtcaacgcgattcgttcgctgccgttcctgattctcatggtggtgcttattccggttgcgcaattgattctgggtgatccttacacgccgacaggtggcgcaatttccctgtcgatcgccgcggtgccgttctttgcgcgaatcgcggaaagcgcgttttccgaagttgatccgggcttgcttgaagctgccatctccactggtgccaccacacgccaaatcattgtggatgcggtattccctcaggccttgccgtcgttcattcgtggtgtggtgctcaccattatttcactgattggctattccgcaatggtcggaacgatcggcgctggcggcatcggcgatatggccattcaatacggctataaccgttacgaaaccggcgtgctcgtcgtgattgttattattctgatcgtcattgtgcagatcattcaatggatcggcgattggttcgcacgcaaggtgacgcactgatggttgcgtatatgcgtgaatgtgcgcatatacagtcgcacgatgatagggagggttgatgaatgacttcgtatgtttctcctgttgcgttcactacggtggcgcagtcgattccgccgaatgtgttcgccgatatggatcgcaaagtggctgccgcggttgcggacggggccgacgtgatcgacctggccaaaggcaatccggatgcgttccccgctgacttcattcgagaagtggccaaaaaggcggttgacgatccggccaatgcccggtattcgccgttcgacggcaaaccgagttttctgcaggctgccgaacagtggtatcgcaatacgtacggtgttgaggtcgattggaaaacccagctttttgccgtggagggcgcggttgatggtctcgcggcgctgttcgcggtgttggtctccccgggcgacgctgtggcgtatgcggatccgtattacccctcgtatcattgcatgacggtgatgagccaagccgaggaggttctgctgccgtcactgccagagcgcggcttcctgccggacttggatgcggtgcctgcgcaagtgtggaatcgtgtgaaagtgctggtgctcaactatccgaacaatccgacgggtgcgcaggctccgcgtgggtttctgcaacgtgccatcgatttggctcatgaatatcatttcgcgatcgtgcaggatttcgcttatgcgggattgggggtcgatgcgcagcaaatcagcatactgtcgctgccgggtgccttcgatattgcggtggaagtatgctcgctgtcgaaaatgtatgcgatggccggctggcgtgccggtttcatcgcgggcaacgacgacattgtgtctcatgtgaagcagtaccactatcaaatgggttccatggttacgtccagcattcaagacgcgggcactgtggcactgctgtcggatcagagctgtgtggccgaacttgcggaacggtatgcgtctcgtcgcgaaatcgtggcaggtggattgcgtgaagccggacttgatgttttcgattcagacggtggcatctacgcttgggtgcacgctcctgaagatcagacgggtgaacaatttgccgacacgctgctggaacgtgcggccgtcgccgcgctgccgggcacgtgtttcggcaaagtaggcaaggattacgtacgattcagcctgcttaaatccgaggaccagttgcgtgaggctgtgcgccgggtgactgctgtgctagcgtaatttttcctacgtagccttttggcatggatgagcgattgcgtgcttgcgcaatcgcttttcctattttcctccgattgtttgcgatcgtctttcgatcggttgtggacgtcccatcctccaattgccatcgaaacgtctttcccttaggaaaccgacacacgctccttatgcaggcgacgtttttgcgattgcggtgcggtgtcttgcatctccgccgtttgatagctgcttacaggaaaatgttatggcgattcgcgcgttctatagccaacgttgataaggtgcggcgcgcgttgaaatgcaggatgcggtttagtgggtaccagcgaccgcgtgaatggcacgcggcaatgaaccacaacccaagggggtgcacatcatgaccagattcaacactcagtttgtccacggactgccggtcaacgataacaacaccggagccgtgaacccgccgactacgaagcgcttgatgccgctgtttccgggcactccgccaagggacccgcgcatggttgtccggcgaaggccgtgtatttcgaagttcttaccaatccgttgctgcaggtcaacaatgtgacgaagattgctgaaatcgctcatcgctatggtgcgatttccattgtcgacaacacattcgttaccccgtatctgcagctgccgctcgaccaaggtgccgacatcgtcatccattccgctaccaagtatctggccggccattccgaagtcaacgccggtcttgtggtggtcaaggacgacgggttgggcaaacgtgtctacttcgcgcagaatcgtttgggtggcgtgcttgcgccgaacgaatgcgattcggtgcgtcgtggtattcagacgctcgccctgcgcatggaccgccagcaggagaacgcgcgtgcgatctccagctatctgttgctgcatccgctggtaaaatccgtgcattatccgggattgtcggggcatgagtatgagatttggacattgttcaggaagttgcggatgaggtgacggtaatgaaagacggccatcttgtcgaatatggagctgtcggttccgtgttacgacaccctaaagatgcgtatacgaagatgttgcttgaggcatcgcctaaatttgatgagattaatgcctcgtaaggagtgattttatgattgacaatgcggcaattgatttctatggagccgactggtgcggcgactgccatcgagccaaggcagcattagaccgtttcggggtcgcctacagccttcatgatatcgagcatgaggatggtgctgcagagaaggccattgcgatcagcggacaacagcacattcccgtgattcggttcgccgatggctcatggctggtggagccttcggccacgcagttgcaagccaaatgcaaggaactcggcctgatctgattcaacattgcgtatgccatctcacgagtcggacaaggagaattgtctcctgttcggctcgtagacgtatgtgggtcggcttccggacggtcgatgtccggcttccgaatggactttgcccaactcgcggacattatctgcacgtgattgcattctttggtaagtttttgcttggggtcggcaatggttgcagaacctacggaaagccgtcaatcaacaggctttcgagagaaaaccaaagaagggagtaatgtcatgccgttccttattacgctccttgtcattgcacttatcgtcgcgttcctgttcctgtccacgttgtttatcgtgccgcagcagcaggcctatattattgagcgtttcggcaaattcaacaaggtgcagttcgccggcattcatattcgaatcccgttcgtggaccgtatcgccatgaaaaccaacatgcgcgtcaatcagcttaatgtgcagttggagaccaagacgcttgacaatgtgttcgtcacggtggtggcgtccactcagttccgtgttgacccgagcaatgtggccaccgcatactatgagctgcgtgatccggctggtcagctgcgttcctacatggaggatgcgctgcgttccgccattcctgcattgtctttggacgatgccttctcccgtaaggacgatgtggcctttgacgtacagaagaccgtcggcaacgaaatgtcccgcttcggtttcactgtggtcaagacgctgatcactgccatcgatccgagtccgcaggtcaagaacgccatggattccatcaacgctgcccagcgcgagaaggaggccacccgtcagcgcgccgaagcccagcgtattcagatcgagacccaggcggcagccgaggctgagaagacccgtcttcagggtgaaggccaggccaactatcgtcgtgagatcgccaatggtatcgtcgaccagatcaagagtctgcaggcagtcggcatgaacgtgaacgacgtgaacaatgtggtgttgttcaaccagtatctcgacaccatgcgtaatctcgcctcgtcgcagaatgcgaagacggtggtgttgccggcttcgacgcctggcggtttcaacgagatgcgcgaccagatcacccaggccatgatgtccgcggacgaagctgcgaaatagtcgcaaaatagccgtgccgatgctctgcatcgatgacaagatgaccttcgtattcgtgttgtgcgaattcttgcgccaaagtgctttttccaacacgtcgtgctccctcaataataagcatggcgcgcttgccattcgacgggcttttccaagccatgagtgtttgatatgccttgcgcctgaagagcatggtgtactccttgaaaattaaggcatttacacgaaatgcagagtaaggacagcgcgttttatacacgaaatgcagagtgtcgatacggggcgaggatgtttcgctgacgttccagaggcatgaagaatccctcctttcgagacggccgcttatatgtgacggagagcgcggcggtgaaaggagggattattgtttggcgcgttgccgtaccgcaacgcacgtctatgtgattggcctgtcggcaatgaccgtgttttgcgcacgcatgtcatacgtttcggcgtatgtcacgccatgctgacaagaccttccttggagtttgaattcggcagtgagcagttcatcgcatgtgattcaagcaggtgaagctgtttctgcaggtccatgactttcttttccagccatttgatggtcatggcttgggtgatcaccagcagatcgcgctgcccggaatcggatttgtttgccaacgtctgtgcttcaagcatgattttcggatcggctttccaacgggcgatcgcgcgttcgatgcgcttgcctcccatgattttcggatcaagacctgcgctggcgaaaatactggtaggaccgttgccgcgcagatattgcgccatgcaacgcacctgaaattccttcgagtacgtgatgcggtccatggaagctcgctccaccgcgggcagggtgttcaggtaatacacctcggtttgagtaaaacgacgacgcatgatggttccccttgtgtggtatgcggatgacgcttccgacaacgtcatccgaatgtctgcctcgttgttttcattctatttttgcgagattcggggattttgccgtctggcacgaaacgaagtgtttttggcacgaaacgagaaaaccaccctagttagggttgttttaggaggatgtgagacggggggtctgtgcttctcggggtattcccctaagggatgcagggaactggaaaacggtataaactcggttgtgggacagacgtattgacgccgtgtgggggagggcaatgaagactatgacagatcatgaagggcaagagtcgatggcggggacgcgcagacccatcatcgaagtcaagaatctgcgtaaggaatatccggtgctcgatgaaaccgtcgtggcgctggaacgcatcaatctcaccattccgcaagggcagatctgctgtatctacggcgaatccggttctggcaaatccactctgctgaaccagctagcaggcatggaaaaaccgaccaaaggcggcgtgcgcatcgggggagtgcccatttctcggttgaatgaacggcaattggcggaatttcggcaaaaacatcttggtttcgtattccagtcatacaacctgcttcccaatctgactgccgtggaaaacgtggcaatgccgctgatgttccaaggcatgccgaaaaacaagcgtgaggcaatcgccaagaaaatgctgaaacgagtagggctcggcaaacgcatgaaccactacccgacgcaaatgtcgggcggacagcaacagcgtgtcggcatcgcgcgagcgttcgcagccagaccgcaagtcgtattcgccgacgaaccgaccggcaacctcgactccaaaaccaaaaccgacgtgatgaacatgatctgcgcgttcgctcgcgacctcgaccaaaccatcgtgctcgtcacccacgatgacaatatggcgcaatatgccgaccgtatcgtaacgctacttgacggacgcatcatcgatgaccgtctgatgaacaacgcgtgacggcagagaagagaaggaaattccatgagtaacagcaaccattccgcaaaattcatcaacatgctcatcgcattgatggcgtccatcgccatcgcgctgacctgcattgtgccgacggcgctcgccgaagacggtgatggcactgacgacaacaacggcggctccaccgtgcagccggccggtccggtgccgaacatcatcatcaccaacttcacctatggcgacggttccgtggcggtcggcacgaatttcgatcttggcttcaccttccagaatatgggcaaggtcgcggtcagcaatatggtcgtgaccgttgacggcggcgagaatttcgccatttccggcggtacgaacacgttctattacgattcgctgtgggcgggctattccctgacccagaccgtgcccatgcaggtgctgtcgagtgcgaagaacggcgcgcagggcatcgatatcaacttcaaatacgagtatgtcgatggcggcacccgcaattccaacacttcggatatcaagatttccgtacctgtttcgcagcccgaccgtttcgaactgggcgatcccgtgcttccagacgccatcaatgcgggcgaggaatccaccatttccatggaatacgtgaacaagggcaagggggatgtatccaatgtcgaagcgtccatcgagggtgacggcatcaccgccacgcaagccacgcagtatatcggcaatgtggcgtccggcgcttctggttccatcggattcgctttcactgcggatgcggccggcgaatatgatgccaaactgaaggtgacgtacgaggatgccgacggccagcagcagaccaaggaatcgccggtgaagattacggtgtctgaggctccggctcccgccgatcccggtatggatgttgacccgcaggaaaatcaaggcattccgacttgggtgtggattgccgttgccgtggctgtcgttgccgtgatcgccattgtggttgtggtggttgtgcgtcgccgcaagaaggcgaagaaggctgccgaggatgacgattgggattgggatccctccgattcgcatgcaggtgctgatgatggtgcggctaatacggctggtgccattgacgcgccgacccaggtgattgattccgtgccctccgacaaggagtgagcatgcgattttcggatattgcacgttcatgcacgcagaatctgctgcgtcgcaaatcgcgtacgattcttacggtacttggcgtgatcgtcggctgctgttcgatcgtgctcatgatttccattggccaaggcatcaacgaacagaacgagcagatgctcaaaaacatgggcaacctgaacgacatcaccgtatatgcggacggcggaggttcacattccacggcaacgtcatccagcgtgagcggtgccgacggcgaacaggcgaaactcgacgatgacgccgtgcagaatttccgcagcattgccggtgtggctggagtgcttcctcagaaaacgatgtcatacagtgtggatgccacgcaaggagctggctcccggtacgtgtcgcaatatgtcaacgtggtgggagtcgacgccacgcaattggaagaatccggctataaattggccagcggacgtcttccgatgcgtgccggcgaagtgttggcgggcaaatccttcgtgtattcgttctacgacaagtatgcgtcagatccgagcaatcatcgtatagaagcgggcggttattactgcgatgagcacggttgcgcccaatccgaaggcgaagacccgttcttcgatatgctgaactccaaaatcacgttgattaccggagccaactatcaaagtcccgacgactaccacaaggtgggcggcggatccgtggcgccatccgattccggcagtggtgagagtcccaccattaccatgccatacacggtggtgggtgtcattgattcctccgccaacaactatgatgcgttcacttccggcattgtgatgagcatcgacgatatgaaaacgttgaacgccaaaatatcgggggacaccaaggccaacacgtcgagcaaggtcgtttacgatcaggtactggtgcacacccaagacatcaaagacgttgccgacgttgaagtgcaaatcaagggcgccggttatcagacttcctcgtttgagcaaacgcgtaaggagatcgaaaagcagtcgcggggcatccagttggctttgggcggcatcggcgcggtgtcgttcttcgttgccgcgattggtattgccaacaccatgattatgtcggtgtcggaacgtacgcgcgaaatcggcattatgaaggctcttggctgctatgtgcgcgatattcgcatgatgttcctgtgcgaggctggtgcgatcggccttgtcggcggtgtgatcgcttgcttgatttccgcgattggttcgataggcatcaatatggcgtctttgggtggattcagcattgagaatatcggcaaagcgattatgggcggcgacgatgtgactcgcatttcggtgattccgtggtggctttttgtggtggccatgctgttttcgatcgccgttggtgtggtagcaggtttcggcccggccaataaggctgtgaagattcccgctttggatgccatcaagaatgatcagtgattgctgattacagatcgctgatttatagattggcggggaatggtccacagatataccgatcattcccgccaattcgcttatgtatcgattattcgctgagaataccgcggattcgagagacgatggtttctgaagtcaatccgtaacgttcgttaagctcgccaagaggcactcggtcggtgaactctttggctgcgccgaaattcagcacacgaacgtgagaagccttggtattactggaattggcataaaatgcggtgactttctcaccccatccgccttctagctggccatcttccaacgtaacaaccaaacgatgcccatcggcaagcatcgccagtaattcggcatccatcgtggaatattgcaatgcgtcaacaagcgttgcggtaatcgcagcatgttcttcatcattttcggccagtgccgacgtaatttcggcagccaacggcatggtattgccgagtccaagaatcgccacatccctgccgggctgaacgatctgatagcgggcgaacgggcatgctccggcaatattgacggctggatcatgctcttcggcacgctgcaacgggtcgaacgccatatcggcggcacgttcaagtgcgagaatctgctcgccgggcatacgaatcgccactacgccatgtccggacgggccggtagcccaagccaacatgtcaagcatctgttcgccgctcgcgggagccaaacaggtcacgtcgggaacattggcgaacatcgtcatatcgaatgtgcccgaatgcgtattgtccgcgccggaaattcccgcgccgaaaatcagcagcgtggcgggaacatgattcaatgccaactcttgctgcagctggtcgaacgtgcgttggaagaacgtggcggaagtcgcaagcaccgggcgtccgccagccctggcgatacccgcggcgaatgcggcggcatgttcttccgtgataccggtatcgacgtagtgggcgccggcacgttcacgaaaatctcgggtgatgccattcgatccgggggttgcgggggagatgaccaccaatcccggctcattgtcgaaacgacgttccagcgatgccatggccatttcgccataatatttgcgtgcgtcgagcggtttgccgagcgaggcctccggatcctgccaatggttggcctcgcattggcccgcatgaggttgaggattggtctgattgcagccatccgaaccattgtcggcttccgtttcgtcattgaagcccaagcctttggtggtgtggatatgcactacgatcgggtggtcaatgtctttgacctcgttcagtacttccaccagcgcgtcaacgtcattaccctgctccacatagcggtagtccaagccgaatgccttgaacagattcagttcggccatgccattcgacgtacgcaacttggcaagctgcccgtacataccgccgaaatcctcagcgatcgacatttcgttgtcgttgacgatgatgatgagattaccgccctgttcggccgcattgttcagcccctcgaacgcaatggccgaactcagggatccatcgccgataatggcgataacattgccgatagtgctttcgccggcggcgccgcgctgcatatcgcgggttttggcaagaccgcaggccagagaaatcgaagtgccggtatggccgagcacaaaggaatcatgttcgctttccagcggattcgtgaaaccggtcacctcatcaaaacgagattggtccaagtatgcttcggcgcggccggtaagcattttgtgcacgtagctttggtgcgacacgtcgaaaatgaaacggtcgcggggcgagtcgaacacgcggtgcaatgccacagtgagctccaccacgccaagattcgagccgatatgcccgccatgttttttgccgtagtcgagcagcgtggcgcggatttcgaggcatagatcgcgtaattgctgggctgaaagggcatgtacgtccgccggagtgtgaatcgaactcaaaatgccagcggtcatcgtgcgcaatcacccttccctacgatcagtgcaaccaagtgcgaaatcatatcccactgtatgccccgacgagggtgtttgcgggcaaaggagcgcaaagtcttctcaacttgaggcacaatagaggtgtttgcaatcgtgaaaagccgttattcgcaaaggagcgcgaacatgaaagccgtatatgccaccggaacgaattatgatgatccgctgtccgtgcttgaagtgggcactatgcctgagcctgaaaccaagccattctggtccaccattcgtgtgaactcggcgagcgtgaaccatcatgacgtgtggagtctgcaaggtgtggggctttccgacgagcagacgccgatgatcctcggcacggacgcggctggcgtgttggaagaagacattcccgtacgaaagggacttaaggccggttccgaagtggtcttgtataccttcgttggtaccgatggcgccggtgtgatgccgggggagagacgctcgatcctgtccgaacggtatgcgggaaccatggccgaatacacacaggtgcccagcgccaacgtgttcgccaagcccgcgaatctgaatcttgatgaggctgccgcattgggtaccagctggcttaccgcatattccctgctgttcgcatcggcgaatgtgaagccgggagacacggtgcttattcaaggcgccggaggcggcgtgtcgaccgcggcgattcagcttgctcacgcggccggattggaagtgttcgtcacgtcacgaagcgaagacaagcgtgcgcgagtgttgcagctcggtgccgatgcggcttttgaaacgggtgcgcgactgccacgcaaggcggatgccgtcattgaatccgtcggcgcggccacatggagtcattccgtcaaatccgtacgtccgggaggaactatcgccatttgcggcgcgactactggcgaccagccgggtgcagagcttacgagaatcttcttccaggatattcgagtgcagggcaataccatgggctcccgtgaggatttcgcacgtttgctgaaattcgtggaacatgccgatctgcatccggtcatcgattccgcatatgcgatcgacgacgcgcatcttgcgttctccaagatcgtgaatggcgacgttttcggaaaaatcgtgctgcacatctagccgattgcgtaaagtaaacggtgttcaagaacatgttcttttggattctttcggaggtccttgatggcagacaacaagcctgaagtcgcagtgattatggggtcggcgagcgattgggaaaccatgaagcatgcctgcgagatgcttgaccagttcgaagtgccgtacatgaagcaggtgatttccgcgcaccgcaccccggaattgatgggcgagttcgcgcatagtgcccgtgccaacggtctgaaggtcatcatcgccggagccggcggcgcggcacatctgccgggcatggtcgcggcccagaccaccctgccggtcatcggcgtgccggtgcgttcccatgcgctgtccggttgggattcgctgctgtccatcgtgcagatgccaggcggcatcccggtcgccaccaccgcagtcggcaactccggtgccacaaacgcaggtcttttggctgtgagcattctgagcaccaccgatgagcgtttggccaatgctttgcaggaatatcgtgactctctgaaggaaaaggtggctgaatccaatgcccagcttgtctgaggaaaccaatggccgtgttgaacgtctgatgccaggggccaccatcggcattatcggtggcggtcagcttggccgcatgatggcgttgtccgcccgctacatgggcttccgcatcggcgtgctcgacccgactccggattgcccgaccgcacaggtggccgacttccaagtcactgccgaatacgacgacatcaccgcgatccgagaactggctgaaaagtccgacgtgctcacgtacgagttcgaaaacgtgaacgccgacgccatcgacgaagtgcgttccttgtctgcagccccgcaaggcaccgatttgctgcgtgtcacgcaggatcgcgtcaacgagaagcagttcatcaatgatcatggcacgccgaccgcaccatggaaggccgtcaacagcgttgaggagcttgatgcggcgctcggtgaaatccattacccggccgtgctgaaaacccgttccggcgggtacgacggccacggccagaccgtgctgaaatccgatgccgatctcgaaaaggtacgagcccgtgccgatcgcggtggcggattcccgccgagcattctcgaaggattcgtcgatttcgcattcgaagcgagcattctcgttgccggtaacggcaaggattatgtgaccttcccgatcgtgcgcaacgagcatcgtaacaatattctgcacatgaccatcgctccggccgaagtcagcgaagacgtggcgaaggaagcgcacgaactcgctttgcgtttggcgcaaggcttcgaactggccggcatcctcgctatcgaactcttcgttaccaaggatgagcgggttatcgtcaacgagcttgccccgcgcccgcataactccggtcattacactatcgaagcgtgctcgttcgaccagttcgacgcgcatattcgaggcatcgccgggtggccgctcgaacagcccgaactgctcaagccggctgttatggtcaatgtgctcgggcagcatgtggcaccgacccgcgcgctgatcgccgagcatcccgaatggaatatgcacgactattgcaaggctgaagtgcgtcatgatcgcaagatggggcatatcaccgtgctgaccgacgacaccaggcaaactgtggcggatcttgaacggaccggctgctgggatgatttgaaataaaaccgatgacggcatgtttcgcgcgtcagcctttccctgaggggaggacggcgcgcgaagccatcaagaacggacatagattgacggacggacgcgtggagcgcaacaccaaacaaaaagaactgattcatgatgcgttgaaggcaaacgatgaattcatttccgcacaggatttgcatcgcaagctggaagacgaaggcgtgaaggtcggccttgccactgtatatcgtcaattgaatgccttggctgaggcaggcgaggctgataccgtgcgtttggaaggccaacagctgttccgtctgtgtggtgatgacgggcatcaccatcatctcgtatgcacgaattgcggcaaaaccgtggaaatcgaatcgccatccgaaacttggctgcgtggcatcagcgagaaatacggattcaccatcgaaaggcatacgcttgaggtgttcggactatgccccgactgccggaatgaggcacgacggtaattccgtcgatctcaacaatttcgccgatttcagcaacaacggttatgcggacggcggaatccttgacgacaactagatactgccatccgaactgtctataccccctcatcgttcttttgcgatttcatcgacatatgcgtaagaaaatcagaagaaactgtggatgaaatcgatcattacagctttttgtcagatatggtcgcgagaatagtgccttggcgtcgccgtaaggcgggaaacgaagcgaactgacacgttacgagtggagataaacacttgacgaacgaatccgtgaatacagagacgattgaggaactgaagatctcgacgattgatccaaacgcacccgccaaggaacgtaaggaattcccagggtggttgtacggcatactgtttgtggtgttcgacgccatcggtgtggcagcgctacagattggcgtcagtcaatccgctacacgcgtcaagctttcgaacaacatgtggctgaccggttggggcttcgtcaccaaaatgttcaccaacctcaactttgtggcggtgctcaacctgattttgtggggcgtgctgtatgtgatactgctcatgctcatcaaccgcttctggatcgccacgccaatatttctggcggtgacattcattatcgcggtgatcgaacatttcaaagtatccatccgatatgaggcgattcttcccagcgatctgaacttcctcaaagccgatgcgggcaatcttatgagcttcatgccggcaggcgcacagtggaccattctgcttgccgtcgtcatattcgttgctttcattgcgcttttcgtattcctgaatcatcgtgacggccgtcacggcaagcttttccgtggcgacgacaagcagtcgcgctcgctgaatgccatcgtgcgactactgctgatcatcgtgccgggaacgttcttcacgctgtattccatgcaggtgagcactgtcggatcttgggcgaaaaccttctcttcggcaatgggggacatgccgtccatgtgggattccgtctacgatgcgcagcgcaacggaccgatggtcgccttcaccaggcagctgaatccgaaagtcatggtgaagcctgacgactattccgaagaaaccatgaaggaagtcgcggcacgatacgaaaaagaagcgaagaagatcaacgcatctcgtaccgagaacatgaccgacagtacggtgatctatgtgctgtccgaatccttctccgacccgtctcgcgtgccgggtcttaagatcaacaaggattccatgcccaacattcgttccatcaaagagaatacgacctccggtttgatgctttcttccggatatggcggtggtaccgcaaacctcgaatacatgggattgacgggtttgagcatgtcgaatttcgattcgtcgctcaccagcccgtatcagcagcttgtgccgagcgagcattggacgccgaccatcaaccaactgtggggggcgtcgaagaattccatcggactgcacccgtacgaatcgtctatgtactcgcgtgcgaccaactataagaagttcggattctcgcatttctacacgttgaccggtccggacgtcatctcgcatcaagacaagatcgacgattcgccgtacgtgtctgacgaagcgacgtacgagagcaccatcgaagaagtcaagaaaaccgatggcaaccagttcctgcaggtcatcaccatgcagaaccacatgccataccacgattggtataagaacaacgatttcaaggccgaatccactacggacactcctttggaggacgatgagaaggagtccatcgaaacctatcagaagggtgcggctctgaccgacgaggcgaccgccgacttccttgacaagctcgacgccatcgacaagccgatcaccgtggtgttctacggcgatcatctgccgggcatttattcgtccgcttccgaagacgacaacaattcgcttgccttgcatctgacggattatttcatctggtccaacaaggcgtccagctcgcaaggcaacgagatcgacaacgccgactattcgtcgccgaacttcttcgtggcgcaggccgccgagcatatgaacgccaaggtgtccccgtatctggcgttcctcacgcaaatgcatgagaaaatctccgccatggagccacctgtcgtcaacaatatccagggatgggaccgtatccctgaaggtcagaacatctatctcgacgctgacggcaatcccatggccgaaagcgacttcgacgcggaaacccagcagttgcttgccgactaccagctgattcagtacgatatcaccacagggaagaactacctgaaagacaccgatttcatggatcttccctagaggcaagggggaagagatggccgcaaccgatcgcgaacagcagattttggcgtggattaagcagaatcctttgatcagccaaaacgagcttgcggaactgtgcggcatcacccgttcaggggtggccgcgcacatctccaacctgatgaaaaaagggtacatccaaggcaaagggtatatcgtcactccgcccagctatgtggctgttgttggcgccatcaatatagaccattacggtgtcgccatgcaggatgtggttggggaaagttccaacatggggcgcattgtgtcatccgtgggcggcattggttacaatatcgcctacaatctgaaccggcttggcgtgccgaattatttgatttccgtctatggtgatgatgagaacggcgaacgcgtcaagcaggacgcgtatgccaacggcattgacatcacgcatgccaagcagatttcccatatgcctacttccaccttcttgtcggttgtttccgcgcaggggcgtcagattgtgggtcttgatgatatgcagatcagtgcggaaatcaccccggaatttctagcgcaacgagagcagaccatcgtcaatgcggaaatggtggcgattgattcgagcttgccgtctgatgccatagcatgggtttgcgaaaaaacaagtcgaccgattttcgtgcgcgtggtttccgttaataaagcggcgcgaatcacgccggtgctcgatcgcatcgacactatggtgcttaattccgccgaagccaaattcgtgtcggggattgaggtgcatgacgaggccagtgccagagattgcgccgaacatttgctgcggtccggtgtgcgtaatgtgtttctttttgtggatgattcggacatgctgtactgctgcgaacatgaaagctttttctggtctttgccgggaagggcggaggaacgtcgatataccaatggtggtgcgtcggcggcgttgagtgcgctggtgtgggcgcgtcgtgagcataaaacacagcgggaatgcgctagatatgcgtctgcggcggctgcgatgaatatgtctcaggtgcagtcgatttgcgctgatttttctgaagaagctgtgcggcgcaaagctgatttgctgcagtaacgcaggtatggcggtcttacatttgtttctttcgtaatcgcgagacacgcgatttttccatatgttacatcgatgaaatataagcaaaagttgactggcttaaacttttgttgtattctaaattgaagataaaacgtttcatcaagggtgtatcaaggcagatatatccccgaaaatgtaggaggcaatatccatggcagatatgacttcaggaaatactgttcctgaccgttacgttgtggtcatcggtggcatgaacatggacatctgtggtagaccgacgagcaccgtagtggaccgagactcgaatccgggcgtcgtcagcatgtccgcaggtggtgtcgggcagaacatcgcacagaacatggctcatctgggcatgccgacatacctgatcaccgtctacggcgacgatgaaaacggcaagaccctggaacgttcgtgcgcggccaacaacatcaatcttgactatgccgcacagctggaaggacgccgttcttccacctacatgttcatcaccgacgatacgggcgatctgctggtggccgtcaacgacatggaaatctgcaaggaaatcaatccggcattcctcgaatctcgcctcgacttcatcaacggtgccgccatctgcctgcttgacgccaatcttgaaccggaaaccatggcatggattggcgaacacgtcaccgcgccactgttcggagacaccgtttccacagtcaaagcgcaccgtttcgacacgatcctcaacaagatgaccgtgctcaagccgaatgatttggaagcatccgtactcaccggcatcggtatcgccgaccagtattcggcaggtgccgcagcgaagaccttgctcgacaggggcgtgaagaacgtattcatttcattgggtgccaacggaatcctgtgcgcgagacacgaaaacgacgaatacagcttcaagcatgtgccgccataccgtaccgaaatcgccacggcaaatggggccggagatgccggcatggcagccatcacctggagcttcttcgataaccccgatcgagatcttgaagaagtcggcaaaattgcgcaggcagcatccagcatcgcgctcgaatgcacaaaagcagtgcccgatatcaccgtggaacgcatacgtaagaagatgtccggcgagatcgagccgttgctcgacgaagtgcgtaccgcctgaattttgctacatcacacgtccatcaacccatacaaacacaaggagaaccgacaatggtagtcaagcagatctattctctgatcgaatacgatgaggccgtcaaaaccatggaggctggtgccgacaacattggactggtgccgatgcagaatggtggcgttccggcacatcgtgtgccaatcgaacgcgtgcaccgcattttcgacgaatgcaagcgtcgtggcgtcacctccgtggccatcatgctgaccaacgatcccgacgagatgatcgagcttgccagagaggtgcggcctgacattctgcatatcgcaggcgatgggtacgccgcagatgaagcattcgcggcccgacttaaggaagccgctccgaacaccaaactcatgcaggccgtgctcgttgacgatgaatccgccgtcgaccgtgccaagaagtacgcacaatactgcgatctcatcctcacggactccggtctggcccccgacaccggcattggtgccagcggtctgacccacgactggagcattgacgcccgtattgtggccgaatgcggcaagccggtcatcatggctggcggtcttggaccagacaatgttgccgaagccatcgaacagtgcaagccgtatggcgtggactccctgacgaagaccagcatcaaatacgacggcggctacatggagaaagacatcgacaaggttcgtcaattctgcatcaatgccgacgctgcggccgcaaagatcggacagtgaccgatggctatggaagtcaaactgctgcaacccgtcaaagtggtctgcactgacgatttaggggagactctggtcgatatcatgcagaccgcgggctattctcgtccgctgatggtcacggattccttcgtcggaagcatgccgctggtcgttgccgcacgtaccaagcttgaacaggtcggtgtcgatgtggcggtattcgaccaggtcaagcccgacccgctttgcgaaaccgtggaatccggcgtcgaagcattcgaagcgcataaggctgacagcatcatcgccatcggcggtggcagttccatggatgttgcccgaggcatcaacatcgtgcgtgtcaacggcggatccatcatcgaatacaccgatccagccaagccgatcgcaccatgcaacggtatgatcgcagttccgaccaccgccggcaccggcagcgaaatgtccaacgcgctggtggtcaccgaaggatccaccggtcgtaaactcgcggtgcttgccgatccggcagtcagcgaatatgccgtgctgaacgcggatctcatgctgacactgcccgcaaaaatgaccatcgcttgcggacttgatgcattctgccacgccgcggaaggatacctttcccgaatggcaagtccggtcacggatgccatttgcgaaaaagcgatgttcctgctgtacaactatctgccgcgtgctgtggcaaacggtcaggatcgtgaagccagggaacgtgtgatggtcgcgtcgacgcttgcaggatggatgctgaacaatgcgggaaccattgcggggcattccatcgcacacgtgctcggagcgaaataccacatcgtgcacggtgaagccgttggctacgcgttgccggcggttatggagttcgttgctcccgtacgtgcgcataaggttcgtgagatcggtcagattctaggtgcggtctacccggaaaatgcgccggacgagcaggttgcgattatcgcaagcagagcgttcaaggatttccgcgaccgcatgctcggtctgcatcctgttgaggattacggcatcagcgttgaagaactcgtttccaatgcgcaggccgtagttgacgagcgttttgcaggaaacacacctcgtgacatcgatcttcaggcagccgaacaactgctcgaaggtttcggaagtcgctgatatcaaaggccattgccggccttgcaacaagttgtgtgaccgatgagccggagtcagtcaatcgtcgaccacctcattatcggttcaaagttggagcacataaggaggaaccataatgtccaagaaaatcatccttgattgcgatccgggacatgatgacgccgtcgccatcctgcttgccgtgggcaatcccaatatcgatctgctgggcgtcaccacggtaggtggcaatcagagccttgacaaggtgacctacaacgcccgtgcagtgctggaaaaggcgcatgccaccgacgtgccggtgcatgccggatgtgaccgtccgctggtgcgcaagcaggaagtggcagcttccattcacggcgaaaccggtcttgacggcgttgaactgcctgaacccagtcgtccgctggaagccggacatgccgtcaactggattatcgacaccattatgagcaacgagccaggcaccatcactctggtgccgaccggaccgctgaccaacattgccatggctgcccgcatggagcctcgcattgttgaacgtgtcaaggaagtcgtgcttatgggcggcggataccatgtgggcaactggagtgccgtggccgagttcaacatcaaggtcgatccggaagccgctcacatcgtgttcaatgaagcctggccgatcaccatggtcggattggatctgacgcatcaggcattgtgcacgcccgaagtgcagcagcgtatcgaaggcgttggcactgatctcgccaagttcgtgtctggtctgatggacttcttccgcaagacctatcaagacaatcaagatttcatcgatcctccggtccatgatccgtgcacggtggcatacctcattgatccgagcgtcatgaccacccgtcgttgcccggttgatgtcgaaatccatggagatctcacacttggcatgaccgtcgccgacctgcgaggtccagagccgagcgccgaagaatgccacacccaggttgcagtcaagcttgatttcaacaaattctgggatttggtaaccgacgcaatcaagaccatcggctgaaagaagagaaagataagtaaaggggtgctctaatgacagagaccaaaaacagcaaaatgctcgacgaaggcggcaagtccgtcgtcgcattgatggcagcattgatggcagccatcttcgcgttccagctcaacgcgtccatgctttcgcctgcattgacgaccatgcgtgttgaactcaacaccaccgatgcgcagattggcttgacccagacggtgttcttcacctcgtgcgcagtgttctcgctgttcctgccgcgactcggcgatttgatcggtcgcaagaaagtgctgcttggcattcttgtgcttaccgctttgggctgcgtggtttccgcgctcgcggtcaacgtgccgatgctgatgatcggtcgtgtgattcagggtgttgccggtccgattgtgccgatgacgctgatcatgctgcacgccaaggttactgaagataagaagtacgccaagctcatggctattctgacttccgttaatggtggcatcggcggtgtcgacgctattcttggcggctggcttgctggcacgttcggtttccgttccgtgttctgggtcatggttggcgttgcggtgcttgccattgtgcttgtgttcgtgtatgcggaagaatccaccgcttccgagactccgaagatggattgggttggcgtggtttcccttgccgccgcattcttggccgcatatctggccatcaacgagattcagaagctgggctccgccaattgggcgctggtcgctgtcgaaatcattattgcagcagtgctgttcgtggtgttctggaatgttgagaagcgtcagaaggctccgatggtcaccacgcattacctcaagcagcgtcgtacttggggtctgctgctgaccaccctgcttaccatgaccggcgtgttcgccatcatgaacggtatcgtgcctgctctcgctcaggataccgaagtcggcgccggcatgagcgccagcgtggtatcgttcgccaccctgactccgtatgcgttgatcggtctcgcattcggcccggtcgcaggcgtgctcgcttcgaagttcggctaccgtgcggtgctgcgtactggcttgatcgtctctgttgtgggcgtgctgttcggcatcttcgtgtgcaacgttccgagcatctgggcacttgtggtcatgtctttggctttgggtgtttcctacgcaggtactgccaacatcatgctgaacggtctgggcatcgtgctctctccggaagacaatccgggctacctgcctggtctgaactccggtgcattcaacctgggtgccggtctgagttatgcagtgctgtacgctgctcagaacgcgttcaccgcatccggcggtgcgaccagcggctacatcgcagccatggttggcggtgtgattctgctcggcctcgcgttctgcgcatccctgctcattccgaagccgggagagcagaagtaatcaatataagcttgcctgtgttgtgtgattaaaaaacggcggttttgcagtcggactcctctctgtccgaccacaaaaccgccgtcctttttatatatatgattgcgattgtatggttacagacatttctgatggtatgcaatcgctgggtgcattcagatgttcagtgccttggcgccgatgtcgtgacggtagaacatgcccttggtatcgagctggtcgataatcgcatacaccttgtcttgagcggccttgatgtcggctgcggaggtttccaccaacagcacgcggccggaattggcgaccagaccttcttcgctacgagccacgccagcgtaatagacgtgggaatcctcatcgactggaatctcaggaatcgcagcgcccttgatcacatcgacagggtagccgtcggcggcgagcaccacaccaagcgtggcgttgtcattatcccaagtgaactccggagtctcgccattgagcagagcgctgatgccggcgccgagatcagacgtgagcttcggcagcacgacttccgtttccggatcgccgaaacgagcattgaactcgataaccttcggaccatccgcggtggcgatcaagccagcgtacagaatgcccgtgaacggcgtaccctcatcggacatagcctgcacggtcggcttcacaatggtttcgatagcggtgtcaaccacatcctgaccgatctgcggaacgggactgtacgcacccatgccaccggtgttcggacccttatcgccatcataagcgcgcttatgatcctgagaaatcggcatcggccagaaatcggtgccattcacaaaactcatcagcgagaactcctgaccctccaagaagtcctcgatgacaaccttcgcaccggcgttgccgaaacgatgatcgacgaaaatgtcgtcaagagcggcgatggcggtttcctcatccatggcaacggtcacgcccttgccagcggccagaccatcagccttgatcacaatcggagcgccatgttcacgcacataagcggtggaacgctccaaatcgtcgaacgtctgatactttgcggtcggaatgctgtgacgctccatcaactgcttggcgaaatccttggaaccctcgatttgcgcggcggccttgctcggaccaaacgccttgatgccagctcccgcgaaatcgtcgacgatgccctcgataagcggcacttccggaccgacgaacacccagtcgtagccgttgttcttcacgaaatcaatcagcgcggcatgattggacgggttgatctgcgtggtgcggatgccgtcaagctccatgcctggattgcccggagccaccgtgacttcgctgacgctgccgccgcgcataagtgcatgggcgatggcatgctcgcgtgcaccggaaccaatgaccagaaccttcatgtttcctcctgttgtgtcccttttgggaaaatcctatgttcaggaaagtcttcggaaataaaggggggtggccgttatggctcacccccgtatatgtatttactgcagttcgacgtcgctatcggtcttcttgacgatattgccgagtacgtaaccggcttcgtcattggacttgagcaattccatggtcttatcggcatcttcggcgttgacggccagcaccataccaatacccatgttgaagatgttgaacatttccatatggtcgacttcgccggccttttcgagcacgtcgaaaatcggcagtaccggccaggagccgaggttgatgtgtgcggccagaccgtccggaatcatacgcggaacgttttcgatgaagccgccgccggtgatgtgggcgacacccttgaccacgccggccttgaacagcggggagagggccttcacataaatcttcgtcggggtgaggagcacgtcgccgagcttttcgccgtcgagctcgtcaagcacggtatcgacggtatagccagccttctcgaacagggccttgcgcaccagagagaagccgttggaatgtacgccggtggacggcagaccaatgagcacatcgccctcagcgatggtggagccgtccacgattgcggacttctcggcaacaccgaccgcgaaaccggccaaatcgtactcgtcttcgtcatacatgcccggcatttcagcggtttcgccaccgatcagaccggaaccagcctgtacgcagccgtcggcaacgccagccacaacctgctcgagcagtgctggatcgttcttgccgcaggcgatgtaatccaggaagaacaacggttccgcaccctgagcggcaatatcgttgacgcacatggccacgcagtcgatgccgatggtgttgtgcttgttggccatcttggcaacgaccagcttggtgccgacgccgtcagtgccggaaatcagtaccggctccttgtatccgagggaagccagatcgaacaggccgccgaagccgccgataccgccgaccacgcccggacggttggtgcgcgccacatgggacttgatgcgcttgacgacttcgtaaccggcctcaacgcttacgccggcttcctcatatgcttttggcatatcaaacctttctcgggttcagtgttcttcttgggatgaagtggtggtgtattcgttgccttcgtacttgctcttatacaaggcgaattcaggcagacgcacgcgatcttctggggtgagggacttcaaaaaatcactttcataatcgtcgagtgcggtcgggtagtcgccattgaagtaggccacgcacaaaccgccatacggggcgtccgcgcctaatccaatggactcgaccaaaccgtcaagcgaaaggaacgccaacgagtcggcgccgatgaaatcgcgaatttcctcaacggacttctttgcggcgatcagttccttggtggtggaaatgtcgatgccgtagaagcacgggtacttcagcggcggcgagctgatacgcatgtgcacttcggcggcgccagcttccttcagcagctgtacgatgcgcttggacgtggtaccgcgcacgatggaatcgtcgataacgatcacgcgcttgcctttgaccacgccgcgcacggcggacagcttcatgcgcacgccctgctcgcgcagttcctgcgtcggctggatgaaggttcgagccacatactggttcttgatcaggcccatctcgtttggcagaccagcttcttccgcatagccggaggccgcggacagcgaggaattcggcacgccaatgaccatatcggcatcgaccggcgattcttgggccagacgcgcacccatacgcttgcgggcggaatgcacgtttacgccgtaaatgtcggaatcggggcgtgcgaagtagatgaattccatcgagcagatggccaactgggtctgattggtgtactgcacgatcttgtagccgtgatcgtcgataaccacgatttcgcccgggcgaatattgcgcaccaattcggcgccgacaacgtcaagcgcgcaggtttcggaagcgagcacataagcgccgtttttcatcttgccgagggaaagcgggcggaaaccgttcggatcaagcgcgccgatcatggcgtcttcggtcatgatcaggtaggcgaaaccgccatgcacggtgttgagcgcttccttgagcttgtccatgaacgtacgctgtgtggagcggcgcaacaggtgcatcaacacttcggtgtcggaattggagtggaagatcgcgccttcgtcttccaactgacgcctcagagtcgggcagttcgtcagattgccattgtggcacaaggccatatcgccgtcatggaagcggaagatgaatggctggatgttgtcggtgccgcctgaaccggcagtggcgtaacgcacatggccgatcgccttgtctcccttcaggcgttcgatttcgcgttcgtcgccgaacacttgggtcaacagacccgttccgcgatgaccgatgagatgaccgttatcgttcgagacaatgccggcgccttcctgaccacgatgctgcagcgcgtgcaggccgaagtaggtgagtcgggcggcgtccgggtgaccccaaacgccaaaaataccgcattcctcgtggatgtcttcgagttcagctgacaagccaaagctccttccaaaaccatggagacaaggggttcgctaccgttcaaccctaccaaccggaggctacaattggcggttttcgtggagtccttaggggcacttggcatgtcgggtgtgtcgaacaattgttcgaactctctgatatgctgaatgcaggaaaatacagtgcggtgcatcggcgatgctttgtcggtgctttgcgaggcgaagtgctcgttgacgtttcaagatggagccaaatcatggaaggagtctgaagatggccgaacgtacctatatcgctatcgatctgaaatccttctatgcgtcttcggaatgtgcggaactcggattcgaccctctatccacgcatctggtagtggccgaccaatcgcgcaccgacaaaaccatctgtcttgccgtgtcgccatcgctcaaagcatatggactgccggggcgggcgagactgttcgaagtcaaagcgaagcttaaagaagtcaatgctgcacggcgggcagcggcaccgggcggtgtgctgagaggtgaatcgtatgatgcgaaagcgctcgcagctaatccgaatctggctgccggcgtgtatatagccaagcctcgaatgtcgcattatctcaacatcagtgcgaaaatctacagcatatatttaaggtacgtatccgaagctgacattcatgtctattcgatagatgaagtattcatggatgttaccgggtatttgcgggcttacggcaaaagcgcgcatgatatggcccgtgaaatgatccagcagattcttcgggagacgggcatcaccgcaacggccggtatcggtacgaatatgtatttggcgaaagtggctatggacgtggtcgccaagcatattcccgcggataaggatggcgtgcgtatcgcgcaattggatgagatgtcgtatcgtcggctgttatgggcgcacaggccgttgactgatttctggcgtgtgggacgagggtatgcgaagaagctcgaagcccaaggtctaatgacaatgggcgatatagcccgatgttccataggccgtgccgacgagtattacaacgagggcctgctgtacaagatgttcggtgtgaacgccgagctgcttatcgaccatgcgtggggttgggaaccttgcacgatcgccgacatcaaagcgtataagccagctggtcatagtatgagttcggggcaggtgcttacgggcgcggtcggttttgactcggcgcggctgattgtgagagaaatggcggacgccttgtctttggacttggttgccaaaggtgtgaaggccggccatatggggttgatggtcggttacgataccgccagtcttgatccaaagcggctaggggagtgtggcactccggaattgaaggcgatggctgagcgagccattgccgaatatagcggtcccgtaactcttgataggtatggtcggcgtgtgcccaagccggctacagggtcgattggtctggacgaccatacgtcatccaccacgcgcatatgcgatgcggttgacgaattgttctgcagaatcgtcgatcatcggctgttggtacgtcgattgaatgtggttgcttctgatttgcaaacggtcgaacagctggctgagcggaatgctgcggcgaattacgttcagcccgatctgttttcggatatgcaggaagtctcaaatggaagcgatagcaacgattgcagtgataacgtcgataacaacgtgcggtcttcctacgctgacgatatgcgggttgtcgatgagatttccgaacagcatgtgcagcagacgattcttgacatcaaacgcaagttcggcaaaaacgccgtcattaaagggatggacatgttcgctgatgccacaggtcaacagcgcaaccggcagattggaggtcatgcagcatgagtttgcagcaaaccgaccgttacgatgacatcatcaacttgcctcatcatcgctcgtgcacgcgcccgcacatgagcatgcacaaccgtgccgcgcaattcatgcctttcgccgctctcaccggctacgacgacatcatcaaacaaaccgccacccattccaacgaagcagtggaacgcgccaacacccccgtcaatctcgccgaaggctacctctccgcctaacatgcgtcggagaccaaaaaagaggctgtttggtttgactagggaggaatcccgatcaaaccaaacagcctctgtatgttcgaatctacgtcagaacgcttttatggatgcggtcgcggatcaggcggcgaagtactccacgccggctgcgaacagcggctgatccttctcgccgggcacgttcttgaacgtaccgttgctgtaacgctcggagtggcccatcttgccgaacacgcggccgtccgggctggtgatgccttcgatggccagcagtgaaccgttcgggttcacgctcaggtccatgcccggcacgccggcctcgtccacgtactgcgtggcgatctggccattggccttgagctgggcgagcatatcgtcggaagccacgaaacggccttcgccgtgggagatggcgatggtgtgcatgtcgcccacctcggtctttgccagccacggggagagattcgacgccacgcgggtgcgcaccagacggctctggtggcggccgatggtgttgaacgtcagcgtcgggcattcggcggtcatcggcacgatgtcgccgtacggcaccaggccgagtttgatcagcgcctggaaaccattgcagataccgagcatcagaccatcacggttgttcaacaggtcacgcaccgcttcggtaacggcaggagcacggaagaacgcggtgatgaacttggcggaaccatccggctcgtcgccgccggagaagccgccaggaatcatgatgatctggctcttcctgatttcctcaaccaaagctgcggtggactcagccacagcagcaggggtgaggttgttcacgatgagtgtgctcacgtcggcacccgcgcgctcgaaggcggctgcggaatcgtattcgcagttgttgccggggaacacggggatgatcacatgcggcttggcggcgccggcgccggtgtatacggtcttcttcggcgcattgaaggacacggtctcaacggtcttgcccttttcatcgcccttggatcggtacgggaacacggattcgataccgccctcccaagcgtcctgcagttcggccagatccagcgtctcaccggctgccacgaactggtaggcctcggtggtctcgccgacctcactgacctcaaccaggttggatacggccggaaccttcgcggtgtcggcaagttcgatgatgaaggaaccataggccggggcgaacaggtcgtccacgctgatgccatcggccagcttcacgccgatctggttgccgaccgtcatcttgaagatagcctcggcggtggcaccgtagccaggcgtggacacggccagcgcatcgccgaaatcggtgaactcctcgactgcggagaacacctccagcagcgaatccttgtccggtgtgaggccgtcggcctggtaacgcggcgcgatgcggatcacacggtgaccagcgcccttgaactctggggaagtggcacgcttcatgttgcccacagccacggcgaaggagatcagggtcggcggaacgtccagctgttcgaacgtgccggacatggagtccttaccgccgattgcgccagcgcctagatcgacctgcgccatcagagcgcccagtacggcggccatcggcttgccccaacgctccggctcgtcgcgtagcttctcgaagtattcctggaagctcagatacgctttctcatgttcgaaaccggcggccaccagcttcgagagcgactcgaccacagacagataagcgcctgtgaactggttctgctccatgatgtacgggttgaagccccaagccatcgcggaggcggtggtggtctcgccgaacaccggcagcttggcgaccatggccatgttcggggtcagctgcttcctgccgccgaacggcatgagcacggtgcctgcgccgatggtggagtcgaaacgctcggaaagacccttgttggaagccacgttcagatcggtgagcatggtgtgcatgcgttcggcgagcgtgccggtcttccacggggtggcgtagccgtgctgcgcttcgacatgcaccacctgatgcttcggagcgccgttggaggcgaggaactcgcgggacagatccacgatcgtgtcgccgttccataccatcgtcatgcgcggctcttcggtcactgtcgcgatgacttcggcctcgagattctcttccttggcgtagcccaggaactcgtccacatcctcggcggccacgtccacggccatacgctcctgggattcggaaatcgcaagttcggtgccgtccaggccctcgtacttcttcgaaaccttgttgagatcaacatacaggccgtcagccagctcgccgaccgccacggatacgccgccggcgccgaaatcgttgcagcgcttgatcagacggcatgcgtcaccgcggcggaacagacgctgcagcttacgttcgacgggagcattgcccttctgcacctcggcgccgtcaagctccaaggattcgacgttatgcgccttggacgcgccggtggcgccgccgatgccgtcacggccggtacgcccgccgagcaggatgaccttgtcgcccggagccggggtttcgcggcgtacatgatcggccggagtcgcggccacaaccgcaccgacctccatgcgcttggccacatatccggggtggtagatttcgtccacctgaccggtggccaggccgatctggttgccgtaggaggaataaccggcggcggcggtggtgacgagcttgcgctgagggagcttgccttcaagcgtctcggacaccggcacggtcggatcggcggcaccggtcacgcgcatggcctgatacacgtaggaacggccggaaagcgggtcgcggatgcagccgccgatgcaggttgccgcaccaccgaacggttcgatttccgtcgggtggttgtgggtttcgttcttgaacaggaacagccaatcctcatcatggccattcacatcaaccttcaccttgacagtgcaggcgttgatttcttcggattcgtcaagattcttcagaataccattcttcttgagccacttcgcgccgatggtgcccatatccataaggcatacgggcttttcgtcgcggccaagctcgtgacgcatctcaagatacttatcgaacgcggcctgcacggtcgcgtcgtcaatctgcacatcatcaagttgcgtgccgaacgtggtgtgacggcaatgatcggaccaatacgtgtcgatcaccttgatttccgtgattgtcggatcacgctgttcttcggtgaagtgagcacggcagaactgcagatcagccaaatccatggccaggccacggtcggcgatgaactgttcaagatcggcgtcgctcatggtgcggaaaccttcgatgatctccaccttgcccggcaccggcacctgcgtcttcaacgtggtcttggtatccagcgaagcttcgcgagcctcgaccgggttgatcacataatgcttgatggcggcgatatcgtcgtcgcccagctcgccttcaagtgcatacaccttggcggaacgaacagtcgggcgctcgccctgggagatcagctgaatgcattcgctggcggaatccgcacgctggtcgaactggccgggcagatactccacagcaaacacattatcagaaccgaaatcaggcaaatcggcggaaacattatcgacctgcggctcactgaacacggtaggggtggcctgtgcgaacagttcctcgctaatgccttccacatcataacgattgacgagacgcacattcttcagcgatgcgatgccaagaatggtcttcagctcgttggcgagctgcttggcctcgacatcaaaaccctgcttcttttccacgtacacgcgaaaaaccatggttgactccttgaaagaggggcttggtgagattgataaaaataagattttcaaaaacgatgaagcccgcatccgagtttgtactgcagatgcgggctatcgcaagtattattcggctacttcaatgccttcggacttggcgagttcagccaagcggctttcgacctcttcgtaagccggaatgatgtcgcccagatcgcggcggaacagatccttgtcgagatgctcaaccttgccggagccgtcacgctgatcccacagacggcaggaatcaggcgtaatctcatcggccagcagcagcgtgccgtcggaagtgcgacccatttcgattttgaaatcaacaagcttgatgccgatcttggcgaagatctcgatcagggcctcattgatacggcgggcgagaggtgcgatctcagccagatcctcacgggtgcagacgcccaacgcaaccagatcgtcgtcgttcacgaacggatcgtgcagatcgtcgttcttcaggaagtactccagcaccggctccttgagctcgatgccctcttccacgcccaagcgagagcagaagtggccggcggcggtgttacgcagcacgatctcgagtgggaacatggtgaccttcttgaccagctgggaggtttcgcctacgcgggccaccagatggctgtcgataccacgcttcttgagcagatcgaagatcagcgtggtgatgaggttgttcagcctgcccttgccggcgaagtcttccttcttctcgccgtcacctgcggtagcggagttcttgtattcgacccagagcacctccggatcgtcagttgcgtacagttgcttggctttgccctcgtagagcttttccaacttctccattactcgcctttcctggtgtttgggaggtagatagtttggtgaacttgacggttaacaagataccaacgggaggctacaatcgaatggtttttgggcgcgttccggcagtcttccgtcagtatccggcaatagtgcgtcaggcgatgtcgatttcgagcgattcggccacattctcggctttagcacgcgcgtcggcctcatctgttccgatggccagcgcgactgccatgcgacgatggccgtgcacttccggcttcgcgaaaatacgcagatcggtgcccggctgagacaaagcggtggcgacgttgcggaattcggcttcaccatcgccctgaatgacgatcgcatggcttgccgcgacggcaccgtccgggatcgacaaggcgacatgttcctgcgtaatcggcaaaccgagaatcgcacgcgcgtgcaacgcgaattcgcttaaccgttgcgacgccatcgtgaccatgccagtgtcatgcggacgtggggagacctcattgaacagcacggaaccgtcggtcagcacgaacaattccacgccaaacacaccccaacccttctcgccggaagccttggccttcgccaccagaccttccactgcggtgcacgctatgcgttgcgcctgcataagcacatcctgtgtgaaggaggccggttgccaggattcgcgatagtcgccgctttcctgacgctgtccgattggagcgcaggtcacgatgccggcgctggagctgacggtcaacaccgtcagctcgtaatcaagcggagccaacgcttctacaatcactcgggaaacgtctccctcgtcgtgcgcgcgacgaccttcctgtgcctcaacccaagccgcatcaatcgcatcggcggaacgcaccacggactggccgtgaccggaagaactcataatcggcttgaccacgcacgggtagccaaccgtttttgccccagcgcgaagctcttccagcgagcctgcgaagcggtacggcgtggtcggcaatcccaattcctcatgcgcaagtacgcgcaaacgttcacgatccatgcaaatggatgcgatttcggcacttggcaccacctgtgcgccacgctcggccgcggcagccaattcgctggtggcgatcgcttcgacttccggaacaatgatatccggctggatttcgtcaaacaatacgcgcaactgttcggcattggccatatcgagcgcacggtattcatgcgccacctgctgcgcgggggcaccctcataggaatcggccgcgcacacccatgcgccaagcctcatcagttcgagagtgacttccttgcccagctctccggagccaagaaacagaacacgagtcggatgcttaccaagcggagtgcccaaggcacgattctcttcagtcatgccttccattgtgccatcggcgtaggatggagtgcatgtctgagacggaacaggaagaaacacagcgacccctgaccatcgccatggtggtcgacacgtcgggaaaccgaggtaacggcacgtcgaattcggcgttgcagtgggcggaggaattgaagcgtcaaggccatacggtcaggcttgtgggcattggtgcgcctgaatacccggcacgagtcaaccatgtgcctctggtcagttgggtggcgaaaaagcagcagatgcagttcgccgaaccgagcgacacgctgttcagaaccgcgttccgaggcgtggacgtggtgcacatctacacgccgttccgttttggccagcatgcgtgcaaagtcgccaaacagatgggaatcgcggttactgcgggctatcatgtgcagccggagaacatcacgtattcggcaggtccgctgaaatatattccgggcatcgacaagttcatctactggctgttcaatttgtggctgtaccgcaaaatcgaccatgtgcatgtgccgaccgagcttggcgcaagtttgctgcgttctcacgggtacaaatcgaaactgcatgtgatttccaacggatatgaatcacgattcactgcgaaaacgcagcgcgatgcggggaagtctgctccggttccgttccacattgtcgcttccggacgattgacgaacgaaaagaatcatgtcgcattaattcatgcgatcgcccgttgcaggcatgcgcaagatattgaactgacgattgccggcaccggtcctttgaaaaagaaattgcagcaactcgccgcacgtttgctttcccgaccgacatcgatcggatttcataagaacaccgaaatgcccgcgttgctgcgttccggcgatttgctggtgcatccttcgattgccgatctcgaatcggtgagcgtcattgaaggtatggccgccggtttggtgccggtcatcgcatcgtctccgttgagcgccgcaggccagttcgcgttacgtgacgaatcgctattccctgtcgacgatgtggaagcgttggcaaggcgcatcgattggtgggtcgatcatcccgatgaactgtcggaatggggcgaaatctatgccgaacacactaaagagcattattcggtggctgcttccgtgcgtaaattcgtggctatggaacgcgaggcgatcgccgataatgccaataagcaaatcaatgcgtaacaatcagcataaatggaaccacatgcgtgataaatgatcgtaacgtaggcaaaaaggcgcgggatgtaattcctgcgcctttttgttgtttgtcgtaatgattatttttccgattgacagcgacgatgcgcgctacagcaatgcgatcagctgctccacctgctcatcggtggtggcccagctggtgcagatgcgcatcaccgtgtgcgtgtcgtcggccttttccatgaagccgaggcgcacattgcgctgcaaacgctcggatgtcgcgttgtcgagcgtgatgaagatctgattggtcggcgcgtcgaaggtgagcgtatagccacgttccaccagcacttcgcgaatacggtcggccgcatcgttggcgtggcgggcgatcctgcaatacagatcgtcggtgaacagcgtgtcgaactgcacgcccagcagccatcccttggcgagcagcgcgccatgttgcttgacgagcgtcacgaagtttttcggcatattgccgtgcgtgaacaccacggcttcaccgaacatggctccgaccttggtgccgccgatatagaatacgtccgcgatacgcgcgatgtcttcaagcgtcacgtcgttgccggttgcggtcagcgcgtagccaagtcgtgcgccgtcgatgaacaacggcatgtcgtacttcgtgcagaccttgcggatcgcctcaagttcggcgagcgtgtagagcgtgccgtattcggtggcctgcgaaatgtagacgcatccggggaacaccatgtgcgtgtagttgccgtccgcgtagaacgtggcgcagtactcgtcgagttcggtcgcatcgattttgccgtcatggtgggggagcgtcagcaccttgtgtccggtgaattcgatggcgcccgcctcatgcacgttcacatggcctgtgcttgccgcgattacgccggcatactgcggtgtgatggagtcgatgatggtctggttggtctgcgtgccacctaccaggaagaaaatctgcgcgtcagggcaggcgcatgcttcgcggattttggctttcgcgctttcgcagatgctgtcgttgccgtaacccggatattggttttgtgcgatttcgctgatgcgttcgatgatttccggtgttgccgtgcaggaatagtcgttttcaaaagacagcatgatgcgctccttgtatctgacctatgctgatgacttgcgaccggctgtttgctgtattcaagccgtccggatagcaaaaaacctcggaatttcttccgaggtctctaccggggtggctaacgcggctcgaacgcgcgaccttctgaaccacaatcagatgctctaccaactgagctatagccaccatgttttcgcttcatacagaagcgcaacagatgaaaactatacacgattttccagctatgtctacatcggcgtgttgcgcgtgcctgtcgtcggcttgcgctgtggattgttcattatgtgaacggcatattacacaaatccgaaactcacgcgtaccttgtagtcgctgcatgcgtaagggtgtgctgtaatggcggtgtgggccgtctcggagtgtttacggcgtatgcggatcatcggccgaaaagctgtgaaatgtgaaggaagagagattcatgcagaaggtcaaagcgtttggtgattggctcaccaagtggttcaccgcgattgtgattgtgtgggccgtgttcaactatttcgtgccgcaggcaagcttgtggggcaaatcctataccggttatttcctaggtatcgtgctgttcggcatgggtcttaccttgacccttgacgatttcaggcgcattctcacccagcctctgatggtcatcgtcggtaccgtggcccacttcgtcatcatgccgttggtagctgtgctgctgtgctggattttccgtcttgatggtgcgctcgccgtcggtgtgattctggtcggctgctgcccgtccggaacctcgtccaacgtgatgagctatctgagtcgtggcgatgtggcgctggacgtgtccatcggcattttgtccacgctgtgcgcgccgttcatgattccgctgttgatgcagtggctggcttcccagtatgtgtcggtcccggtggaatccctgttcctcaatgcggtcaaggtggtgctgttcccgatcgctcttggcgtgatctgtcatgctattttcggcgagaagatcgagaagattacggtcgctctgccgatcgtgtcccaggtggccatcctgcttatcatcggcgtggtcgtcgcagccaacggtccgaagctgttcgtggcttcctcgctgcttgccatcccggtggtcattctgcacaacctgtgcggatacgcgttgggcttcggtttctccaaacttatgtacaaggtatatccgaagggcttccgttatgcacagcagaaagccatcaccttcgaggtcggcatgcaggattccgctttgggagcgactttggcgctgacgtcgttcgcttccaatccgttggccgcggtgccgtccacgttcttcagcgtttggcacaacatttccggttccgtgctgtccagctggtggcgtgagcatgatgacaggcatcagatccatcctgattccgacaatggcgagaagggctcggctgcgaaggcccgcgaagacgctgccgaaacagctaacagctgacattcgtcagtagattccgtcgtcatattgcgcattccctgaatctttcaaaacgattcagggaatgttttgttttgagtggtgcaaacgtgtcattgtgatgttttgttgctttgcgctgatgtaggcaaaatgattgaaattattgggatttaagggtgtcttcacccgtgttttttgttcgttttggggtatactgtaactgaaggccggagttgtggatcagtcgagaattcgtcaggtcgcaacgaagcgccgatggccgtgaggttcatgcgcaacgcctttaagatataactgaacaatagcggttcgaaacagcggcaatggggtagtacggcgcaggcgccgggccgcaaatgcaaaacagacaacgagactgaagagtgcgcgtaaggtagcgcgtagcaaagaagtgggaacctccttcccgagtggatggccccggattcgaaaggatccggggccatcccttttgcgatttgcgacacggcatgttggaatgtcttgggaatccgtatactgataattcgtgtgtgccaacggcatgccttatgtgacaggcgtgcgggttgggatatcccggaactcgattgcatcacgcgcagcaatgcgacggtgagagagggatgggccatcgggccggtggactgtggctatcttcacgattcagatgcgtggagtgtgggtgcagtgcggcggtcacacaaaagcaagagaaaccactgaatcggagaattcaagttgcctactattgaacagctcgtccgtaagggacgtcaggcaaagccgaagaagtccaagactttggcactgaagggaagcccgctgcgccgcggcgtgtgcacccgtgtttacaccaccaccccgaagaagccgaactcggcactgcgtaaggtcgctcgtgtgcgcctgagctccggtgtggaagtcaccgcttacatcccgggcgaaggccacaacctgcaggagcactccattgtgctcgtgcgcggcggccgtgtcaaggatctgccgggtgttcgttaccacatcgttcgtggcgccctcgatacccagggtgtgaaggatcgcaagcagggtcgttccctgtacggagcaaagaaggcgaagtaagagatatgtcacgtaaaggaccttccaagaagcatcagctgctgccggatccgatttacggttccactgttgtggcacagctcatcaacaagattctgctcgacggcaagaagtcgatcgccgaagacatcgtctactccgctctcgatatggtcaaggaaaagactgatcaggagccggtggcagtgcttaagcgcgctcttgacaacatccgtccatccctcgaggttcgctcccgccgcgtcggtggcgctacctaccaggttccggtcgaagtgaagccggctcgtgcgaacactctgtccctgcgctggctgaccgacttctcccgcgcccgtcgtgagaagaccatggctgagcgtctggccaacgaaatcctcgatgcctccaatggccttggtgcttctgtcaagcgtcgcgaggatactcataagatggcagaggccaacaaggccttcgctcattaccgctggtaattagtcgagaacgagagttaaggaacactcatggcactagacgtgctcaatgatctcaaccagatccgtaacatcggcatcatggctcacatcgatgccggtaagaccactaccaccgaacgtatcctgtactacaccggcaagaactacaagatcggcgagacccatgacggtgcctcgacgatggacttcatggctcaggagcaggaacgcggcatcaccatccagtccgctgcaaccacttgcttctggaaccgtcagacccatgacgagaagcagaagttccagatcaaccgttatattggttttgcggtggtcatggcccaggtgagacgcccggtccctttccgaacccggaagctaaggcctggtcgcggcgatggtactgcactcgagagggtgtgggagagtagcacgccgccgcattctttcgttgggggttcccgtcgagcgtgacgctccgggaaccctcttttttgtcttttggttcttgtttcccgcgacgcgcgggaggctcccaatccacaacacccttgcatcgcatggtccgtcagcgtgactgttagtaatgatgtgatgaggctcacgcgttacgcccgcgcgggttccagagaatcacgttacgatggaaaacggcagaagcccgataattgacaatcagcgaaaggaccgatgatgactctcctgcagcatgaactgaccgattttaaggtgaacgcgttccagaacaacgagttccatgaggtgaccaaggctgatgtgctcggccactggtccctgttcttcttctacccggctgatttcaccttcgtgtgccccactgaacttgaggatctggcccgcaactacgccaagttcaaggaaattggatgcgaggtctactctgtctcctgcgacacccacttcgtgcacaaggcatggcatgacgccaatgaaaagatcgccaagattcaatatccgatgcttgccgacccgaccgctctattggccaaggatctcgacacctacaacgaagtcgatggcatggccgaacgcggtgacttcatcgtgagccccgaaggcaaggtcgtggcttatgaagtcatctcttccaatgtgggccgcaatgccgaagaactgctacgccgtgtgcaagcttctcagttcgtccacgaacatggcgaccaggtttgccctgccaactggactccaggcgaggacactattgaacctagccttgatcttgttggtcaactgtgatcgtcgcttgacggacggcttgtcaagctaatccgacggggtgcccaggagaatcctccgggcacctcctgaatagccagatcaaggcacgaagggagtcgttatgtctcgaaatgatttgtacgatgtcatagtcatcggcggcggtcccgctggtctgacggcgggattgtatttggcccgtgcccgatatcgcgtactgattctcgagaaagatgattttggcggacagatcaccatcaccaatgaggtggtcaactatccgggcgttggccgcaccactggccgtgcgcttacccagaccatgcgtcaacaggcgcaggatttcggcgctgaattcctttccgccgaagccatcggcctcgacgtgcacggcgatgtcaaaaccgtgcatacttcgcgcggcgacttgaaagcttttggtattctcatcgccaccggtgccagcccacgcaaactagggttcgaaggggagtccgaatatgctggccgcggtgtggcctactgcgccacctgcgatggcgagttctttgccggcaaggaagtactggtggtcggcggagggttcgcagcagccgaggaatccgtgtttctgaccacatacgcctccaaagttaccgttctcgtacgggaacaggacttcacttgcgacgctgcggtggccgccgcagcaaaaaacaatccgaagatcgacgtgcgttaccaggtcgagctgcaaggtgtcactgccgggcaaggtggtttacgtgaagcttcgatcctaaaccgggccactggccagaccgaaacgtggaaacctgttgatggcggcacgttcggcgtgttcgtgttcgccggatatgtgcccgccacgaatctggtgcgcggcgtggtggagctggacgattatggttacgtggtcacgcacggctatctcgaaacctcggtgccgggcgtgtatgcagccggtgatctgcgggccaagaacctgcggcaagtggttactgccaccgccgatggcgctattgccgcagtggagttggaacggtacgccaagcggatgagcgagaaaaccggtttgacgccacagcgcccggtctcttgcgcctacgagcagtccacaacgaagacagatgctgcctcgttggacgctacagcgcctacacctacgcctgcgcccgccaccaaacgcaacgccgatgccgcggcgaacgccgttaggaagcccggcgaattgttctccgacgccaccagacagcagctcaacgtggtctttggccgcatgtctcggccggtcacgcttgctctggaactggacgatacgccgctgtccacggaactgcggggattcatcgatgcgttggtcgcgctgtccggtggcaagctgaaatcgacggtggatgatggtgagtacgagaaggatgatacgggtcgtgcggtattcgacgtcgacagcgtgctgccggcagcgcgtccatgcgtgcgcatggtggtggatggcgagccgactggtctcgccttccatggcgtgccttccggtcatgaatttaattcgttcgtgttgggcctgtacaacgtggctggtcctggtcagccgttgggcgatgatctgatcgaacgggcaaagtccattgcaagcccgctgagtatcatgattctcgtctcgctcacctgtacgatgtgcccggagacagtgcttgcttcccagcgcatcgcctcgctgaacccggccgtgcgcgccgaggcctacgatgttgcgcacttccccgagcttagggaccattatggcgcgatgagcgtgccctgcatcgtcatcaaccgtggtggcgagcagaccgtcgaattcggcaagaagagcattcctcagatgcttgatctcatcggcgcgtgacaagcgtgtgacaaacggtgataagcgcgtgagcacgcttcggcccacgggattccgtcgcctgattctgtgaaccgaatgccacgcgatgacgaatatgcccggaatcaggttttggcttgattccgggcatatttatatgcgatggcgcaggcacccagttcgtgggattatccgctgtaatcccacgaactaggaaccacgaacctatgggggactaggcgacggcgacgcgcttgcctgcggccttgaccagcgaaatactgatcagcgcgattatgaacagcacgatgagtaccggaatcaacgcggcataacggtgcgcctgatcgggggtgtgcgtgacgacgaacgacgccagctgattgccggacaagccggcgaatgcccaggcgctcaaggtcagcccatgcgtggtggatacggttttcgtgccgaagtgctgatcgagcagtaccggcagggtggagaagccgccgccgtatccggcgttgacgaggaacagcatcatcaacacggcccacaacaaagcgcggtcgatactgttagtgcaaacctgcagcaggcatacggcgatcgatatcacgaaaatcacctgatatacggtttcgcggcgtttgaggtgatcggacagcgtggagaagcccacgcggccggcggtgttgaacacggaatccacggcgagcaccaaaccgataatgccggaaatggcggccgcgaacgcgctcgggcttagcggagcgtactgcgggaacgccttcagcacatcatgcaggatgtctttctcttggctgataagagctagaccacaggtgatgttgatgtagaaggcgagccagatgccccagaacacgggtttcttaagaatcgagacgcggctgacataggaggtcgcgggatcatagacccagccggcggggcggcgtatgagcaggaatcccacgagcatcattatcgcgtaaaccacggcgagcgtatagaacatgttcaccaggccgatcgagccgatcaggtattccatcaccggactggcaatggctttggccaagccgaaaccggcgactgcgataccggtggcgaggcccttgttgtcggcgaaccacagcatcaggttcttgaccggggtcaggtagccgatgcccaggccgacacccatgatcgcgccgtagcagatgaacacgccgggcaggaatcccaaggcgatgctcacgcccgtaccggcgaaaccgaccacaaagcagaccattgagataagagcagatttcttgatgtttttctcaaccatcggcccggcgaatgcagcggacatgccgagaaagaagatggcgagagagaagccccattccacggaggcggggctggcgtgaagctggtccgcgatcaactgcttgaacacgctccagcaatagacggtaccgattgggatatggatcaatagtgcggggatgattgcgctggtccaacgattcttggtaaaccttgccatgtataggcgaatcctttcgcaactggcgtacgatgacctgccggttggaacaagaggagtttcgtcgaggaaacggatgcacaccacatgtactgcgaacaattcgctgaacatctttggtgttgttttcatcggcgccgctggctcttgtcgacgccgacaaacagcactataacgccgttacggtgattccgtggccgattatcgtgggttgtgaccgtgagcttattcacatcgaaaacggttatggaacggtatcaatgtgagtaaacttgtgctgctgaaccatgaaagcttgacggttgagtttacaagcgaggcatcccgacctcagattgacgatgagctcgtggacaacgtggtggcgttggccaataccgaaaaaacgggtcgttgtaccttggcatcgaagacaacggcacggtaaccggtgttagcagggaacatcgcagcgttgacgggctggcggtgtttatcttcttcagcaagacggtgccgcaggtcgcgtggtgcgtgctgaaatcatccatgcggacaacgggttgccggtggcgtgtatcgaggtagaccgcaacttgcagattgtgtccagtatccaggggcgggacagcgccgtctgaaggcggatggaacgcccgaggtggtgccgctgttcccgagccggttcgtcagtcgcctatcccagttgcgcaactacgactacagcgcccagcccgcgcggaatcacgattggacgactgggatcctgtcgcgcgcgaacggttgcgcgacaggattcgtctcaccaattccggcgatacattgctgctgttagatgacgatgacctcgaccatgcgttgttgatggtggtggacggtccctacggtccgcaaccatcgcttgccggagtgctggccatcggcaaggtggatgcgatccgacgtttcatgcccatggcatcggaagtgtttcaagtgatgaaaggggcgtctttggccgtcaacgccgagcccttcgcggatgccgttggttgatatgttctcgcacatcaacgcattgaagccttggaatccgaatcacgaaatcatgagcggtctggttcatgtcaatctgcctgattttggccgtcaggcgttccgtgaggcaatggccaatgcgttctgcgatccttcgtcgccattgagcaatggcattgtcgggaaagttggacgaagtcggcgaagcggataggtggatttgggaacggctggggcatatatgggaacgcctcggctgctggaccggttcatcacagcagccgaggcgtttgataaagactcaaatcttacttgctgaaaaccttcttgaacaaggtgtcggtggcgccctgtcgaacggcatcgtcggcttcatcgccgttgcggcaggtatgaccggtgacgcgaccgccgccaacatgaccgccgcgaacatccacaccttcgaagtctgcgccttctatgtgccgctcgacctgatcgtgctcagcctgctggtgttcatgttcaaggtgaagatcaacgagaagatgcacgccgaaatcgtcgagcagctcgaagccaagctcgcggccggtgagatccccgacgaggaagtcaagacggtcgagacggttgaagcgtcaacgagaaggccaagattctgaccgaataaataaccaatacttgccactccttcctttctctctgatggaggccccaatttcgattggggcctccattggtatatgcactgttttatagccgttcaaagtttgtcaaatgaacaaaacgaccgatgtcccggagcataatgcaaccaatgttgtttcgttttttcgctcaaggcatatcttgccatgttccgaggtgaaccatgtattttggcgaatgaccaatcgaagaatcgaattagatttcattgtttcggatgagaaggtcccagcttcacagggggtattaatgacattcatctcacgagcggcgcgctatgtgctcagaaagcgagtgcgcaccgcagtgctgttcattgtgctgaccatcataacggcgagtatgctgtccgcaaccgcagtttctcgggcagcgcaacatgaggccggacagattgagaaacaggcggtcggcggattcgtgctggccagtaacctgcaaggcagcatgctgacacctcgcggaggcggaatggttcgtcccgctgatgtgcaacgaatctcgaagctgtccggtgttgactcgtacatggtcaggcagaacgccaccgccgatctcgtgggagccagcgtggtgaaggtccccggcggcgatgattacgatgcggagaaagaacagcagttcggcaatacggccaacgtcataggcacaaacgattcgtcaaaactcaatgtgttcacgtcgcacacgctcagcatggtcgacggacgtcatctcaaggcatccgataagcatatgtcgatggtccatgaggatctcgccaaaaccaatgggcttaaagtcggcgataccctcacgctcaaggccaatccatatgatgccgacaatgagtcgcattcgacggcaaccgtcaaaaccaccatcgttggaatattcaaaggagacagcgacagaaaggtatccagccgcgcggaactcacctccaacactgtgtacaccgatttggacactacaagtactctgtaccagtacaaggccggcaaggaaatatatcaggatgccactttcgttctggacaagggtgtcgacgtggagaaaaccatggaagcggcgaagaagcttccagtggattggaacaactaccagatcacgcgcaatgaccaatatacgtcgagcatgctgaatgccgcccgaggtgtgcgttccatgatgctcggcgctttgatcggcgtgaccatttcggccgtgatagttctcagtctcatgctcttactgtggatgaacgaccgacgtcaggagatgggcgtactggtgtcccttggcatcggcaagccatccctgatcgcccaatatctaaccgagatgattctgatcggtctgccgtccctggccctcggatggttgtgcgcacgaggagtggcccaatggcttggcacttcggccctccgttccgtgaacgcctccgcggcgaaggagctgagcagcatggggcaggttggcggcgatctcgaatccaatatgtcggttcgtaccttggattcgctcacggtatcgatcgacacgactgccgtactgtatgtgtcgctcggcctgctggcggtgatgctggtatgcgtcgccatatcgtgcataccgatgctgcgcaagtcgccgcgaagcctgtcggagctccgatgacgggcatgaacgtgtggaatcgtgccacgctggcaatcgtgcgtaaaccggtacgcagcggaatcatcggactgctgatgctgatggttttcaccagtcttgtggctcaggttggagtgtcaacggcacttcagaaaatgtccgacgatatcggcagaagcatgggaataggttttactgtcgacacaggcgagaatcctgcaagtctaaaggaagcgagccggttctcgcgcatccccggcgtaggaaaaaccgtttacgagcgtaagaccttggcaggggtggatggagcgcatccggttgtccccgaacatggtcctcggctggattccggtctatccacgcaggtcagcgtgctgggcaccactgactcctcgttgtccgaagagttccaaagcggtctgtaccggttggaacaaggacaccacatttcaggtaatggccggaacgtactgattcaccgggatttcgcacgtgagaatgggctatcggtgggatcaacactccggctcagtcaggaagaccgcgattccaccgttcgcgtggccggaatcttctctggcaatgtgcaggcacagagccctatgccatcggacgcatcggagaatcttatctattcgggcgttcaagtggtttccgcgctgactggagaggaacgggtcggcacgatccggtgcctttcggataatccgcaggctctctccgccgcagtggcccaagcaaaaaaaatcgctggaagcaagtatggcgtcaccgatgactcggcacggctttccggcgtgctgcagtcagtggaaacggtgcgcgatctggtccgcatggtgctgttgtccgtttgcctggctgatgtgttggtactgggcatggcgcttgtcttctggatccgctcacgtatccatgaaataggcacccttctggctctcggcattggtaagatgcagattatcgcccagttcgcaatcgaaaccggtctcatggctgtggttgccgccctgtgctcgctgggcacaggctctctattgtctggatacgtgtcctcactcctactgcacgattcgggagtcgcgcctcttgaatcattgcaggtggagactctgccgccagaacagacgctgctcattctgctgctcggatgcgcggtcatcgcaatcgcgctcgccgtgtcgtgcgccgcagtgctggccaaatccccgaaatccattctttcctctatgcgttaggagatattaatcatgactatctgtctgcaattggaccatgtcaattactcatacggcgcggcgaagatccgcgttctttcggacgtgaacgcagatttcgaatccggaaagatgtatgcgataaccggcccatcgggagcggggaagagcactttgttgtctctgttggccggtctggatgccccctctgatggagtggttcgttttgagggcaaggatatagctacgacgggttactcaaagcaccgtcgcgagcacgtgtccttggtgttccaggaccataatctgatcgactatctcacccccgaagagaatcttcgcttggtcaatcccaaggccgatatgaagatcctcgaggatctggggctgagccgtgaggaatcgaagcgcaacatcatgcacttgtcgggtggccaacgccagcaggtggcggtcggccgcgccctagtggcgcccggccgtgcgattctggcggatgagccgactggcagcttggatccggaaatgactgacgaggtgattgatcttttgcggcaggccgctcatcaactcggtaaatgtgtcattgtggtgacgcattccaagcgtgtcgccgattccgccgatgccgtttacactctcagacataagaagctagccaaggcatagctcgttcgcatagaccgtgtcttccgtccgaatagcgattcaccatcgatggcctctcggacttccatcgcggcggccctcttgacgcgtggctgttgcgccacgcaatgaacgcgttgggccgcggcatcgccgccgttgcctacgtgtccatgggcggggcggcatgctggccggcttctactcgctgtccgcgaacaacgtgggctgaggcgacgtgcacggcatcgtggatggttcgttattacaacggcagttctcgataaaccaaatcatcgcggactgcaaagccttgacgttcccagaaatcgttgccggcatcgttgtctgcgggcactccgacagcgactttcggcaggccgatcgcacgaagcgtttcaaccacgcggcccaccaaaatcgagccaatgcctctaccgcgcgcgtcggggtcgactgccgtgtggtagatgcgcgaccgtcttccgtcgtggccggcaagaatcgcgccaatgattcttccgccatcgtcctcggctacgaaacaggtgttgggattgcgttcgagaaacgtctttatcgcatccttgcaatcgtctatatctctcatagtgaaacctgtgcatcgtatccacagttcgtataccagcggataatcctcgattttcatatggcgtatggtcattgctatcggttcggtcatatttccttcttttttcttgaacgtcaactccgattctcgcatcgttcacggtattttctgtgcgggtatgccatatttgcgttgcacggccgtttgcagcgcgtgtgtcagggaagccatggaagcatcctgaaggataatccgccgattttcggggatatcccggatgtgaacacatggcgacggcacagtgaactgtgcttaactggaattatgcatatgaagaacggaagtatcgcgagggcggcggctgtggtaatcgcaaccgccatattgtgcggcattgtgcctatgattggcgtcgcgctgcgcgattctgcaatcgcaacaatgcgtgaaaccaatattttgcaggctttagcggcgctgccagaagggttgcgcgactgctccacgatacttgcgtacttgttttcaacggtaggctgcatcgcaatcgtcgctgcgctcgccgctgtcgatttgcgtattaccggcagcaggcacgtcgtcatccgcgatgtcgccgtgtcggcggcgccgatactgtacgtgaccggcgtcaaatggctggtcgaacgcccccgtccgatcacgtctgtcggcaatggtctgttgccgggcgatccaagttttccgagtggtcacacggcagccgcggtgatcgtatcggtcatgatgattcttaccgtgcgtaatttcgcgcgcaaatgcttccccgacggagaagatgacgggcgtgcaaacagaagacgggtgtttctccgcaggacgatcatcggcgctgtcgcgcttgtcatggcggtcgcctgttcgcgattgctgctcggcttgcactatccgaccgacgtgattatttccgccaccatctgtccgctcatttcctacgccgtatggtgtgtatggaacgcatgcgaaagcgcgggggagcggtaaaaacgtatctgccatgtgagttcctttgattccgaaatcagtttggggatatccgattgtgcgtgcaaaacgacaggttgtgtaatacggcagtggtgatgtgacaaaagctggttcaatcaaactagcggcgaaaacctgcgtgcggcacggcacgatgcagcgcggtgcggcagcgggaaaatcgcaagaaaaaccacagtgaagccgagcaagacagacctgacgaagtgggtttgcgacatacttagtgcaagggagagccaatggaactcgaagaactttcggtcgttgaaaaggccgcaatgctttccggtggatccgaatgggattcgcgaggcaacgaccgcgcagacatccccagcttcgtgatgagcgacggcccccacggcgtgcgccgccagctcggcgaaggcgatcatctcggcatcggcgcatccaagccggccacctgcttcccgaccgcaggaaccgtggccaattcttgggatccggcgctcgccgaagaaatgggcgaggccctcggcagcgaagcgcacgatcttgacgtgaacgtgctgctcggcccgggtctgaacatcaagcgcaacccgctgtgcggacgtaacttcgaatactattccgaagatccgatcgtcgccggacgtatggcggcaggcctgatccgcggcatccagagcaacggcatctccgcatgcccgaagcatttcgcagtcaacagccaggaactgcgccgccaggccagcaactccgtggtcgacgagcgtaccatgcgcgaattgtatctgaccggtttcgaaatcgcagtgcgtgaagccaagccgctgaccatcatgacctcctacaacgagatcaacggcgtctacgcgcacgaaaacaaacatttgctccaggagattctgcgcgacgaatggggcttcgacggcatggtcatctccgactggggcggatccaactccgcggtcgcagcagtcaaggcaggcggatcgctggaaatgccgtctccgggcttcacttccgtgcgtgagctggaaggcgcggtcaaggcgggaaccctgtctgaagccgatatcaacgcgcgtgccgcagaagtcgcaaaaatcgcggcagcgaccaagctggtcggtgttggacgtaacgatctgctcaaagacgatatcgcagcagcgcatcacgacgtggcacgcaaggtggccgaaggctccagtgtgctgttgaagaacgataacgcgaccctgccattcaaggccggcacccgcgtggcggtgatcggcgatatggccgcaaccgcacgttatcagggttccggctcctccaaggtaaacgccaccaaggaagagaacattcttgaagaggtcaagaacgccgaaggcctcgtgcttgccggctatgagcagggctatgaccgccagggcaaggctgaccgcgtgctcgtggaagacgcagtcgcgctggctggcaaggaaagcgttgatgtggtgcttgcagtcgtcggtcttgacgaacgcagcgaatccgaaggccttgaccgttccaccatggcgattccgcaggtgcagaacgatctggtcgaagcgctgaagggcgcgggcaagccgatcgtggtcgtgcttgtcgccggctctccggtggaactgccgtggattgacgacgttgccgcagtgctttacgtgggtctgtcgggtcaggccggcgcttccgcgaccgtgcgcgcgctgaccggtgagatcaatccgtccggccacttggccgaaacctggccgatgcattacgaggattgcccgagctccggttggtatccggcgattggtcgcgatgcgatctatcgcgaaggcccgttcgttggctaccgttattacgagaccgccggtgtgcccgtgcgcttcccgttcggttacggcttgagctactccacgttcacctacagtgccgccactgctggtgagaacggcattgacgtgatggtcagcaacgattccgatgttgccggttcgaccgttgtacagctgtacgtgcgcggtccgcagggtggtgtgttgcgtccggatcgcgagctcaagggcttcgccaaggtttcgcttgccgcacacgaaagcaagagcgtgcacatcgatttcgaccgttacaccttccgtcacttcgacgttgccagcaacgaatggaagacggaaaccggcgagtggacgctgatggtgggcgacaacgccgaacacctgccgcttacgattccgcgcaccgtcgcaggcgatgtcaatccggttgccgcggatactgcgctcggccattatctcagcggccacgtcaaggaagtgaccgacgccgaaatggccgtgctgttcggccatgaggttgtggcaccgggcaagccggtgacgttcggcgtgaacgatccgatcatgtcgtgggtggattccaagggcttcgtggcgcgtaccgtcgccaagacgctcaccaagcaggaggccaagattcgtcagaagaccggcgctccggacctcaacaccctgttcatcctgaacatgcctccgcgagccatgagcaagatgacccaaggcatggtcgattccgcgatggtcgacgccatcgtcaaaatcgccaacggacacaccttccgcggattgggcggcgtcatcgccggcttcttccgcaaccaatccgcaaacaagcgtactgcaaaggagctgaacaatgactgataacaacgcaacgcagccggctgagaaggtcggtccgatccgccagtggatcaaggaccacccgaacatctgggagttcatcctgttcaacgtgctgtcgaacatctccaccatcacccgtttcgtggtgacgtggatcggcaccgccatcttcatcagtggcatgggcctgacgcagccgttccacttcctgatcttcaactacgacactcagggcaacggtctgggcggcttcctcaccttcctgcttgccgaggcgctcgcccaggtggtgaacttcttcgtgcagatgaagtgggtgttcaagtctgactccagcttcaaggatgccgcttggaagtacgtgatcctcgctgtgatcatcgtggttgtgaaccttgtgctgccgggctatgtgaccggtctgtgccagggttggggcatgggcgctggcattgctggcaccatcgcttccgtggtcaacaccctgctcgccgtgatcgtgagctacccgctgctcaagttctgggttatgccgaagagcaagtccaaggagacggccaagtaacccttcatagctgacttctttttcttcccttcctcaacccgcccggtcttccctctttcccgggcgggctttcttatgccctttttgctgctttcctgtagtttcttgtgatttctcaatatcgaaatgcaatcgtcagcagtgttgccggcgtaaaatcgaaaacgagattggcgtaaaatcgaaagtcaaaacagcgtaaaatcgaaaacgggattggcataaacttgaaagtgcggaatgatgagtgatttggcgaggtcctaaagcttcgtcaaccattaaacggggtcgttctcttcctctctcatgacctcgttggaaaagccctgcatagctgcggggcttttctttttgctcagaaagacatacgctaaccggccccagcaaatgaacgttttttgttcttttgtcaacctcttccgtatagttgtatgcagtaatctcccgaaaggggattgcgaatctatgaggggagacaatgagctcggaattgaagttcgtccgttgcgggtttaacggaggaacggaacaggaatctggacggcagtgcctgtctttgaagcgttgccttgcttcggttattgctgtttccttgtccatcgtgtgcatggtgcctgcagcatatgctcagaatatagacgatgtgagtagctctcctaacgccgtaatttctgagggggggggtaatactgtcgtagctgctccttctgcccgcaatgtcaacgttgacgataagacgtcagaagaggccaatacatcaaacggtgcgccaacaccttccgaaacgaatcaagacgcacagcaggattcatctccttcatcttctactactggtgattcttccgaatcctcaaatggtgcgacagacaataaggcggacgactcagcagaagctaccgctggcaattccactaatgatggagcccaaacgcaggctccaaacgatgcttcttctcaagatgccaagaacgattcctcaaatgcgacggatcaatcgccggcgaaggccgatgtgcaggtcgccgcgacggcgcttggcggccgtgactttgagggtcaggccaccaaggagatcaacggcaagacctacatcctgattggtaacgagcagcagctgcgtgcgattggttctggcaagaaggttattggccgcatcaacaaggtcacgcagacttgcatgcagcaaggagccctcaattatcagtgggtggacggcacgccgtcttccgaatacgccggtgacgccgatctctccgattcagatattttgcgcgatactgatgcctccgaccacgacagtccactgctggcatgcacggcgttaagcgtcaacaggacccgcaccaagtattacggcgtgggtgctgatggcacgcaaacggactactccgctgccaacaccggcctgacctattccgcagacgccaactacctgatcttccgtgacatcgacctgtccaagaacgcggcagataccaacaacaccgagtggactccgctcatgttctccggcactatgctcggtgcggtctccaatgacggcgacaccgaagccagcctgtggaaggctgttggggccgatggcgcaagcgtggttcacgctaccgcagctcggccggtcatcagccatgtggtcgtcaatcagaaagatatggtctctaatgtcaaaggcgaccagctggatgtcagcaagcagcagggcatcggcttcttcgcctcgatcacgaacaagaccgtgatgaacagcaacagtctgggcagcgccggtacggccgtggtgtcgaacctcaagctgcaggatgtgtcggtgacgaatcatacgagtgaatcgtatattccgccgaccttgctcggtatgctcacttcggcagtgggattactgctcgacacactgttgaaggcgttaaaactattgacactcggacaagtagatcttgacctcaatcttcaaggtctgctcaccctgcacaaagacaatccttccaacctcgccacgggtgcatttgccggccgtatctacggggacaccaaggttacggactgcgaggtagcagatgtttcggtatctagcgtaagccgtatgaccggtggtttcgtgggatatgttgagggcgcaacccgatacgatgcagtctccggcatcgtaggagcgctcaccaatgtactctcgaagatcttgggtgtcatcccgttcctcgggctgggcgatttggtggactggttgctgtccggcacgctcgggctgaatgccttgattccggttggctactacaacccggttatctcgaatagttcggtgaacgggttcaaagagaacgtggtgatcggcaacaaggacaacccgcaggccggcggctttgtcggtgcacagattggtgcaatcattgagaactcttcggtgacgagcacgaatggtttcaccgtgcgggcaacgcaatatgccggtggttttgccggaataagtcgcaacggcaacgtgggcggtctgattaactcgcttggcgtcgacttgctgtctgcgctgcgtccgcagagcctcatcgaaaacagtggcctgacggtaaacggtgacgataagatcaccgtgcaggccgaagactacgccggcggcttcaacggtgccatggccaatgcctatgctgtcaataattcgattacggcttcggtcgccgtgactgccgacagatcccacgccggaggattcaccggattcgcctccgtgggatggggcctggaactcggtacggacgataccacgaatgcatcgctgttgaaacagctcaccaaggctgtgactaaattgctgagcggcagcgataacggtgcaggagaactgctatccatcgtcggtgtgaatccttctgtgattctcggtacacaaatgaagggttccctcacagttgctgccggcggtgattacgcgggcggccttgtgggcgaaggttcgggtacggtgatcggcgactcctcacaggatcatctcaagaatctcacattctggaagtacaacaatcttcgtgacttcccacagcagcgttccaccaccatagaaggtcttgaatcggtcacggccacgggctcctacgcgggtggcatcgccggcaatctgcaaccgacaacggtagctgggttgctcaacagtgtggtgaaaattggcgatattgccacgctcaagaagttcgaccagtttgccgcgttcaccgtggagaacatgtctgtcaccgctccggcatccggcttgacagtgacggctggttcatattatgcaggcggtgccatcggatgcgccaccggcggcgacgtggccaacacgaaccttaccaatctggccacggtctcggccaggggagaagccggcggttttattggcttctctggaccaggcgacgccatcggcgctggcggtctcaatgtgcttgggcttatcaagctttccggtctgctatcggttgcccaatattcttcggttgcagtcactgcatcgaacgtgaacggcatctctggcggattcacggttgcggcaaccggcaagaacgagaacaacgaaacaaccgattacgctgcaggcggtttctatggtcaggccaacagcaccaagacccgggaaagccatgtgacaaacctcaaatcggtcacagccgataccagcacgtccgatggtgtggcaggcggtttcgtgggcttctccaccaccggtggcctcgccgacgcgctcagcaacgcagaagattccagcatattggatgacctgatcaaaggcggcctgctgtccgtgaacgacttgctcggtgccgtaccgtatctgattccaagttatacggataccaccgtgacgtacgtcaacggcggttatgtcgaaggcgatatcgcgggcggctatgcgggaaacttccaaagcggcaaggtcaaccagttctccgaaaccgatctcaagaacgactcaacgctggccggtgtacagtcccgcgtgcaaaccaaccccgtggccgttgtcaaccttgaccatgtgactggcggcgcatacgcaggtggtttcggcggcaaggttgtctccggtgcgctcgcttcggctggcaacggcggcctgagtttgctcggcaaattcggtacggtggatctcgccaacctgttgcaggtggtgcagggctatgtgccattcatctcctacgcgggtgtgcattccgatgccaccaccgtggaggcaactagcggtaacaagatttccgacccggatgatcccggcttcaccgtttccgccacccgatttgatcagtccgatacgcaatccggttccgccggcggctacatcggatacggttccggtgtgcaggtgtcccattccagtgtgacccaactgcgccgtactgatgtcaaggcaccgaagaatctggaaactgccggatcaatcgatggcacctatctgagcaaagacagcacatatgcagtcaccgctgcgcgatacgccggcggttacatcggcaaaatggacatcggctcggcggcagctgtgggcggtggcctgagcctgctcggccagaacgtcaatctcaacgatgtactcagtgtgctggatgtcgtcgtctcgtcgattgaacactccgatgtgactggcggcatcggcggatattccgttctggccagcaccgcaaatcataggaatgccaacaatgagcccgatccactgggtatggctggtggtttcgccggagacattgaaggcggctatattcaggactcgagctctcatgagttcgtatacatcatcggccaggtttcggccggcggttacgtgggcgccatgcagccgggagccgtggcgaacgtgcttggtgacggcagcgtgctcaagaagcttgtcaacctcgacaacctgctctcgctcgtgcaggacttcgtgccgacgattcgcaacagctcgaccgatgccgcagtgtgcggcggcgcggtgcgtgcccaggcggcatcggatacgaccacacgccgcggcatggccggcggctatgcaggtcgtaatcgtggcggtcatatctggggcaacaacacagcagcgtggaagcaggagaataccgacggcaaatacaacgggccgcagcgcgtagcctacgccgcgcgcatccgcagcgtatacggtgccgaaatcgccggcggttacaccggcttcatggaggcggccgataccgctcaaggcggttcgctctccttgcttggcggtctcatcaaggccggcaatctcgctggcgtgctgtctgtggtctacccgaccgaggagcactcgaaggtcactggtcctttgcgcaatatgagctacgaccaatggaagacgtgggccgacaacatcggcaagtacggtgcgtatggcaaggaatttaccgaggtagctacgggcgatggtgcgggctctgttactgatcaggattccctggacaagttcctcgaatcctacatcttcggattcaacgtcgtcgccggtcgtgcggagtatcagactggcgcgaacttgcatgattccggcgtcgccggcggacacgtcggtctgatgtgcaccggcacgatcaccgatggccagtcgatggatgtcaagaccgtctctgccatgcgtgcggcaggcggttatgcgggcacgatggaatccggctcggcatcctcgttcggctctatccaactattcggcgacaaaggcatcaaacttgatttgggacagatgctcgacgtggcacaggtatttgtgcccgtcgtcaaatcttcgagcgtggccggctaccgcaagggtatgaaggtcgtggccaccggtgaagacatcacgcacggtaccggtaatgccggaggctatgccggtctcgcggtcggtggccagatctggggcgatctcgaccagaacggccagaagcttgtcgagggtgtcaccgctgccggcgccaacgtttccaacctgcgcaaggtggaagggcgcaacaatgtcggcggatttatcggcgtggccactgccggtgcggttgcggatgtggacaccaatgcgtccgagggattcctgcaaggaatcctcgactcgctggtatcgaacccggcaagtctggtcagcgtattgcaggccacggttacgacgattcgcggtgcacatgtgagctcggatgacccggcatggggatacacggtcaatggcgcatatgagagcaaggacgataagggtaataccacagccaagtatgccctgaacgccggcggtttcgctggttcgttgcaagccgcgatcctcggtgacaaggattccgccaaaggcaccggcagtgaagcggatccgaacaatgacccggcttctcttactgttaacgggctgcgcgctgtcgaaggcgggcaatacgccggtggcttctttggccttgctgatgtatccagcgtcgcttccgtcggcggcggcgaggccggcgataagcaggataccaacctgctgctcaaactgctcaaggttggcaacgtgggcgtgctcgaagcattccgcaccttcatctatgacggtcaggtcaacggtgtgagcgacggcatccagattgtcgcccatgattccaccacaaagggcatgcttgactcgaagcgttacaccggtgcggtcggtggcttcggcggtggactgatcaatggctctgtgaagcagtctgcggtcaccaacctcaacagtgtgaccggcgtgaactacgtgggcggcttcatcgggcatcttggcaaatccggcacggtcgccgccgacaatgcacaactcggcacggatgcgctcaatctgcttggtgccacggccggcgtacttgacatctggggctcgcacgttggcgattcgcgcgtcaccggcatcccggacggttataccgtcaccgccacacaccatggcgacaattacggcaaagccaccgacaaggctaccggacgtgaggtcgcaggcggttttgttggatacgtggatttggccagggtgaagggctgcacgtctgacaatctcaagaaggtcactagcggtgagattgccggcggattcgtcggtgaaaccagccgtgcctatttggttgacgcgaaggtcaactctgtacttgtggaactgctgctgcaagtggtgaacgcgctggtcaagctcctgtacctcgacaaggcggaacaggtcggcgtcatcgatttaggcaagtggttcccggccatcttcggcaaggtattcgatctcaaggtgctttcggaaggcgacgtgctatacgtgaacctgttcggactgaaggtgagtgttgctctgtccaaggctgatgatgaaaaccagcagcagaccgacgtggcgattgtcaccatcggcgatagtgtcatcaaactgccttgcagcaaagacggcattgatatggatgggtcaggcagcaacctgaccgtccagctcatcaagggcaaccgtacgcgcgtcgaacagtccaccgtaacgggcatcgccaatggctatgacgtgttcggcggaggggcaactcaggataccgacggtgtgaaggatctttccacaggctacacgggcggcttcgccggactgaacgacgagggcgtgctggcagacgaccacatggtctacgccgacacgatccgcggtgccagcggactggtcgacccgttctcgaacaccaaactcaagtccgtatgggacttcaacaccatgagcgacatcctcggaccggtcgatgacggcaacggcgacaaggcatacaacacctatcgcatttaccgcaaggcggccgcgaacgctagtgaggcccgcacctccgcacaggacggcaacaagatcttctcgcagaagaacacggcagacgatgcgctgaacaccggactcgatcgttgggaagtgaagctgttcgacgtggtcaacacatacgacagcagcgctgtgcacagctccgcatccggcgacgctggtaccacatgggttggcatcaaggatgccgtggtcgactccacggacggcagcaccaagacgaagctcgatgcctaccagtccccggccaaggccgtgctcatgctcgacgcgaccgtgaccgacaacaacggcggactcacccccgaaccggacgacggccaggacccgtgcggcaaggacggctgccggagcgttgacttgaccgtgcagaaggtgtggaaggacggcaacctcgaacggccgcagtcggtcgaactgaagatcgccgcgcactataccgatggccgtggcaatacggtgacgccgcagacgattcaatgcttcggcgcggattgcacaaccgtgacgcagaagaatccatggacggtgacgttggactcctccgatgcctcttcctggagcaacacctggcgcaaggtgattcaaggactgccggtcgcattcgtggatggacaggatgccaacggcaaggacatcgtgcgttactacacgtacaccgtggaagaaaccgccgtgacctataaggacggcgataccaccaagaccatcaagcccgcggaggccggataccaagtatcggtctcctacaacaccaaggaacgcgtggccattgttaccaatgcggcgttgcttccggatacgggaggcgcgggcacgatgtggtttctgatgttcggcttgctgcttatgggagctggcgtggtctggtacgtgcgtgatcaacgcgttcaatccggcacagtccgctcgggctccagccgtatacgaaagcgaggtgcccatgccgcgtgacgactacatagacaaaccgtatctgccaaacagaaaagatttccatttagaggaaggaacagtaatgaaatcactgatgaaaagggttttcgctgccgctgcggcgattgccaccgtatttggattggctgcgacgacagtcgccacggccaacgcagcggataatgccacgctgacggtcagcactactgacgcgaagttcgccggtaagaccgtgaacgcctacaagatgttctccgccaccgtgagcggtgacggtggcagcaaggctgtctcctacacgttgactgacgagtggaagccgttcttcaagaactccactgcttccggactgactggtgctaccgacgagaacgtcaacgataaagcaaacgactacgtatccaagctgaagggtgaagacttggttgctttcgctaccaaggcatcgaactgggcgcagactaaggccaacaacatcacggctggcacgaccgctaaggtatctgccgctgctacggacggtaagtacttggcgacgttcactggtctcgactacggctactacgtggtcgctgtgccgggtgcgaccttggccaacgccagtggtcaatacgccacgctagtttccgttgatagcaccaatgtgactgccaacattaagggcgacctgcctaccgtcgacaagaaggtacaggtaggcggcactggtaaggacgccactgacgcgaagatcggtgataccctgaccttcaccctgacctccaccattccagacatgtccgcctatgacacctacaccttcaacttcaaggatacgttgtctcagggcctcacctttggacaagtcacttccgttacggtcgaaggtgtgactgatccactgaccgtgaacactgactacaccgtcaccactcctacggtctccgacaatacgcttactgtcgccatgaaggacttcaaggccaagcagcaggccaatgccggcaagaagattaccgtcacctacacggccacgctgaacgagaaggctgttgtgggcggtgttggtaacaccaactccgcaacaattcagtactccaacaacccgagcagcggtggcaccggtgagtccgaacccagcaaggttcgcgtcttcacttatggcttcaccgtcgataagtacactggtgacaaatatgatgatgacgctactcgacttgctggtgctgagttcacacttgcacctaagaacggcatcgctatgagcttcgtgcaagtcgatgccggtagtgcgaccgcgaacgctgtataccgtgtagctaaggctggtgagacagatactacgacgactatcaccactcctgcaagcggtaaggttgtcttccggggactggagaacggcgagtacacgctgaccgagaccaaagcgccggccggctacaacaagctcgccagcgccatcggcgtgaaggttgatggcaagaacgacggcactgacaccacggatgccaccgtcgccatcacctacaacaacgacaatggcaacagctacaaccagaccgcatcgaacggtgtcatcccggtccagaacaagtccggtgctatcctgcctggcactggtggcatgggtaccatcgccttcacggtgattggtgtgctggtcatcgcgctcggcgttgcctggactctcaagcgcaagaacgcctgacgagcatggccgtgttttgggcgtgaagggcacacacccgctacgcccacaacacggtttcctcgcgaaaagaacgctcgatgaaacgactgcgcaacatcctgcccttactggtcattctcggtggaatgctcattctgttctatccgacgatcagcaacttcctcattatgcgcaacgccagccgcgccgtaaataactacgacgccagcgttgaagcattgagccaggaacagtaccagaaggtgctggatgctgcgcacgcctataacgaaaagctcgcccagaacgatgcaggagagaccgacgctcttgccagtgccgtcaattccgcatccacggacgaggaatacaacagtctgctcaatattgacggcgacggcatgatgggatacatcactgtgcctaagctcgaggagaccttgccgatttatcacggcacttccgagaaagtgttgcaatccggcatcggacatctcgaacagacctcactgccagttggtggcgcgtccacgcatgcggcgctgtctggccaccggggcttgcccacggcaaaactgttcacggacttgaaccttatgaaaaaaggcgacaagttctacatcacaatacttaaagacacgtatgcgtatcaggtcgataagatcactaccgttctgccgaccgataccaaacaactggcaattgagcccggcaaggatttggtcacgctcatcacttgtacgccgtatgcggtcaatacgcatcggctgctggtgcgcggccatcgcatcccatacgcgccgcagcagcaggatgacgccaaatccacgttccacgtggacattccgctgcagtacttgttgccgtctcttgcactgattgccttgctcatcgcatggcatttatggcagcgtcatgagcggcgacgccgacagagtgggagcgccaaggtcgcgtctgatgattctagctccgcagccatcgagccggacggtggcttgcctcctcagccagacagtacaaataaccaatcacattcatcacggcgaaaaggaccgggcagacatgttagacctgcatagcggaagcgaatatggtgcggcgcgcattgctgccatgattgccgccgccgttactatcgtcctcactgttcttgcagccttcggctctatggtgccgtatgcgcaagctgattctttcggcgctctcaccatcaatgccgtatggggccgagacacggcttcgcccaaatcgcttgccggcgacacctattccatcgtgcgcgtcgccaccgtcacaacgaacaatgatggtagcgtctcctcatataaaaccgtcggcgatttttccggcctcactgccgattgggaacgcctgacatcaagtgaatatcacgatgctgccaagaagctcgctacgcacgcggcgaaaaacaagctgtaccagcattccggcaccactaacgtagctggtcagctcactttccagaatctgccgctcggtctatatctggtctcccgcacggattcgacgaaagccaacaaagcatacgactgtgatccgttcttcatctcgattcccggcagcggagacacagccgctgatctcaacatcacagtagagctgaaatttagcactggaactcctgttgtcccgcccgaaaataacccgagcgaggagccgggcaatcctggccttatcggtcgtacgggtgccgccgtaggcagcattgccgcggcagcggggctcatgttacttgttgcgttcattttgttcagattgcgcatgaggcgtcgcatacgggacgtcaattcggccggcaaatcccatacagatgattgcacgatgaagtgaaaaagtaagcatgagcgacgaacgattctctccggaacaagcacaatatctggcttcgctgcctgcggtcataagtattactggttcacgtatccgatatgcagagtggttcaagcgtgaatgcgtttcgagtgctgaaaatggtgaatctcccactgtgctgttccgcgaagcggggctcggtcctgagttgataggcgaaaagcgtattgaacggtgcatgcatcgttggaggaagacaatacgaatagaagatccaggtacggtagacagagtgaatctccccgattctgaggttacttccagtcgcacgaatgaaggtaaccctgaaaccggtaaatgatatgcgtgatttgattatccgtcgacaggcgctttatatcagacgtttggaattaaaagtcgatgacctaaagatgcagctctcgcagcaatccctatcaaatgatgtgcaatgagttgtgctggataagctgagagcgtcatcactattgtctctgattcagtatgagatttgtttgaaacattggtgattcgtgatttgcgcgtgtatctcgaatcgatgggtggcacgaatcgaatcgcatattatcgggatgaaaaaggccttgaagttgatgtgattcttgaattggtggatggtcgctgggctgcggtggagattaagctgagcgacttgaaagtcatggagaaaaatgtggacaaactacatgctttcaaagaaaaagtgtgcggaaatcctctatctcaagttcgtgagcctgaattcatggcatttattgtcgggcgtggtgatattgcataccggcgtgatgacggcattctggtgctgccgatcgccacgctcggggcgtaacaaatgaacgttgcggcaggtgggacaattgggggaatgaattgaacgaaggagacggtgtgcaaggagtgcggcagatgcgggaatcgcaggaatcgcaaaaaacacgagaatcgcaggagtcgcagaatcctcaaggaacgcagccaaagattggcagaattccggcgctgattgcggcggtggcgattgtgggagtggccattggcgcggccgctggcctgctgacgcttatgctgtacggcgtcgagcatcttgcgctcggctatgttgagaattcgcaggaatccggcccgttcaacgttcctgcgattcgtcgactgatttccgtgaccgcgggtgcggtcattgcggccgtgatttggtggctgttgcgtacgcgcagtacgaaggtgccgtccgtcaaaaaggcggtgaatggcgatattatgccgatttggcagaccgtcgtgcatgtgttgctgcagattttcattgtcggtacgggcatgtcgatcggtcgagaagtggcgccgcgcgagttgggtgcgatgttcggtcaacggttcgcgcgttgggtgcatcttgacgcaaaagacacccgcatgctggtggccattacggccgccgccggccttgcgggcgtgtataacgcgccgcttgcaggcacgtttttcgcggtcgagattctgctcgccgacataaccctcgaaacggtgacgctcgcattcgcctgttccgcgctggcttcgtgggtggcgtcgctggtcaaaggcacgcacgcgttctacctgatcggcaaagcggacggcctgttcacacccgattacatggcgttcgcactggttgcggggctggttctcggtgcggccggcgcactgttccgtcgcggctcgcagtgggctgagaaatccaagccgtcgggcgttggcattctgtggatgctgccgctcgctggcttgctgaccggcgtggtggcgatttgggtgccgcaggttatgggcaatggccgtgccaccgcgcagttgagtttctcgtccgacgttgatttggctgtgctgccgattttgttggtttcattcctggcgaaggcgattgtcacattgctgacgatccgttccggcgcttccggcggtgtgctgcagccgggtattgcgctcggcgcttcggggggtgctgtgctgggtgttctgtggatgcaggtgtttcacacgaattcgattggcatgtatgctctgctgggtgcgtgcgcattgctcgcagcttcccaacaggctccgcttatggcgatttgcttggtgatggaacttgcggatgctccgatcaatctgtttgtgcccattggattcgcggttgcggtgagtgcgttcaccgcatcgtgtttaggggagccgcttgccgctttgcgcctatcgaaaagtgcggaaaagaaggtaattaaggcgaatgcgcgttgaagggtgtgttaggcggtaaactagggggtcggcgtatagatggtcgatgctgagcgcccgatgatgaagaaggacgtatgacgaaagacaacaatttcaggctggaatttccgacggataccgaggtgatgggggctgacatgtccgaaccgccgaagcctccgacggtcgcttcgcaagaaagcgatgtgaacggtgtaagcgatttcagtgttttcgaggattacggcgattacagcaatgaaattccggtaccaccgaagaataccggcaaaatcgtcgctatcgtgattgcggctatcgtcgtgattgctttgattggcggtattgcatgttggatgctttcgaataattccaagaaatcagccattaccagcgcagccgcgcaatgccaggattccacgagccagctgcaaagtgccaataacacgctttccgacgctttggaaatcggaaaaaccggcgcgaaggtcactgccgatcaagtcgccgatgtcagcaccgtcactaagctcaatgcggccatatctaacgcgaaggaagcgaaaatcctgtcgtgcgacacgtcgcagggcatcagcaagctgaagaaatccgcgaaagccatggcatccgaggcgcggagcatgaacgacaaggccgaaaagattacaaatgcggccgaagccgtcgacgcttccaaagtgctggccacgcagaatcgtctgaagggccagctcaatgacgcgatcgagcaggcgcagtccgtgctcgacaattccgacggcatggtggccgatgacagcgtgcgcgtggcattgcagcaggcgattgactcggccagaaaccttgccaatggcaccaatctcaaggaaaacgacgtgacggccgccgttgacgcgctgaatgccgccaaagacgccgttcagcaggcgatggaccaataccaggaggcgtcgtcgactcctaacaccgtgacgaacaacaccaatatcggcactaacgggggctctaacggtggtgctgcgaatagtccggacaatacggctggaggtgctgcggctggcgggtcggctggaggtgcggcgaatgccggcgatgctggtggcgacgcatcggcaggcggtgatgccggtgatgcgtctgacggcgatgccgctgcgcagaatcttgaaaactagcggagccgccttaagccttatggccagtcctacatggccataaggccggttttccgcggaataagcgcggtcagcacaaaccagtggtcttcggtgcgaatcgtcacttcgccgccatactgctgcgcgatatgacgaatcgacttcacgccgaaaccatgccgatgctgatcgtcgcgcttggtggtgcgcagattgccttccgcatccttcttcaatcgggaatcgtaataattctcaacccggataacaataaagcgattctgctcgtataacgcaagtttgatcagacgctgctcacgtttcggcaatttcgacgtcgcttcgatcgcattgtcaagcgcgttgccgaacaatgatgcgatatccatcgacgacatgccgcttagcagcgagccgtccgcgaccgccgtgaacgtaatgcctcgatcggcgcacgtgcgctctttcgtggtcaaaataacgtcaagcacgggattgccggtatgctgctgcgcgctatagcgctgcaccgattgctccagctgctcgaagccggccgcggcatgcttcggatcgacttcggcacgcaacgccgcaagctgatgcttcagatcgtgcgcaagacggcctagcgattcgatattttccttcgattgcaggtattcctgatgctggctttccagctgcgcgttgatcgacgcgagttccgtattcgcctcaatacggcgcgcctgctcctgctgcgcatataggatcgcgaaaccgcagaaatcgaccagcgtgcgaatgtagaagatttcctggccgaccgaaccggaaaacggcgtattcgtcgacacgaaactcaaattgctcatggcgaacgtgacgatcataatggccatcgtcgcaatcgcggcggaagcggtcggcaaggtaggtgtggcctggctgaaattgccgcgttcaaccatccaagctagaccgaagcacagcgcatacgtaacgacaagcagcgcgatcgcgcgccaatcgtaatcggtgaatccgtcgcgcacgccaatgaacgtaacgatctgccaatgcagcgacgccaccaattcggccaacacgaacgcgcgcgccgtaatatacaggccctcgcgtttgccggtgcccgcgccgagcagaatcgtcgcatacatgcaggcgaatgcgagcagcataccgatgatccagaaccagatcggcatactgccgtcgaaatactgcaccgcgaccagcgatgccaagccggccgcactgacgatgatcgaccgtcggagcggcacgcgacgatacgacaccgcgatatacaccatgcacgcggcccattcgcagatcgccgtataagaacgggggatgtcgggcagagcgttggtgattggcgtcatcggcggcaccgaaagcacggtcaccaaaacggaaggtatggaaggggagcctcctgccagtcctcctgccaatccggccagcgcattcggcaatatcacgctggtcacctgccacctcctatatagtcggtcaacgcggcgaggaacgccttcttgcgtggtcggcttacgcgcaactgttcgccgttcgacatcacgcaatcctggtcggcgacgcccgtcacatgcttgagattcaccagatagcaggaattcgagcggaagaaatggtggtcggcgagtttcgcttccatgtctttgagcgtgccattgatcgacagtttgccttccaacgtgtggatgacgatggtatgccggatcgattcgagatacagaatatcggcaagattcagccgcatctgcccgttgctggtttcgataagcatggaatcgtcgccattgcgcctcaccatgtcgatcgacttcttgagttcctgtgaaaacgcgaaccacggcaggggcttgagcagatacgacaatgcgcgcacctcgtacccgctgatcgcatactgcggtgcggcggtgatgaacacgatcacgaccttgtcgtcgcgctcgcgaatgcgtctcgcggcggccatgccgtccatttcgctcatttcgatgtcgagcagtaaaatatcgtaaacaggggtatatttctctacgattctcgcgccgtcgtcgaatacggaaacggtgaattgttcgtcattttcctgctgatatcggttgagatagtcaagtaccagctggcagcttgcgggatcatcctcgaccacgccgattctaatattgcgcactgcaacctccctgttctgtctttcgctccgcaccattgtcttgcatgatggcgataaaggcgtgtatttactacgccgttaacccccttttgccagcgtaggtaaacagcgcgactcgcgacacgcattgacagttttagcgttgtatgtatcatggaacgtggctcaacgaagagaaccttcgccaaaccaaagaaataaattaacgctttgaattgtggctttgtcgaagtcgtaagccgcaaggcgaggcaccgaaaagaaatccctttacaacggatcgtgaggcacgtacctgcctctgaaaggatgacaaatcatggcagaagtcgtattcgaccatgttactcgtatctacccgggcaacgataagccgtcggtggatgatttgaatatggacatcaaggacggcgagttcctggtgctggttggcccgtctggctgcggcaagtccactactctgcgtatgctcgctggccttgaagaggtcaacaagggccgcatcctcatcggtggcaaggacgtcaccacgatgcagccgaaggaccgcgacatcgcaatggtgttccagaactacgctctgtacccgcacatgaccgtggccgacaacatgggcttcgctctgaagatcgccggcaccccgaaggaagagatccgcaagcgcgtcgagaaggccgctgagatcctcgacctgaccgagtacctcgatcgtaagccgaaggctctgtccggtggccagcgtcagcgcgtggccatgggccgtgcaatcgtccgtgagccgaaggtcttcctcatggatgagcctctgtccaaccttgatgccaagctccgcgtgcagacccgtacccagatcgctgctctgcagcgccagctgggtgtcaccaccctgtacgtgacccacgatcagaccgaagctctgaccatgggtgaccgcatcgccgtcatcaagctcggtgtcctgcagcaggtcggcgctccgaccgagctgtacgatcgcccggccaacgtcttcgtcgctggcttcatcggctccccgtcgatgaacatcaacacccacccggtggtcaacggcaaggcaaagatcggcgaagacaccgtggatctgccggccgaggccgtcaacaagctcaccgctgaagacaacaaccagatcgtcgtcggcttccgtccggaagacgcttccctggccgccccggatgacgccaacgccttctccctcaaggtcatgaacgttgaggatctgggctccgatggctacatctacggcaacatcatcaccgatggctccgctgctgaggcatccaccatgatgtccgatcagaacaagctcaccacgatccgcgtgaacccgcgtgctctcccgaaggtcggcgataccgtcaagatcaagatcgacccgtccaagatgcacctgttcgctccgtcgaccgagctgcgtctgaactgagctgatatcgagtaaccaaccgttggctgtttcttcaggggaatatcctttacggaaatcggctggcgggtggctgaataaaaacttggcggaagcgcgaacttccgtcaaccattaaacgagacgtgctcttcctctcttatcgtctcgttggagaagccccgcgtcggtgcggggcttcttttgttttccgcaagcacgatatcggcttgtaatgtctgtttgtagcatcgatcgcaatattcgatcgtaatatgagatggatagtgagattccagtattgagatcatcgcatatcggcaggtgaaacggattcgtccatacttgcttcttcgggtaggtcaacaggtaaattgttgattcatggaatctcttgaattgccacagatggatccccgtgtgctgaaagcaacttccgtgaaggccgaagatccggctgcctcatctccggagccgcatgcgctgaaaatcaccgccgcaagctcgaatccaaagatgttcaccctgccgtgggaaaagccgctggctacttggccggaagacctgctggctaatcttccgcgtggtatttccaggcatgtggtgcgtttcgtgcacgtaggcgacgaagtgtacgccatgaaggaaatcacgcgcaatgtggcggaacgagaatacgagctgctgcgtcgcctgcagaagctggaactgccgaccgtgcagccgatcgccgtggtcacaggccgtcatagccgtgaaggcgagccgctggaagcgatccttgtcaccaagcatttgaagttctcactgccgtatcgtgcgctgttcgcgcgtaatctgcgccctgataccgcggaacgactgatcgacgcgttggccgtgctgatggtgcgtttgcatttggctggcttctattggggcgatgtgtcactgtcgaacgtgttgttcctgcgcgacgcctacgcgttctccgcatttttggttgatgcggaaaccggtgatctgcagattaatctgacggaaggccagcgcgagtacgacgttgatttggcccgtacgaacattattggcgaattgatggatctttcgtccggttcgctgctgccgagcggtgttgacgaaattgcgatcggcaaccgtttggtggatcgttaccattcgctgtggagcgcgctgaccgataccgacaagttcggtccggatgagatgtggaagatcgagaagcgcgtcaacaagctcaatgagcttggttttgatgtggatgagctggagatgaagaccgccgaagatggcaagcgtgtgctggtgcgtccgcgtgtggtcgatgccggctatgcgaatcgtaagctgctgcgattgactggtcttgatgtgcaggagaatcaggctcgtcgactgttgaacgatttggatgcctaccgcgcttccacatggcgtgagggtgaggatcttgagattgttgccactgattggatgcgcgaagtgttcgaaccgaccgtgcgcatgattccgcgtgaataccgttcgcagatcgaaccggctcagttcttccatgaagtgcttgaccaccgttggttcctggccgagaaggcgggtcatgatgtgccgatggccgaggcggtgcaaagctatgtggagaaggtgcttccgcagtacaagctcaccacgaaggatgtggacgcgttgaacgccgaagccgattccggtgtgatcgacgacgaatacacctacgacgatcccgacgacggctacaaccccgacgacgatcccgacgcagctgtatgggcacattgatagaaaaagctccagtggagctttttctatcaatgtgccctgagacgaggcgatagccgcgccgaaggcagtattgagtctgcggcgtagccgcagtcaaaaattgcagggccgagccgttaagcggaggaccactaataatcctccgctttttgttatcccttcacacccctcactttcaaaactcaaaaaaattttgacttttgaaagtgagagaacgtgttgcgagagatcgttggcgggggagtgggtctgcggtaagcgcaaaatcaatccaagtacagatttgcgcaacaaaatgagcggataatccgtatggactatccgctcatatgtatttcggacttgctgccttgttgtgcttacttcctgttgcttcgtgttgattacttcgcgtcagcggcggcaccggcctcgcggcgggcgcgtgcgacggaatacagcgtgatgcccgctgcgacggaagcgttcagcgattcgaccatgttcgacattgggatgccggcgatggaatcgcatgtctcgcgtacgagacggctcaggccgttgccttcggaaccgagcaccacaaccagcggatcggtttcgaaaccggtttcgccaacgagggcgtcgccgccaccgtcgagaccaacgctgtagtatccgcgttccttcaggctttcaatggctttggtgaggttcaccacgcgggcgaccggcatgtgcgcggctgcgcctgcggacaccttccatgcggctgcggtgaccgaagcggaacgacgttccggcaggatcacgccgttggcgccgaatgcggctgcggaacggatgaccgcgcccagattctgcggatcggtgacgccgtcaagcgcgatgaacagcggacgtgccgcaatgcgtgcgcttgcggagttggccgcttccatggcacgagacttcttgtccgcgcgttccaccagctcggcgagcgaggaatactggaacggctgcgccttcatcaccacaccctgatggttggaggagcgtgcgatacggtccatttccagtcggtcggcttccatgaggttcagtccgtgaatgccggcgagacgaatgatttcacgcgtgcgatcgtcgtgctcgatgcgtgcggccacatacagcgtgctcgcgggcacgccgcagcgcaacgcttcgagaacggcgttgcgaccgatgacgagatcgtcggattctgagctgaactttgccgcgcgacggcgtgccgccagtcgcggatcagccatcttacgacgattggtagcctgcttttccttgtaagccttgtgatatacgcgatcttcggccttgggggtcggtcccttgcccctcagcgcgttacgatgctttccacccgaccccttggtcggtccttttttcattgccatagttgtccattctcccagcaccccgggaaaaggctactggcgtcgcgtccgctcgatattgctcgatatgatggcaagaatggagaagaacaaagagattttcggattgcccctcatgttctggggcttgtgggtcacgctgcttatcctgtggatgggccgcttcgtcacgtcattcctttccatgtatctggtgtctgacatgcatgtcagcgcgggcgtggccggcaccatcgtctccatgtacggtttcggcggcatcttcggctgcctgtatggcggcgcgctgtccgaccgcttcggccgcccggcgatgatcgtcatcggcaatctcggctccgccgcgatgctggtcctgctggcgttcatcggcaatccgtggatcatggcgatcgcgctgctggcctacggcgccatctcatccatgccgacgcccgcggtcgcggcgtacgtgtccgacgtggtgccgttccgcaaacagaagcgcgcgtattcgctgcagacgtgggccgcgaatttcggcttcgcgatcggcccgatcatcgccaaccagttggtgaagatctcctatgcgctgatgttctacgcggaagccgcggtgctggtgttcgccacgatcttgatgatcgtgttcttcaaggaagtcgggctgggcaagcgcccgcggggcgaggtcgcgccggcgcgggcgtcgcaagccgcggaatcagctgcgggaaatgccgtggaacatgctgtgaaacaaaccggcgaatcgcagcggccgcagcggttctccgtatggcgcagctatcgtcgcgcatgcgccgacggcgcgctgatgtcgatggtggtgctgatgttcctgtacacgctggcgtattaccagatcgtcagcggcctgccgatttccatgacgcagatcggccttggcacggatgaatattccagtctgctgaccatcaacggcggcctgctgtgtctgctgcagattcccgcgatcggtctgttccagcggatgagcaacacccgagtgctggtgctcggcatgtccatcacggcggtcggatacgcgttccagatcggcgcgaattcgtgggtggcgttcgcaatcgcgaccgtgctgtggacgcttggcgagctgggcacgttcccgattgccgccacaacggtggcgaacatcgcgccaaaggatgtgcgcggcacctaccaagggttatacaacctggtgtggtcgctgtcgaacgcgttctcgccgttggtcggaggctggattctcaacgcgttcggcagccgtgtgctgtggatctgctgcacggtgatgttcgtcatcgtggcaatcggcttctacgtgacgcgcggcccacgcgaacgcgccgccgcccgcaatctcgctgttgaggaggggtagccggcgtacgtgaaaagcgggaggccgcgattccgtttggaaccgcggcctcccgctatgtgatttaaggattggaaagaagaggggcgaggtgctgtggcgcctgcgccttgcctcccgtctaggaagcggtcttacttgttgaggaccttcttgaagaggtcggaggaagccttggcgagtgcgaactggccgaagcccggatcgatggaagcgaggttggcgttgatgacctggttgaaagtgttgttcttcatgatgtttcctttcgttcggcttggcggcgcgtatctgttttcttgtccattcctctggccgctgccgtaagtctgtgtttgttgtctattttcttttcttcgttcttctgttgtgccttcatcttacgtcgggcaagtcgacaatgtcatgcgacgatcgtcacttcttttgtaaaatcatcggctaatcttgaagaaaaagtaacgttcgctgaaaattggcggacgcatcttatagtccatattctttgcgtctcttgttggctttgatgtaagcgtcactatcggaacgaatgccaacgacgatgatggtcatgattccatttcgcagtaacggtttgtaaacaacgcgaatgccgatatccctgaatttgattttgcaaagcctggaaagtttcgttcgttcggcattgcgtaacggtttgccatacccgccttgcgaggtgggcagtgggtttgtgcgaactttctcgattcccttgagtacttggatttgctcggctttgccgagtttgcgcatgtctttcttggcttcgtcaagccattcaacttgccagttcatgcgagttccggctcaggtgcctcggcgaggtcgcttggggaaatgccgagatcgagcatgacctcttcgttgctgatagttgtgccagtactgttgtcgagtcttttttcggcaagaagcaagtcttcgttgtcttcgattcgttccatgagagcgcgatagttttcgatattcatgagaacgtaggacggcttgtttcgtttgatcagaatgactggatcgtggtcggcccgctgcaacaatgcggaagtacgaccattgctgagctcgctgattggaacaaggtcatcgagtatgtcaagtgcgcttgccatgataaacctttcttaaaaccgaatttcatacccaattatataccagtattaataccaagattcatggttgtgcgactttgaatcttggtataaaaagcgatttcgctatggaaagggcaccgagctgttgcttggtgcccctgggaaaacagagataatcagactttacggcccgcgccgcaaaaaattacttgcgcttggacttgccgaaggtgaacgcacgtacgatcgcgacgatgccgatcgccacaagcgcgcatccgccgaacaggatcagccaggtcgtggagctgacgggggagaacagcacgatgaagccggcgacgatcgacagcagtgcgtagattacggcccatgcggagcttggcatgcgccacgattccacgagcgccatcacgccttccagcatccagccgagaccgaccaccatggtgatgagcacggcgagtgtggctccggaaagcgccgcgtttttcagcatgaccacaccgccgacagacagcatcaggccgatcagaatgtcaagcacgcgccatcctcccggaagcccgagttccacgattgcggtcacaatgcggaccacaccggaaaccacgaagtatgcgccgagcgcgattgcggcgaccttcagtgtggcaccgggccaaatcagcagtgccaggccgagaatgacggcggcgatgccgagtaccgcatacgtgccgcggatcgcgttctttgccttcttcgggagccattcctccatgagcttgaacgggctgatcggctgccaattgttggtgccgttgtcagcgtcggattggctgttctgctgtccgtatggttggccgtacggctgaccggtggtgtagctcgcgtagaagaagccgttctggttgggattcgggttggcgttgggaccgtcgaagtagcatggggtctgaggctcgctttgatacggattgcccgaattgttgggattgccgccctgctgctgggattgcgattgctggtttggtgcgtatgccccgtattccggctggccttgcggctgctgttcgttgctgccattttgattcggattgttcgcatacgggttgttcattgcgtcgctcatgatggcccctttcctggaagagcgtgcttcgtgatgctcggacgcgcgcgaatttgcccgcctgcgctcgaacgtttcggaagttctgccctcattctaggcaatccgtctaatttaagccatcaacaaaatccccctcatcgtccattttgatggactgatcgcatgttttttccgaattgtcgcacgatcttgcgaaatcgtgagacagaactgcgaatcgtgaggccgaaagtcaacttgcggcacaacgaatgcctcccgatccttgaaatcaagaatcgggagacatttcgcacgtaggaatcgactgaatccttgaaactagaacaggtcgagggctacgtcgaggttgagcggctggtcggcgggcagctgatactgctcgtgcaccgggctcatccaggaatcgtcgccgccgacacccatctgagcggcgagcacgcgcaggaacatgtgcttcggctccggcagctcgtcctgatgcagcgcctcctcaagcatcgtgctcgaatacggcagcaggctcatcgcaaacggcttcgtaacgccggtttcagtattcgcagtctggctcacgcgcaagccatgaccagaatcgtccgtaatctcagcccaacgcacgtcctcatggttgccggtttcctgcggcagcagatacggcgcgcgatcgcggaaggcgttcgtatcccaaatgcccagcttcgcatgcttgcggtcggcatacgtttcctccgggccgacgccatagaatcgcagattcgaatactcgaccggcagcatccattcaatgccgaacgccggaatcgtcggcagatcgccgtccttttcacccggatatgcaacatgcagatcgacgtggccaagcacatcggcaacgtaacgaatggtgaccttcgtgcgctgcgcaatcgcaagctcatacgtgtaagtgacggaaactgcggtttcgccgagcggctcaaccttcgtatcaacgcaacgcgcatactttccggcaaccgcccactgcgcacgctcgaacgcatggcccgcgccgcgatcattgtcggtcagcgcacggaacgtggtgatcagcggcttacgcaacacgaattcgcgctcgccaagcttgtacgacaccatgccaccctgtgcaagggagaacagggcttcacggcccgcactgcgtgcgccgatattccagcggcccaaggtgatcgctccatcggaagcggcggaagcggccgtaacagtatcggcaatcttgccacccgcaaccacgcactggccgaacgaaagctcatacccagccggagcccaatcgcaagcggaagtcaactgctgggacgcctccaaaaccagttcctgcgcacctgcgcggtaatcgtcgatcggccaatcgatctcaacatgctcgcttgtacctgcggcaacgtcgaagcggcgcgaagaagaccaaacgggcttgccatcagccaaaatacgcaacacaaacgtggaatcagccgtcgaaacaaacagattgtcgttggtgatcgtaatgccggaagcatcgacggtcatatgcacgttcgcgtacagctgcttgacgtcctgcgccttcggcgacggcgtgcggtcggcgaatagcaggccgtcgccggagaattcgtagtcgctcggacggtcgccgaaatcaccgccgtagcacatgcgaccgttgctgtcgagaatcgcctggtcgatgaaatcccaaataaatccgccctgatattgcggatagcgttccaaagccgtgtattcgtccatgttgccgacggaattgcccatggcgtgcatgtattcgcaggaaatatacggtttcttcgggttggacttgaggtattcctcgatttcgtcggcgtgcgcgtacatgcggctttcgatatcggtcacgtcgtcgaacgcgcgatcatgcacggaaccttcgtaatgcacggggcggttcgggtcgatcgcgtgcgcgtgggcgtgcatcgcgcggaacacttcgccggcgaacgactcgttgccgagcgaccagatgagcacgctcggatggttgtaatcgcggcgcatcatgctgttgatacggtccacgcacgcgccttcccaccgcggcttgctgcccggcacggcggtttcgggggtttcgatattgttcgcgacccagctgccgtgcgtctccatattggtctcgtcgatcaggtagatgccgtattcgtcgcacaggtcgtaccagtattcctggttggggtagtgcgaggtgcggatggcgttgatgttgtgcctcttgcagaacgtgatgtcgtcgatcatgtcttgcctggtgatggcgcggccgcgcttcgcgtcgaattcgtggcggtcggcgcccttgaagaccacgcgcttgccgttgagcttcatgatgccgtcttcgatgcggaagcgacggaagccgacgcgctgcacgaccttttcgaccagcggaccgtcatggcccacaacaagcaccgtcagctcatacagggttggctcttcggcgctccacggcgcaatgttcttcagcgcgccggaattgagggtgatggtttcgttggcgcattgcgtggattcccacaccacagtgccgtttgcgtcacgcagtttcgccttgacggtggccgcgtcgtttgcattgcgcaactgcagggttgcattcagcgttccggcggccatggagggattgtagtcggcttcgatctgcacggtttcgacatgcacgcgaggctgtgcggcgagctccacggaacggaacaggccgtgcaaacgccagaaatcctgatcttccagccaagaggcgctcgcgtattcgtagcaggcgacggtgagcacgttgtcgccgtcaacgtgcagcgcttcggtgatgtcgaattcgttcggcgtgaaaccgtcctcgccatagccgacgaaggtgccgttaagccacacgtagatcgcagtggccatgccgtggaaggtgacgctgacggtgccgccattttccagcgttgcggcgagcggacggtcgagcgtgaaggaacggcggtagatcgccacatgattgttttcgggaacgttcggctcctgcggatcctcatggccatcccatggatactgcacattcacatatttgttcttcaaatagccggccatctgcaggtgttcgggcacgttgatcgcgccgaaaccggcatcgttgaagtcagctgcggcgaacggcgcgttttccacgtcgacgttggctgcctgagtgacgtttactttccattcgccgtcgagattctgctttggttcggtggcttcgcccaggaaataccgatgattggagtgcgcgggcttgcgattcaccgcgaatacggtcggatcggtgagccagcttgcgttcgcctgccgcgcctgcaggatgcgcgattccggaaccccttgcgtttgctgtgattgcgcggcttcttgagctgccatgataactacccctatccattgcgacgttgccaatgtacgctacgaatcatagcgtaagtaattttgtttactaacatccgataacatatcacacttccgccaaagatggtagcgacattgccgtcggtgttgccgtgtaatcgaatgcgcggtcgaaataagattgcagattatgtttcacgattttgtgaaatcttgacaaaagacggtgcgttgcgctcttgcaaaatggtcacggtgtgtaacaatggcaggaatgcaccgatggcgtacgcccggtgcccacaaccgcgcagcattgcccagttcggcgagtggttgcgaaaatcgcaattttccgctatttcgcactatcgcaacggcaggggagtgctgactactccgcggcgctcccaaggagatcatcatggttgatcgcaaggaagatcaatccacccaattccgcgataccagttcgggaaatttcgaacaagcagcaaaaaccgcgacgcaaacgcaagtcgatccgtcgctcgccgatgcgcaaaccgtagcgcaatcgcttggtgtcgatttgaataccggcctgagtcaagcggaagccaagcgtcgactcgacaagtacggaccgaacgaactcgcgtccgcaccaccggtgccgaaatggaagaaattcctcgaacaattcaaagacccccttgtctacctgttgctggctgcgaccggcatttcgctcgtcgcatggttcattgaacgagccaacgccgtaccgggtgcggaaggcggcgaagcattgccgttcgacgccatcgtcatcgtgctgatccttatcgtcaacgcggtgctcggctacatccaggaatcgaaggcggaagccgccgtcgaagcgctctccagcatgaccgcgccgcaaaccaacgtgctgcgtgacggcaaaatcgaacgcatcaacacggttgacgtggtgcccggcgacatcatcgtgctcggcgaaggcgactccgtttccgcggacggacgcctcttcgccgccgccagcctacgaatcgcggaagccagcctcaccggcgaaagcgtgcccgtcggcaaaaagaccgacaccctcgcacaggcgaaggccctcggcgaccgcgccaacatggtgttcaacggcacgtccgtaacgcaaggcaccggccgcgccatcgtaaccagcaccggcatgggcacgcaggtcggtaaaatcgccgatctgctgcaagccacggaagacgacgaaaccccgctgcaaaaggaaatgaactacgtttccaaaatcctcggcagcgcggtatgcatcatcgcggtcgtggtgctggtcgcgctcgcgcttaccgaaggcttccaagacgttcacgatgtgatcgattcgctgctgttggccgtttctctggcggttgcggccgtgccggaaggtttggctgcgattcttacggtggtgctcgcgctcggcgtgcagcgcatggccatgcacaatgcgatcgtcaagaagctgcattcggtggaaacgcttggatctgcgtcggtgatctgctccgacaaaaccggcacgctcacccgcaacgagatgaccgtggagcgtgtggtcactccgagcggcgaagtgcagcttactggcaccggctatgcgccggaaggccgcatggtggtcgatccacagaccatggaacatgcgcaaatacgcgggatcatcgaatcggaagccgttgcgacccttgccgtgggcgcgttggcgaacgacggcgaactgcgcgaatctgctgcttctgccggaaatgcggaaaacgtaacgtgggaggcggtcggcgacccgaccgaagtctcactcatcgtcgcagcacgaaaagtgaaggcggatcgcaagtacgccaactacgagcgcgttggcgaaatcccgtttacttccgaacgtaagcgcatgtccatcgtggcacaagacaacgctgacgccggccgcctgaccgtcttctccaagggtgcccccgatgtacttcttggatattgcagcaggattgctgtcggcggtgccgttcgcccacttacggaaggcgatcgccagcagattcttgcgactgtcgaacagctttcctccgacgcataccgcacgttgggacaggcttatcgtccgctcggtaccgcttctcttgcgcaagtgccgggaatcatactgaattccgcaggtcatgttgccgatattgcggaacaaagcgatgtgcttgagaacgatttgatttgggtcggcatgatcggcatcatcgatccgccgcgcacggaagtgcgtgattcggttgccgaagcgcatcgcgccggcattcgtacggtaatgattaccggcgatcacccgctgaccgcggcgcgcatcgccaccgatctgggcattatcgacaagggcggcacggccatgaccggcagccaactcgacgaactgcccgacgaagcggcattcgacaaggtgaccagcggagtgtccgtctacgcgcgagtcgcgccggaacacaagttgaagatcgttgaatccttgcaacggcaaggcaatatcgtggccatgaccggtgacggcgtgaacgacgctcccgcagtcaaaaccgccgatattggcgtcgccatgggcattaccggcactgaagtgaccaagcagagcgcgaaaatgatcctcgccgacgacaacttcagcaccatcgtcgcagccgtgcgtgaaggacgcggcattttcgacaacatccgcaagttcctgcgctacctgctgagctccaatgtgggcgaagtgttcaccgtgttcggcggggtgatgctcgccggattcctcggcatcacccagcccggcagccaaggcgtgaccgtgccgctgcttgccacgcagctgctgtggatcaacctgctcaccgacgcggcacccgcgctcgccatgggcgtcgacccgtccaccgacgatgtgatggcgcgcaagccgcgcaaactcaccgatcgcgtgattgacgccgaaatgtggggcgacatcattttcatcggtgtgattatggcggccgtcaccctgatcggcatggacatgcacttggacggcggtctgttcaccgaccgttccgtcgatgcgatcggtcacgacgcacaaatgacggaagcacgcaccatgggcttcacgattctcgtgttcgcgcaaatgctgaacgcgcttgcctcgcgctcgcacttgcagtcagcgttcgtcggactgttctccaacaagtggctatggggcgcgatcgcgctgagcatggtattgcagctggcggtgatttacattccgttcctcaacaccgctttcggtacggtaccgctcagcgtcggcgcatgggtcgaatgcctcggccttgccatgatcgtgctcatcgcttccgaactgcgcaaatgcgtcctccgcgccagataacgtccgaaagtgcgcaaaatctcggacgttatccagctttctggaagggaaaggtttgtgaagtcaatgattgatgggcttctttcttgcctaatctttttggtgagatgggaggtgcgcgggatgcattcgtttgttgaagtatggcgtccgatgaaatttaagtgttttatctaaatcagatacaacatttattttcatatcggctatacgcttcttttaggaaatctgtcggatcgcatcgaagcgcttccgacagacgcctggctgtatccagccgcatgcctgaggtcgagcgatagcctgtctcaaaccaagagatgttcggctggggaatccctgtcatctctgacaactcgttttgcgtatagccgcgagtccgacgaatgtctcttagcccggattcagcgcagtggattccgcctctccaaccttcgtcgggatggagctccaacacgttgcagtgcaatgctttggcaatttggcgagcggtgtccaaatgcatattgcgtatggtttccggattgttttcgaacatgacgagacgatcatgatccacgccggagagctcggccagctgttctagagacattccttctttgagtctcaggtcctgtagcctcataagctgcgcctccatgccgttccctcccttcacggtatcactgcggaatattcgatccgtcttctattttgagtcaaaagcctgctcatgaaagggaccatcccgtcttggcaggtcattttgctccgctgcgccccacaggataacagaatcccctcaacgtatcgttccgtcaattcctgataaggcgactcgtacgacgaacatgttttccggaaggatgagctggtttctgtggaaaaggagaaagacgattcaggtggacggaatcgggacacgccgagggatgtgtttatttgcaacggttttagggtatctttggaagggtcgatttgcgtgattgccggggttcgtgtaaatttcgtcatttcctttcctcccgagaaccatcagtttggttgataagcactcgggaatctaccaaggaaccggacgatgccggtgttctcattccaccggcgccatcaccgccgacaccgtccaaattgaacgctcagggtgttcaggaacaagtgccgacagtgaacacctttattcgatcacacacaccgcccctccggtgccgccgcttgcccctgtggcgtaggcgcgccctgatgccccgtttggcgcgctccagctcgggcgagtcgagcctgccgtcgttgacggcccggtagatggtcgacacggacaccgacaggtccggacgttcgaccccgatcctgccggcgatctgctcgggcgaccagcgctcccgcacgatcagccgcgtgacgagcccggcgagccccgcgtcgtcgaggatcctgggacgcacgcaggagagcctgcgcgcctcgtaggagcgttgcgcggtcgatgcccggtagcagcggtcccgcgccgacccggaacgagttcctgcgcatctccctgctgatggtcgaccgatccctgcccgtcgctcttgcgatgtcggccgggctcctgccttcgtgccgcatcagcatgatctcctcgcgctccgccagtgcaggatgtgcgtaccggcccatgcgtcctccgatgtctggttgtctgtcgcaagcaccatcgtatcggtgacccatgggcccttgccttttccggccgttgcacttgaaataaaaattcatgtatcaaaatggcgaagttactcggatactttgcgggacagcacacacattcccagctgttctaatttcaaaagattttgacccagcatggctttcgtatactactgccccaattgggccggtcttccttccagattgtgattctgcattaccagcggttgaatcaaagtcggatttcttcggcccctatggaactatgcctcctgataaatgcaacgcaacatggacaaagattctttcagcaaagaaacaaagagccaaagcacctgaatccgccgaggagcgcactgaaatggttctaccatgtatcgagcgcatggaacatgacgcaggcataactccaagtcgtttcgacttactgcaggacagcaacctcgctgtctaagcgagattatgcatagcactgatgatgtctgcacaacatagacaggtgggttttctgtgcagtgggaacgacatccttgcaggaaatgttgcgaatgcacaatccgtccgaatgcaactcgtaccagtcgcgctcatcagtcgtgcttcccatgtcatactcaccagagtcaaagaaatattcctaccgcagcaggtacattcctaaataaccgaattatcggcgacacagagcatccagcgggtttcctcatgttgcatacaaggaaacctgctgccgaaacacattgaacagacaatgcgttcacttaatcatttgattctcctccaagtatccctctgaaattctcatatgctgtatcatccttcaatatttcaaccaactccggtgttaagactttctcgaacatacttacagagtcaggttcctttacctttgaaagaaggaaattcttgagcataagagtcagaggttctcctatggcagtcttatagttgaaaccaattagctgcatagttttaagggtatccacactaatcagttccataaactgctcatatactttggtttgttctttcactgcctcaacagcagcttctcctgccctttcggcgccagcaatttgaatatccgtcataatcttcaaaatatttgcaaccgtattatgaagatgctgaatatcttcatcgctgataacgaccttctccagctccgacttatacgcctgtgcaatcctaacggcctcttctcgctcgctaagaagctcattgactatctcgtcatatgtattgcgtattttctcagcattcttctcatcttttattgctcgaatcttagctgacacggcagtggccgtacctttaacagccatttgcgccagattcgcaccaagagcaaccagttcagtcgtatatatatcagtcatctgtgctcctctcaacagaccctacagaaacatccttggctctgacaagacgcatcagcgtaatgtcttgcaacctaagtctatcggatagcgacaagccaatcctcacaattcatcaccccagcttctgctttagcttgccgaacaggtagcggcgctcgtctgcgttcaataccaagagggtattcacggacaaggcaatcacgccctgctgaggagagaatcagaccaagccatgacccgcctgggagcagcggcttaattaaagccgaagatggaccaacaacagggaggaagagctgccatggccctcatccggggcgggagagaagaaccagtaccacttgagcctcagatacctggcatcgcgggcagggcaaacgatatgccccgcaccgggtttgaccgccgcgctgacgccgtccaccgtgcacagaccgtaatccgtgaagttcgcgacaagcatggttgagcagagtgagaaacgacagacactaccccactgatgggattaccccaatcgagcgccgcttcaccttgctcaccgaatgagcacgctgcgcagaatccgcgtcccgctggtgaacacgcacctgagaatcggcagcaccaagagaatctgcgacaaaccacacgatagatctcaaacttctgggggcagacaaacactcagtcgccgtgaacaggtgccagagcgcccaaaacacccacgggaagggacaactcgaaatagtcatagaggtgctcatcaatttgaaagagcttgcctttggcgtcccgagcccacgaaagccctttagagtcagtaaaacctaaagaagcattgaacttcgcgcacattccaggtgtcggcttggatacttcgacctggtattttcctggcagcaacgtaccaataggaacggcatcgtcaccagtaattagctctggagcaccaccttgaatggctcccatggaaattacagcgttgtacaccggttgaaaactgccattacacacggtgacgactattttcctctccgcctcattcgccagatagccgtcaccgtccggtgtcgcccaggctgaaacaagcaccgcctgagcacgttcctcttctttccgatccttctctcgtgaataatcgaaagaaccctgggctattttattcgctctgttagcgacaccaatagatctgcaggagacaacaattcccactaccgctatgacagttgcaataatcgtcgacacagcattgaccgcattcccgtactgattcagccattcagccacacgttctatcgcagtcatgaagataacgtccgaattcttgcacattttcagattccggccttgatggaaaaggacatgggccgtgccgggtacgattttcagtcgccagacaatgaaaaaccgcgattggaaagaggcacggagccatgtccaaggaaatcatacagttcgaccaggccatgttcgagagcaagctcgacgccatggtgcgcgagaaggtcaccgagctgctgaacgcgatgcccgacgcttcaggcggacgagatcgccaacgccgcgagatacgagcgttccggcggacggaaggcgtaccgggccggccactacgaccggagcctgaccgccaaggccggcaggctcgagctcaaggtgccgaaattgaagggcgccctgttcgagtccgcggtaatcgaacgctaccgcagacgcggggaaagcgtagaggaggcgctgatcggcatgtacccggccggtgtcgtccaccaggcaggtagacgacaccggccagttgctgtggggcgaccgcatgccgtcccggacattgagcgacaagctcaagcgcgtgtacgccgagatcgacgggtagcgcccgaaaggttgcgcactaccacctacccacatatgcatttgtatataattccattattttccatcaaaaaaacgcccaatacataacaaatcaatcataagtcataggccaatgcactatatagtatttatcctcttacttactatgatgcttaattctgccgataaagacatctatatatttagcaacagaaaacacctgcagcacacatatcaccacggcaatagcaatagcaatagcaacaatattcccatatggagtttgcagccaaatgaccatagcctgaatcgtcaaaagcactgctgtcgcaataaccaatgaccattggacctcaaaccgaagaatggtacgtgaagagaaaacacgtagcacaaatactaacaaattggataagaccatccccatgcaagcaccagcgacgcccaagcacggtataagcatccatgtagccccggcacaacacaatgcaccccatatggttgtagtaaatagactcttcgtcttaagtgtcgcagtatatacggttccataatacgaattaagaacattgaaatagaacgcaacaaccataatagggataagcgtccatgcctgataaaactctttctgcaacagaaaggatgccagccaagaagaacacactgcaattatcgtagccacaatggagattccggcatgataaatgcggaatactgtactgaaaaacttagcgatatttgttttacggaactgttgaaacgaagacagttgccatgcctgttgaaaaatgccagctgcggtggttagtaagccaggaattttctgtgcagccgcgaacaagcctgtgacacctataccaatcatgccagtgatgaagaaacgattaatgttgctacttacccaccagaaaagcgcattgggaaccatgggaatgcaatatataagcattcgcttaagaattgctatgtctttggtctcaaagtgcaacttaaaatgtcggaacatacctccgacaaagaagaaacacaacacaccacccatattgccgactaataaagagtagaaaaaaccagatgcccctaagcccatatgggcaatgaataccacagcacatatcgcagtgagagcagtagtgacaatggctgaaatcggaattatccttactttattcaaggcacgagccagcatgttaaaaaaagtttgaagagcacacagcgcataggaggcaataaacaacccgcgataccgatccaaacctccgaaaaatgacaagcttagcattggagataaaaccgccaccacaataatactgaaaagaaccacaaccaagccaagactaatatagcgatcgcgattagtcttatcatcgatggcaaagcgcagtacaccatcggagaccgacaatgtggccagaggcaacaccatgctcaccaccgtagagctcatgtccgtcacaccgaaatccgcggtagacatataggccgtatataatggcaccagaaaaaaagtgataagtttcgttgctatctgcgtgaaggcaaacaaacctgtattcaccatgaggtctttgtatttacccatgctttttctttgcaactccttattattctttccttttatttagatgcattatggaagatctcctgcaaaaacaatattatttaactgtttttgcaaatttaaaagcaaaatgcttagcacatctaaaaaaagaataagtacgatatttcccagataaaataagcttatattttaatccatgcatatcagaatcctgaatataaaaaatattcgagcgccaatcaggaaatgtaacatccatataatggattaatttgacaattgcatttgctgtggtaccttcccactctaaagctctcacaatgccagcaaaacgtacatgctcaattgcttggtattcaacaatagtataatattgattcaaacagccatttaatttcatccacttcaatataaaattaaatgccttagtaatatccaataaacgatccgggtgaacatcatgtgtaacacttgtcattcggcacacacatcgatatacatcagaacctaatgttgccacctcatcagcagccataaccaaaggcattatcgaagcgatatcttctccgatatagattccttgcaaaagcttaatgcctgctttatggaataaagatctacggacgatttgttgccaaagagctgaacacttcccaagtatttcgaacttgtcaactacattaaatgcagaaccattctttgaataattccattcagcaatcacatggccatccatggtaacatatgaggtatttattccaagaatatccggattatgattttctaacgtatcgagaattttcacttcttcttcccaaacaatatagtcatcgctatcaagaaactcgatatattctgcttgggaaatttcaatgcctgcattccgagctgcgttctgtcctccattctcttgatatatcacatgtatctcattacgacattgcgacgctaagtcgcataatatcttgcgcgtaggctcatctgacccatcatctacaagaataatttcaatacgtgggtcataattttggagaaaaggctttaaacacttacgaagatatttttcctcagtattgaaaaccggaattattatactaatcagcaatctcttgatagtctcttttttttgcattattattctcccaaaaacgtatctaaagcagaaaactgctccgcagaagccactacagatgaggagacattccacgcaataggatttggtagcttatggccataatgcatccaattctcagatttaagatcaatggcatgcgccatatcaaaacccaaatcatcaaggacataacctgtcttattgctgtacataattggtagaacttcggctccagcaagaagaccaaggataacagcatgaaaccttgttccaattaccatattagaagatgcaagttccgtgagaacttcttgtatattattccaataataaagcgtccgtacagcgattctttccgatttggcacattgcatcaatctacgaactgcatattcatcaccctcaggacgagaaaaagagcatagaacaatgtcatatccaagatggtcatattttctaatatatttcataatcagctgatcatatgccagcctttttttagatagatttttaaatttatttacttgatttaagtccaccacagaaataaaaagcttttccgacgaacaaccttaggtaactctacgttaaataggatatccggagcatatcgaacatttgaaacatcagaaaataaactcgcagaatacctatccctaaaacatacatcttgacaataattggaaaagaattttttataaaaagacaaatatctttttgaataaaaaggaccaaaattagcacctaaaacataatatttggctgcttttcgcgcgtttcttttatctctgaaaaaacgacgcttttcggcaacaacagctctcagtgttctattttcattctccatatatagtgaaccaccaatagttactaaagcgtcagcattatgtagctcagttaagtactcgcaaatatttgaacaataacgtttcattttcaaaagcaagctacccgaatcagagttactaccacttatcaccaaattagcattgttaaaatcatgagtaagatatccatagctgcaatcagcattcacattaaacataacattcggatagcgtttcaataatgtgaataaaaataaatcgtcgccaagattatgagataagtagcaatcaacagccacaattttattcatactaaaatccttttctgataaatatcaaggaattgttccaccttatgatcagtggacatactttccctgtatcgcatgcagtttccaacaaactcatcaaggtgcttgtccacttgtgcaagttccgcagcatcccaaccgtctttgactatgccaagccgctctaatctgatataactcgcattcaacggtattgaggtggtaatcacaggagtagcgcttgcaatagactccacaatggaaatcatgctgttgtccttctccgtgctcaccagcatggccttggcttctcccaaataacgttgcaacgtccgatgatcaagttgcccgtaaaaagtcaccgaacgctcgataccaagttgcctgactaaacgttcaagattgacgcgttcatccccatcaccgatgatcttcaattcgcactgcatatcaaaggaatcaaggtattgggcgaaagcacgaatcgtccggtcgacacgcttgcgtctgataagctgcgacaccacgcaaaatgtattggttttcctctgtgcggctggaaaaaccttcagatcgacgccatgttcgatgactgtgtcacatacatggggacaatactgcgcaatgaaacaacgggcctgttcgctgcgcgccaccacaggcacctgacgcatgaacagctttggaatgatgccataccataagcgggacagcatacccccacccattctgttgtgtttggccatctcatgccagatcacggttttttcgcgggcgaacaatacacagagcaacgtgtccatggagaacacctcactggtgatgaccatgtcgaaacgatgcgtacgcagataggtgatcaaacccaagttgaccggtattcgatgaattggaaagacccgcttccacgagcttttcatccatagaatcggaaaagggaagtcgcgttccttccgaggcttccattcttcggccgcagccaaggtgatgtccactccatgccgttggaatgccatgcacaagtcataactcatcgtgtcatcgatggaatcgatttggggaatatgcgcgttctccggtgtgtaaatgatcggattgacaaacagcactttcatcgtacgtctccttcggcaacgccatgctttccccgcggttgtccagtacgccgactcgtcgcgataaaccgactggctactgcgatgcatcgatgagccagcaaggcgaacgccataacccctgccaaagtcagcgccaatgccacgacataggagacggtgccatcggacgacacataggccaaaccacatatcctgatcacttggaagatgaacagatgcgaaagatagatttccatactgatgccactcaagaatttcgtcagcggattgctaaacaccttgtggtccttagctatggcgaagaccatccacggaatccataacaccaattgcttgacattggatgcccatgcaggcacatcgacgtacaacaacggcagcaccgccacagcaacaagaagaaccagtctccgcccaacactgttcaaggattctatgcgatgcctgtacaggaacaacaatccaccagcgacgaagaacatgaattggtagatgaaccggcggtcatcgatattcccgttggtcttgaagaaatgaaagacgcaggacaagctcaacaccacggatgccacgaatgtgccccaggcccgacgcttggtgctcatgagaaagacaaagaacgggaataggaaatagaagagaaaaatgacgcccaaagcccagccaacgccgatgacctgaatattgaggtcaggaagaagattgaacatcaacgtcacatcagcaaatgcctcccaaagcgcattcgggctgaatccttccgctacgacgtcaatgcataccagaagagcgaaaaacggcagtatcttagcgattcgacgcgagtagaaccgctcaatgtccatcgaaccgtttttcacacggtcgtagtatccgcaacacatgccgaagccgctgatgatgaagaagagcgtgacgaacgtacccaacggttccactgcggtgctcaaccaagttgatgtatgtacgtattcgccacgaacatgaacgtgcatgaccacgattgctatggcagctatagcacggaacccgtccaaatcgttatagtgtctgttcccagcaacccctgcgaactgttgcatgcttctcttgtcctctgtcatgctcgcttcactcatcccagcaactccttgaacaatgaaatagctcggaactccttgagactgcggtaccgtactgctctagccaacgcatgcaggtattctcgcgacttataggcccaaggcttgactttgccaacgaaatggatgaccttgatatctgcaaaggaatcaagcagaccgctgcgaagatactcggggataagggtgacgaactggttataagtctcgggaagatgcagccactcgttctcaggccatgtgcggtaataccagttgatgatgtcttggtcaccgatgccctgcccgttcagcatacctgggtcaggctcatcagtgaccaacttaagcaaatcatccatcatctgcctatcgggctcgatgaccataaggccagaattgagttgcctccaagtcggattgaagccgcgacccgctgccacggcagacatatgcggtttgtcaaacaggtagtcaatgtttgccgcaacaatcatatccgagtcaagatatatgagcttatcgaattgagtcaatccaaatatgcgcagtttgaaaaaagtattattccaattaggagatccgttaatctcattctgatgacgtacgtatgctccaggcgttataggggcatcaaatagcacctcaataccctcgccctttatttgagtcagactggtatcagatagctgagatgttgtcagaagatacaatggataccgtgactccacggctttcaacgatcgattgagcgcaagaacaccgggaacataagaatcactggtacaaatagtgataaaaacacgcattttactttcctttactaccggcttctagaggggacgtatatgacaccatcaatgttcattgcattagccaactgatatcgataatgaatagagccaataagaatgtaagctaccgcccatgcgaacatcgcactgatggagtcagcggtagtgagattaaggaactggaagactatcaacaacacacaatagaaatttcctctcgtcagattccaatagttattgatgaacaacaatgttgcgagaggcgaaagttccaatgagatgcgaatgaagcacatttcgaggctgtatccaagcgtcgcttcgaccgaaccatatccaaaagattggaacccactgtcgataagtacacgcagaaaatccgcacgccccatggtcatctcatcaaaatcttgaccaaacacacgcacagcggctgtagtgggccatagcaagtacatgtatcccatagccaaggcgaaaaacagtatcttaaagaacaatccacttctcttgggcaaatggcgattggggtcaacgattttcggaagcaccaaaatgacaatggcgaatatgatggctaatcttttgaacgtggcaacagcaaagaccacggataggatagtgcaggacatgtccttgcggtagtagcagaagtagaagcacaacatgatcgctagcgccgaaaaatcgttagattccagcgccgaggtggaattgtcgaaactggaagcccaaatatcagcccaagtcacaccacgaagcaataactggatgatataaccgatgaacgatgacaccaacaccactttcatgcatttgtgaagcgcttcgaagggaatggtgttcagcactacataagcgaacaacatgggcgtcagcaggttcagaatgtcacgaacctgccaactgtcaaattctcctcgataaagcacaagtccacatgtcaccagcacaaaggcaagaaccacgatgacaagctgcttgaattccctccaaaacattccgaacttatgtgacctgcccatgtagcatatgccaaagaaaatagcccctcccatggtgaggtatttggaatccgtaatggcacctttctgaccaagtgtcacaaagatgccatcagtgagcgccttgagcacaaacgtaagaagaaagaatgccaccgtgagcgtgatgaagatatctttggaacctttggcggtccgtggtcgactaccaaatactgcttgtattctgcgtaaatgtcgtaagtcatatgtcgtactcattcggtatctcacctccccattggtgttattccattcgccgctgcctcatagatatcaagcagctgtttgatatatcgatcctgcagacaacgcttatccacgtatttggcgcaggcctgctgcatggattgatagttgatttcgttcacgagcgaggctttgaggaaggttttagtcaaatcatccacattgcccgacttgaacgcaaacccggtttcaccttcaaccaccagctcggggatgccgccgatgcatgcaccgatgatcggcgtctgagcggccagggattccaagccggagtacggcatgttctcacgccattcggagctcagcacgctaaacctggcgttaccaacctcgcgttgcaaatcttcgccagatttgtagcccagaagctgaatacgtgaagcagcttcggatcctgcatcggcgacaagacgctctatctcgagacgctctggtccatcgccaacaatatggatatcccaatttgaaggaaggatagttttatcgttcgcagcttcagaactttcggtcgcgcggcatacagcaccgtcacttccagcagaatcataaggagccgtcagcccagcagccttcaaaaaggctcgaaccagcgtcaagattcctttttctttggaaagtcgcccgaagaacaggaagtatggtcgttttccgtcaacagcatcctcgaatttatgcgtattcgcaaccttacgagccatttccatttgtgaatcggtcaggaaattctgtaaagcaaccactttgccagcaaagccgccctcttcaagcttgcttttcatgaactcagacggagcaataatcaaatcgattttgtcataactatgatgcagtttcaggaaccctgcttccatggaagcgagcgcgcttttggcacgggatcctttcacgcaagcgttcttcacagcatgcatgaaatgtttatccaagcaggcatcgcacacttctcccctaccattcaccatcgtataggccgggcatagcagaatatagtcatgcgccgtatacaccaccggcacatgatgtttcttcaaatacggtgcatcaagaatcgaaagcgtcagctggcgatgcacattgttcatgtggatcacatctggcttgaattcctctagcaaagcttcgaacttacgtctcgcttcaaaagagtaaatcagtgtggaagcttcctgaaccttcttgaaagcggaaatatcccccacatagtccttttcggaaacgaagtatttactccaataacttgactcgttattcgggtgctgcatggaaaagaatgcaacctcatgaccgagcgcgcgtaatccttcagctaacgcgaagaaataggtttccgcaccgcctttacgatagaaatatttgttcactaggagaattcgcatgctcactctcccccatacaggttcagtgtctgatcggtgacgtcatcccagttatatttaccaacgatgtaatctgcggcatttgccttgtaacgttgtacaagatcatcgttttcaagcaattcctgaagtttttccgcagggattcaacagaaccatgatggaatgtcgctgcgtgcccttctactacttccacacattccggaatgtcggacgtaaggcaacagttaccgtaactcatggcttccagcagactcatcggcatgccctccaagtcgcttgggagcacataaatataagcattgctatagagctctttgagcgcctgcccttgtaagaatccggtcaaaataacacgagaatcctgattagccatctgctgaatatgctggtaatactcgttggagtcggaagcgcctccagcgatgacaagctttttgttcgtattcagcttgttgaacgcctcgataaggtaatgcacgcctttctcgggaacaatacgcccgagaaacagtacatagtcgttcttgtgaagaccatatttttcggtaatttcctgcgccgaaaccggctcaccatattcaatgccattgggaatgaaatgtgtaccgcgaccatatttttcttgaaaatactgccgcatgctttcgctgagcactatgatttcatccgcgcatttcactgcggtacgttctccgaacttgagatatgcggaggcgaatttgccccacttggcgcgctgccagtccaggccgtgaatcgtcgccaccgtgcggatgccggcccaatgcgccagacgcagcatgacgcagggaccttcggcatgatagtgaatgacgtccggtttggccgcaatggctttcagtgttgcgaagaatgaggaggtcagagccgccaaacctttcgcttcgaaagtcggcactggaacaacacgcacgccgttgtatacaaagggcttatttgcggaatgaacgtttccgtcaaattcggcacccgcaacattatgccccttgcgattgtatgcgataacatcatgcccctttgcggccatacgcgtagctaattcatctacaacgatttcgatgccgccttcacgcgaaggaatgcgcttatgacctatcatcacgatactaaccatcaccggtcgcccttagttattcagaatgccgggataatgccacaagcgttatgcatggcagcggattgcacagtctgaccactagccaaaccgacgtaacggccgttatcggctcttttcgctcatttagaaacgtccggaaaaccgactgaagcagattccaaacacagtttttaagtcacgaacaagcaaagtgttcatggaaaacccgtgaagaatacccccgaagtgagtgatggggggctgggtgtgtctgagggggatgtaaaaatcgactttggcagataatgaacggggtttggcagttcctgcgcgtttcgcgttgcgcttgaaaaacaccaattcggggttcatttggagggaaaggacgggactcgcatgccgaccacaggtcgatcgattgcaagaagagccgataacggccgttatgtcggcttagtcccggttcgaggacggtaatccagtgccgattcgcgtagcccaggtcatgggaaagatgcttggcggtggtgtcgaatccgtagtgatgaactactaccgccatatcgaccgtagcaaagtgcagttcgattttttggtggatgccgattcgactcgcgttccagaagaggaaatcaaagcgttgggcggccgcgtttttcgcatccctccataccagcatccccttcgctaccgcaaggaattggtcaggcttttccatgaggaacactggccgatcgtgcacagccacatcaatacgctcagcgtattcccattgtctgcggccaaaaaggctggagtgccggtccgtatcgcccactcgcattccacgatgggcaagggcgagtttgccaagaacctgatgaagcttgcactgcgtccgctctcgaacctttaccctacagaatgtttcgcatgcagtgaatacgccggaaaatggctgttcggcagagacgctgacttcacagtgattcccaacgccatcgaactggagaagttccatttcgacccagtccttcgccaggaaacccgcaaggaactcggcatagccgatggtatgttcctgattggccatgtgggtcgtttcatgccgcagaagaatcaggctttccttgtcgacgttctcgccgagctccttccccagaagccggacacgatactcgcgttcgttggtgacggtccagacagaccagacgtacagcagcacgcccaagaactcggcattggtgaccacattctgttcttgggccagcgcacggacgtcaaccacctttaccaggcgttcgatgctttctgtctgccgagccgttatgaaggtctcggcatggtcgccatcgaagcccaggtcgccggatgcccctgtgtcctcagcgatcaggttccgcacgaagccgatatttccagaaaaacatctttcataagcttggaaaataaatcttcttggatttcaactgtactcaacatttcctcgcaaacagcgaatcggcagattgaaacatcaaacacatgtgctgaaaaatatgacatttcagccagtgcgaatcgtctgacctctctgtacgtaagcagtgcggaaagcgcgaatggatgggaggaaacgctgtgaatcctcgcgttgctgtaatcacttcaggctatttgccagtaccgaatgttctcggcggagctgtcgaagcattggacatgatgatggttcaggagaatgagaagactccgaattttgatttcactgttttttcttcttgggcacccggcgtagatcagatcgtgggtgaaggtaatttcaagcatactgatttctgctttatcaagacgccattgctagttcgcgcggcggatcgttgcatttattgggcagccaagcatgtgctccacaaaaagaagctcatgagctatcggtatattgcgcaacgcctgtggtatatcaacaaggtttccaagaagctcgcacagcccgcaaagaatggcggcccagctttcgacaagataatgatcgaaaaccacgccacgctgttcatgaccatgcagaagcacggtaattccgagcgatatgcgggaaaagtgtattaccacctgcataacgaagttcttaatgatttcggctgcattaaagagatttccaaagtcaaaaaagtacttggagtttccaaatatattgttggcacgcttgacacgtatttaagagagcatggtgagcctggtctgcgcgaagatcagaaagctgtatggcgtaatggcgtcgacacaagccggtttggttcggaggaggctaatagcaaggcgattgaatttcgaaagaaattcaatatagccgagaatgatattgttttcctgttttccgggcgtcttactccggaaaaaggcgctgaagaactattgaaagcgtttactgaagtagcgcagaaagttcccaataccaagctggttattgccggagctttcttctttaattcgaatatcgtgagtccatttgaacagaaacttcgcgatttagcttcaaatcctgttgtgaaagatcgaatcatcttcactggctttgtgaattacgaagatatgccagctatttatgccatggccgatatatgcgtattgccgtcaatttgggacgatccagcacccctcgcggtaatcgaaagcttggtttctggtaagccgctcatcaccactcgttccggaggcatccccgaatacgccgatgggcagtcagccatcatccttgagcgtggcgatcaacttgttgaccagcttgctgatgctatgacaaagattgctcgagactccgacgaacgtgatgccatgggcgcgcatgaaacagcattacgttccgaattcaataaagaaacatacatggcacaattagccattcgtctgaggtgactacgtgggtaagtacaagaatctgctagtcaatgtcggcatcttcggactcagcgcagtagccaccaaactgatggcattcatactgatgccgttgtataccctgtacctatctacagaggaatacggcatcatggacatggctaccatcatggtgaccacattattccctgtactaactctgctcatcagcgagggcatgctccgttttacgcttgatgataagtcaaaagccgcgttttatattaccgaaaccatgctggtcatgttggcaagctgtgtgcttttggcaattattctgccagtatttgatttgcctatttttggtggattaggtagatataaaatttggttcttgttgtcctatgcggcgttgtgttttccctctgtgatgggtactgtcgctagggctatggatcagatgaaactcattgcttacgcctcaatattgtctgcgcttattatgggcgcgcttgcttatgcgttgattgccggaatgaatctcggtcttatggggtatttctactcttatatcgtaggcaatggttcagcgatcctggtatatcttttcgccggtaagcagtatcaatttatcgattttacagtatggcgaaacaacgcgtctcttcgtaagcagctttggcgctactcgctgccattggctccgaattcattgtgcaaccagattcagacgacggttagtcgtttcattattacaggtgtactgggtatttccgcttctggtttgtatgctgcagcttcaaagattcctaatttgctgaatgtgcttcaacagattgttcaacaggcttggcagctttccgcgttccaagagtttaagagctctgggctcaagcatttctatgatgtaatctggcgtgtgtaccatgccctgatgtcggtaggaagcgcattggtaatcacactctctccgttcatcgctagggtgcttatgcagcgccagttttactcggcatggcctcttatatccattcttgtgcttgccttttatcttagtgctatcaacaactttcttggcacgatttatcaggcttatatgcgtacaaagccgttacttgtggcaacagttgtgggagccgtagcatgcctcgcatttaccgctgtcctcgtacatgactggggtatttcagctgctgcattcggcgtgtttgtcggtagcttggtgattttcgtggttcgtgtgattgatgtgcgtcgtctgatggccatcaatatgaggccgattcctacggccattaccatgacgctgcttactgtccagtccttggtaacctcgaatcaatgtaaccattatctattctggtcatcgatttgtctgttgcttattgcattcgtgcaatgttatgaacttaagcctcttattactctgatattcacaaggaggaagtacacagcatgagtactaatccatctgccatgcctgagaaaacccgaactgaagatctccccctgatttcagtgattgttcctgtgtacaaggttgagcgctatcttgaccgttgtatacagtcaatcgtcgaccagacgtatcgaaatttggaaatcattctggtcgatgatggctctccggacgcttgccctgatatgtgtgatgcttgggcggcaagagattgcaggatccgtgtcattcatcaggagaaccgaggattaggtgccgctcgaaatagcggaatcagaatcagcaccggagagcttatcggtttcgttgattctgatgattggttagaaccgactatgtatgaagtcctatatcgttctctcaccaaagaaaacgctgatacctccatgatcaccggtgtcttggaatatcctaacggacgacaaatatatctttatcatcctgatttacatctggtaatgaccacttcggaatcctttaaatacattaatctgccaggttattcgacaatctctgcttggagcaagctcatcaaacgttccactctaggaaatattcgtttcccggaagggtgcactggcgaagattggcaattcacctacgatatacttgcagcgagcgtacgaactacttttgattcaacgccgcagtaccattatcgacaagttgcgggaagcctttctaacacgagcacaaatttcaattttgctggttacgaagctaccaaaaacatggtgaaactggtacatcaaaaattccccgaacagcttccttttgcgttgtatggacaaatgagaagtatggtgagcctttatgatcaggctcttgtcacggggcatgctaaagaacagcaatggcgagatttcgcagaagacactcgcactttcgtcaatcaaaacatgaaagctgttactgaatccgtgacgctccctcgtgggcgtcgcctgcagctcaaactcatggccatctctccaacgctttatggcgtgtttttcttacttcataaacgtattcatccggaacggagcaagtgaaaaatgagcattaaacaacttgcgatgcggttagtttatggccacaaggcttcatcggagcaatacatatcatggctccgaagccagggagtacacgtgggacagcatgtgcatctatatacgccatggtccatcagaatcgatactcagagaccttggatgattgaaatcggcgataacgtacatatcaccgcagattgctctattttgcagcatgactatagctgggcagtaatacaacgccttacgggtgaagtgctgggatcatgcggaacggttcgtattggcaataatgtttttgtcggtcagaagtcgttgattctcaaaggagctgagatcggagacaacaccatcatcggagctggcagcgtggtgacaggccgtttggatgggaacgctgtatatgccggtgctccggcaaagaaaatctcttccttggaagcgtatatcgacaaacgccgcaaacttcaattaaatgaagccgtgttattagtacgtgagtacgagcagacatatggaaagcggccgccaaaaaagctacttcgggaattcttctggctgtttgagcctaggaacactcagctggatgaggtattccaaaaggttttccagcttgataacaataccgaacgttcacagcaagcgtttgttcaaagcgaacctatgtttagcagctatgaggcattcctcaaatacgttgaatcaaattcttaacagctagcacagagaaagaggcttctatgaaagactcaattacttcttacaccattacctgcagcagaccaactaattatggcgctgttctgcaaacttacggcttgaacaccgctctacgcaagatgggtgtggacgccaaggtgctggattacaaccccaaatactactacacgtctacgcggccgctgcctattcgcatgcttcgcgccatcgtacgcttccctgatttggtcaaggggcgcaaagtgttcggcaaattccttgaggactacatacctatgagcgccaaaacttaccgtacgcttgccgagattgaggctgacaccccccaatccgacgtctatatttgtggcagcgaccaaatttggaactgtaagaacaagcttaatggtaaagatgatgcgttcttcctgtcatttgcgcctgcgggcgctcgcaaagtagcgtatgctgccagcattgccatgcctgaaattcctgacgatcagaaggatcgttatcgtagactgatttccgatttcgatgccgtgtctgtgcgcgaaccgtcgtcggtgcccatgcttgaagatctcggcattagtaatgttcaatccgtcattgacccagtatttctgcttgagaaggatgattggaacgtaatcgccgatgccagcgatttcactcctactgaagattacgtactggtgtatggctataaccgccagaaagatgtatacgcttatgcacgtcggcttgccaagaagctaggcgtgaaagtctataccatcggtactgccatcgaagattacacacttgatcaggaccgttatttttggaatgcttcccctaacacttttgtgaacctgattcgcaatgcgaaagccgtggtgacaaattcattccatggcactgtgttctctattgtgtacaacaaaccattccacttctttacagttaagcagaccacaaattcacgcatgctcgacctgctggattcgctggcgttaaaagacagacatgttaccagtggcgatctgctgagcaaccacatcgactatacgcagccgaatactctactcgcttcattacgtaaacagtcattagcttatttgcatagcagcgtatcggaaccactaaatcaacattaatcaagagtccaaaggaatgtcattatgaattggaagagcactgtagaacagtggatgccaaaaccgcttatcgctcctctcaagaatctgcgtcaaagcattcatctatatcaagattcgtgggcacaagccaagcggtttaatcgtagctactctcgcattatgccccatgaacgagtaagaatcgagacacgagtgatgtttctcagccatcaaattgaaaagggtctgagccatcacaattttcgctatgggtttgggaaaaaagtttttaacgagcttccgaccctgcttacgcgtctggaacaagcagatctgaatttcgctaataacactgtgtacaaagaaagtcttgctgcgcttcatgagtacatgcagcgtcatctcgatgcggagaaagatatttcttggcagcaatcgttattcactgcagatcagtggcaacgcattatgaatgccgaatcaaacgatggtggaagcatatctatccgtaaaagtgacaagttcaataacaaagatctttcctttgctgcgttaagtgaaaatagacattcagttcgtgaatttgctgatgagccggtgtccctagacgaacttaaccaggcaattcagatggccatgcgcactccatcagtgtgtaacaggcaacccaccagggtgcatgtcattctcgacaaggaagtcatcgcagaggctttgcacattcaaggtggtgttaatggatatccagcccctcccgcattgctgatggttacttctgacttgcgtgcgtttatgacatcgtatgagcgcaatgagggatataccgacggtggcctgttcggaatgtcactactattatctttggaatctttgggaattggagcttgtccgctcaataccatgtttacggcaactgcagaaaagaaaacccgcaaacttttgcatttgcctgataacgaagtacccgtcatgtatatcgaagttggacatttcttggacgaaacacgtacctgtcggtccactcgattccaaggctcagatattacctcggtcttgcagtaaccacagactgatattcccgttcgcgtacttgcatctgcgcgatcagatacagtcgcataatcagcaaggagtcttccatggacgcactctatgttttcgtcaccacatcattgcccaaagctggagcgcaagttgccggattgccattaacgctgaatttgctacttactgcatatgtaattcttcgtcatccaaaccgaactttattgatgatgaagaggtttcgcggattggccgtggcttacggagctctgtttgcgtctggtctgccatacatgtctcaagggcggatgtctttagacatgtatggcaatggtttatgaagcgttagtcgtatttgatcaactggctatgctgtttgttctatgggatgaattttcttgaacaaaacccctttttgtgaatataaaacatcaaaataaggaaaagaatgtttatttatataacatctgttttctgctgcatacttttggtatgtgttgcagataaattaaataaaaaagcagaggttttaccttttgctattgtttttttgattttatttacaatatctggattccgatatggagttggaacagattatttttttacatatgttccaacttataaacagatatataatggcacacctccaccaatggagccaatatttctatggcttaacaagctatgcattgattttgcaggtagttggtatcagtctatatttattattacaagctttatattcataggtttaatatatattgttatatataatatgccatgttcgaaagttctactgactgtttcttttttgtgtggtgggtatttcttatactcatttaatgtggttcgccagacaatagctaccgcactattctgttgtgcattattgtttgttgaaagaaatatggatggcaaaaaacgattacagagtctttttgcagcttttttcttggttgcgatagcggtaggttttcactattccgctctaatttattttgttgttatcactctcctctatctaaagcttgacaaaaaaatatatttgtccctttttttcgcttcggctgttctcgtacctactttcgttgcagttattggcattttgctcaaagggacaaagtatgagaattatatatccggctactggccagatcccagcaaagcattttcattatcatctttactatttgtaggtttcttctttgtttatttgtttacggaatctaaagaggatgatcattggtttaatatttttagaaatttacatttcataggatccatagctattatgattggcctgtttataccactaggtcagagagtttctgcattgttttatttgcttaattttcttagcataccgtactatattgaatactatattacagaaaaaaataaaatgcttataaagatattatatttatctttttgttttttcatgttcctacacacattggcagttaatggaaatggtattttaccataccatttcgctatatgataagttaatgtgactgttggttgcgatgcttttagattgagaagcggggagtttaattacagtatgggattttgcctcaacgaagtttttgaataatgcttggataatgatgtattgtgttttgtaaagaaaagaaagtaaatgaggagattatactatggcataaagttctaggctggctgcactcgattcgctacgaggcttcggcatactactagttgttttgggacacacatcatggtctgctggtctggtgtcgtggattttttcattccatatgccattgttcttcatcatttcaggaatgctgtttcacgaaaggcagtttctggattcattcaagaggaaagcgataaggctactcgtgccatacgtgttcttcggaacggtgactcttgcgtattgggctcttatcgagcgacgtctcaggggagacgaaggatctgttccgaatgcgctggcaaatattgttctcgctcgcgcaggtagcgataattacccgcagaatgcggcgctttggttcctgccttgtctgtttgtcacggagatgttgttccttggaatctttaccttcgtcaaatcaaagagagcgatccggtatgattgggctgttgccgcgacgcttgccacggtcagctttctctcaatcattgccatgcattccttcgatctgccgattgatcggctccgccttccttgggctcttgatatcctgcctttctccatgctgttctattgcattggctacttgctgagtcgttttctcatgccatgcatgcggaaatccaagccgaaggcatcgttgcatgctgtctatgctgctatcggtatggcaggacttggcctgctgagggtattcgatgagttgaccggactaagcgtcaacctcaatgacgcaagtaccagcaatccattttggatgctatgtgcagcattgcttggttttatatcgtcgctcatgctttgcgttgctatcgactgccggctgctgcagttccttggcagggcgtcgcttaccatcatgtgcgtgcatgaaccggtgaaacgagtgctgatttttgttatggcgaaaattcttgggatgaatacagatgcattgcgagcgaatcttgtatatgcgatgctggtgactgttgtcactgtagctatctgcgttactgttcatctcattatgggcaagtttgctcccgtgttaatcggcagttcccgtcacaatctggcttcgcaaggcaaggcaagggcatgatgggagaacatttgcggttggcatcatagttgcgatggaacgtcgctttgtcgttgtgatacctgtaagaagtcggcatctcgatttcgctttgcccattaattgcattcatccgcaatggtggcgtcagtggtaacagatgatctgccgcactgacaccaactagcaagctcagctaagcgttcgcccttcctgcagatgtttaatttgcctttcgactccgtcccacaccagttcgaaccagcggccacggttacagcttacggtcaccgcaaacagtccttgacgcatgaagtcaatcagagtgcagacactaaatagatcgtcaacaggatgccgaggatttgcagaatggcgaaaggctgctgataaaggttctccagcacgaacaggtgcttccaaagcaatgttctcgtggcgggataatcggtgatcaggtaaaccgcgaatgcggaccgggctatgcggttgatgatccggctgcggaaggaaagccggtcgaacagtagaaacatgtcgaagcccaccatgatgacgggcagcttgaacgatccggcgatgaagatgcccttatcgattccgaacaacgataacataacggaagcgcatgtgtacaagaggaagaatcccagtccgattccggtcatcagccaagtctgtttgagtgtgaacggcttcatgtaccacttgtacgcggagatgaggatgaataggtagatgaagccgaacacgctatcgttcactccagaagttccgggaatgaagcttgtcagtccccagatcgccagcaccgttatggcaagcgcgtaatgcatgtgttcgccgagcgcgcgtagtcccttggaaaggaacggcagcagggcgaggaaggtggcgtatgcggtaacataccaccacattcccataatggtcggcgcgacgctgcgaacgatcgttttcataccgaagtcagcacggtcgaaaaccagaaagaatgccatgagcgctccagaacagcacttcgcgttccaaaatccatatgcgcttgaggttcgatttgatggtctgtttcttgtcgaggaagaaccacgcggagatggtgaagaagatgacgacgcccactttgccaccaccctgcatgacgagctgaaagaaagtcctctcaggtcccagtgaaagattcttgacgtcatagccgttatggacgacgaaatggtgggcaagaatcatgaacattgcaacgatgcgcagcagttctatgctggaattacgccccccccaatttgaaattcgggtcggcgggacggccttatgggaggccgtggtctttgagcctataatcatctttcccttcgttttctcttatcttttccaatacccccaattatacccgtccgaaaagaccaagttatgaagctggcctacggccatcgacaggcccgcaggccgcatcgacgacggatacgaacctcgatcttacaacagcaatctatggaaaaatcagagacgaaaataaccaagcaaacaccccacacatgtagacaacagctaacgtccagatcatacgggaaaaactctggtttgcttccgtatctcgcttgcatatggaccggcacggaagcaagaaaccacaacacgcaccaccaaaggtgggtagccattatggctatccaccttcttcttaaggagcgcaaacgatgcaatcgacgtcaaacatatcggcaagtaaaaggcatacagaatccaaagctcacaataagcatgacgcgtttctcagctcgtccgtgcgagttccatccattcgtgaagctcacgcgggaaatccaagcccatctcccggtaaacagagtcgacgtacgcaggtatgtcttcacctaaatgcatgagcaaagaattaaattgctggaggaattccagataacgttttttgtcgattacgaaacgtaaatccttaacaagctggaaaaccgtattgttggaatcatgcggatgcgcacaataaagacgttcatcgtgcgcgcaaatattacgaaaatctttcattctgcgatatatcttatcgatacgttgtgcatcgatttccgtcttatgcctgtgcgaatctccatacagaactgtgaaactcctagcaattgaaccgcgaatcaatatattttgagactgaaagaaccaatatatttgtcccaaagttagatcattggtcaaaacccacaacggcacctctccatcgtgctcattgaggcaatgaacgagatattcttttctgccttttctctcgcaatcactgttgtcagtaagtatcttttgcaatcgcggaatgagctgacttgccttttcatgagcttggccggtacgagcataattgtcgatattaaggtaggggttcttctcagccggatttgccttggtgaattcgtatgcgcagactgttttcagaatcgcctcagcaatcgtgatcattccgaaaaggagaaaacggagctgcctatcaaacaggtacagcttatacaagtcattgtatgaggatccttcgcgatatttgtcttcttcatcttttttcgcgcttgattatcgagaaacggttttttgtatccattgacagtcgcgtaatatccttcgcgctcaagaatccatgatgtcctagaatccgtttgaagtcctcgtgaattgagaagagcgatttgatcttcgatcgtggtaaaaggtttatgcatgaagactccaatcaaagcacaaaggtcgtctttccaagaagaaagacgacctttgcgaactggacaccgcccagctttatcacaaatggttaatttatacgaaaaatggctgtttttcgacttcggcgtgtttcacatagtaagcgtccaaacagttccgcactgcccaatctcactccacattgatgaaaaactctttgctccgtgcaatacatctcccatcgcacacagccgaaacactcataactagatcatcgtagggagcgctttcctgcggaacaatgtcaatgtcaagattcgaacgcgacttgtgcggccaaccatagtccgtccacacaagtcgcgttccatgtctgcacaacccgagaaaaggacggaaaatactagttgtgcagacgcgacgaccgcagatggaccgttgcgtatgcgcagattgcggaagcgatcaccagcagcagcgagatgatggcgagcgcctggactgcggatccggagcgaggcatttccggcttctctggcttttctggattgctgggtttgccaggttcttctggctcttctggctcggcgacggctttgatggttaccgtcacttgggcgcttatgccatcgtggtcggaagtgcgcaattgcatacctgctcccccactcgcattggcactgccacgcgaggaagctccattcggcattccggaagaacgggccgcgtttgcgtccgtaaagtcatcatccgacgtgttgcgcacggcggtgatggtgatgttctggctcacggtttcgaaggctttcctcttctccatcgcctgcattgcgtgatcgatctgatcgttcaacgcctgcaactggtcactatccatcacaagacggtaatcagcgatgccgttcagttgcgttcccgtcaaggttagtaggtcgtcagcactcagccgctgaaggccgctcgccggattcaattcaaccaaagtctgcttgctggagatcaccagatcgccgacatggaacattccatcacccgtaccgtcaccgctagtgccatctggaatcagcccaagcgagtcagccaagtacggcgcaagattcgacgagtcggagaacgagccgctcaacaagacgagcgtgttcagtccagctggaatcataccccggtattcgccgccgcgaacggtcacatagccaagatttttagcgtcatccagcaggttgaaaagcgtcggcgcggtgaatgttccgcccgaaaaactgccttgcgcggaagtttcatccgtttcggcaaaccgcatcaacgttgcatccgaggtgaacgtgccaccctccacgtgcaatgcgccacggcaatcgaccgcaggctgtgttccgcccgcaaccgttcccgggccgacaatggcgagctgcatgttcgcaggcacagtgatcgcagcaaccccagaagttccaccggattcagcggcttgcagcgtatgcccgttcaggtcaaacgttacgtttcgcacgcctttcggtggcgtaatcgtaacgctttccgtcacgtcggctagcaatgtgaccgtcgtgttcttcaacgttgttcgaccgattgcctcctgtacgctcgcgtaggttgcgttgcccacttgcgcgaccgcctgagattcggcggcaacggcaaccgcacccgtagagaacagcagcgttccagacagcgttacgagcgcgaaaacagcggtcagcaccgtcgaaaccaaatacttaccttgcgttcgcgggcacacattcgcccgcttcccatgactacgcatgattatttccttttataggttctgttgcatatttcaatccgcaccgaagtgcgtgggaccaccctcagctgtgagggataacgttacagaaatcatggcgccacgttacattaattatcacataatacgcaagagaaagcaaatttacctattttgaaaatccaaatctcatatgagctatatcaaaaggcaatacttagctatggtggatatgattatacaagttgaatctgtttcacatgagtatcacaatattcctcacacgaataaacgtatcccaataactgcaaaaatatacatatgacgaataattgtttcccatcaagaaacaagcgagcccacaatcaaacaagcgaggtcgcaaccacacaaaaacacatttcccgcctgcacaagtcaggaaacacaaaaagagcgctccgggagggagcgctctgatttgcacgacgattcgtgcgaaaagtactgcggaatttagtaagatccggcgccgcggaagaccacgagcacggtttttgcgagaatcgcaagatcgcctgcaatagaccaattttcgatataggaaacgtccaaatattcgctctgctcctgcgaaagatccgaacggccagaaacctgccacggaccggtaataccaggcttaaccagcagtcgcgtggaataaagggaaccgtagcgggcaacctcttccggcaatgccgggcgaggaccaaccaaagacatgtcgcccttcaaaacgttgaagaactgtgggaattcatccaacgaagtcttacgaataaaacgaccgaccttcgtaattctcggatcatccttcattttgaaaatgaaacgatcggtctgtccattttcttcggcaagcttcttcttcaattcttccgcattggtaaccatggaacggaatttatacatggtaaatggcttgccatgcaaaccgatacgctgctgcgagaagaaaatcggaccaccgtcatcaagcttgatggcaatcgccgtgcccagcatcagcggcgaggaaatcagcagcgcgaaagccgaaccgacgatatccagcaggcgtttaatcacgtacgtcgtattcgtatactgcggcaaacttgccagcaatacaggctgttcggccgtattacgcaagtacaggcggtggccgctcacgtcagccaaggaaacagccaacgcaagctccatgccaagcgactcgaccgcaagggaaatgccatgcagcatttcggaatcgcgggacagcacgtcggcaacatacacttcctgcgcacccaagctttcgcacgtacgcgggaaagcggcattgaacggaatcaccttcagcttgtcggcaccttcaatggaaggatcaggctcgaacgacgtgaccacataagcgtctttctcattgtcgtcagcttcgatcgggcacacggcaatcggcgaatacccccaattggagtagtcccgcatggtgcgcaacgcacaattgataccgtcggaagaaccaatcaccacggtcttatacttacaggcgcccttctgacggctgcgatgctgccactgacgcatctgccaacgggcgatgacttctaggaagaatgcaatgatcggggcgacgataagcgcggttctcggcaaggaaagattgaaaataaaagcaagcgagcagtaagtgatgatggtgagcagcgacgcgttgatgattttcgcatacagctcgtagccttccgccatcacatggcgatgatacgttccggcaaaggtgaggctcaacacccagatgaggctgaagcagatgaggaacagccagaacggcatggccccattgatggcattatatgcggcatcgttggcccaaagactgatggatagcgaaatcagcatgaccgcaagatcgaccatcaccaagcagacgacaaaagaataacgccatgcgggcacaacctgattccgcctgcccttgcgctttccatcttcaccaacggaaaatggcgtgttcgaaaacatcatcggctcaaactgagggctgttgtcttgagactgatgtcgctcctgcttctgatcctggtgacgagagttagaagagacgatatggatttcctgggttctcactacttgatccgaaccctgctcagagctgcggaaaccgccttgcatgactcctccctctactaactacccccacccgaaaagaagggggcttccctccatgaagagatagtatcataagccctgttaacagagtagatctccaactcgcttttgcggttaaatgactattggaaacttgcttttgacgcgataccgcgaaacgcgcggcaagaacggatgaaaagttgacgtccgttccgtgaacgtgaggctacatgcgcatatacccacatattcccccatactcccctgttgcaagatggcttgtctagagccgcttgcttagctgcttaggttacctacggaactgtctagcggccttcaatcagcggggtctggcggagggtgagcggctcatccgtatctggagcggactgcacatgcacggtgatctcataggattcgccgggctgcaaggtcacatcgcccacgcccacggtcaggccatcgtgcaaagtcacacccttgtaatcgtcggcattctggaattcccaatccaccaaacgaccgttcgcaggcgcgtaaatgaacaatgccgtcttgatctggcctttcggaacgatatttccggcaccggtcacatagtcagcttcggaagccgcttcttccgccgttatggtgttctgcaacttgatatgcaccgtatactggttcgcgccgtttcgcgcgaccttctggaattcagtggtcacttcgcgatgcaaataccagtccattttcgactcggtttcgtcggaaatatacacgccgacctgcggtttcgcaccttccgtaatcaatttgccggaaatagcggaatcggcaatcagattctgctcatcctcatgcgcgctccacaccatcacgtgtccctgctcaacagacgtggaaagcgccttgacatacgatttgaaatcgcccgcattctgcatgatatggtcgaacgcggcctgcgcggcaaccgcgaaatactcgtccgtctcctgcggagccatgcgcgcatacacgtcatgcagcaacgtttgggcggtattagtgccatccaacgtcgaaccgtcaggcatggcaacgccaccggtcaccgccagcatgttctgcaggaacagcggatcaatggcgatcacaccatcaaccgcaacgccatactggcgattccacatggcgctcacaatctcgccggtgcgcggaaaatcaggcgtgaaattcacgtcgcgaatatccttgccaagcttgtcggtaaacagcaaacgttcctcggcggtcaaatccacaaccggctcatcggcattctgaatttccgaatcggaaacgaacggctgcaagttcacgtgaccaccctgcaccgtgaccaggccgagcgatcccgtaaggccgccggacgggcgcgcctccgcattcgtttgcgcaagaatcaaataattgcgcggagcatcattcgcatggctttccgtacccaacatgctgggcagcacctgcacgatggaattcaaggaatgcaccatgctgtcaagtttttcgcaatacgtttccgcggttttcagggcgtccgcgacctgcgcgatatgcggggttttcacggttttcacttcccgcgtggccttgtcgatcgtatcgtccgcgatttggagcggctgctgagacgcttccaatccggaaatttcgatcgtgccgttttccacatgaatactgttcagatcaacattttcggcgactttcaccagttgcggcaacgcctgcgacgaaatattctccatggcggccaccgtggtgcgtacggcggaaatgtcattgcccacatacggcacgaccgacgccacctgccacagcggcgaagaggtttgcttgtaggccttgcttacgtgatcggagaacgcggttgtctgcttctcaagcttggacgtgtccgcttcggagatggtctgctgcaagccttgagcactcgacaccgcctgctgcagctcgtttttcacgtgcagcgcagaccatacgaatgcgccggcgaaaacggcgagggctgcgactatcacgagtacgccgattaggatcttgcgacggcgacgtttgcgcttgatttggcgaatatgctcggcgctcatacggcggcgcacgcggcgggaatgcggggcgctggaagtggaatcttctggactggcggttgcgtcggcggctgaatcggcattagactgcggctcctcctgacggccttgctcaggctggacgccgaattcttcaggctgatcagacgcgccgttcatattccgtttcgctccctaattgtttgcaagcacttcggattccccagtgtaatagtagggggagtcgatgaaacctacggagcaaaaacggggcaataacggcggtattactgcccaactgttgccggtaacgcaagaactgatgcaacctaaacgtgacctgcaaaccagtattgctacaactcaagcatgacccgcgacggcagcattactgaagttccaacgtcgccaataatgccttgtggtcggaaccttgaatccgcttggtttccaaatttctggcgtacacacccttgtcgtagatgatatggtcgatttcagcgatagggaataccgaaggatacgtcatatgcaatccctcgccggcactctctcccgcatccgtaaagcgatcgcccaacaaatatctgaagcttgcatgatcccacgtggaattaaaatcccccatcagcacatacgattccccattatcgtaatgctgtaattgcgctatggaatccaaacttttattccataatccctgattgcttggtcgtggagaaaacggatgaacagatccaaatcgtacttttctgccattgaaatcaactgtcgcggcaggaatactactggattcaataggaatgagatcttgtgttgttttctgcagaggatgcgcactgtacagtacgttcacaccgccattatcgtgccaagtgagttgcgcggaaacggaatacggaagataatcctcaattccagcatcatgcaaccgatctaataatcctgatgaaacttcctgcattgcaagaatttcaacatgctcgctttggattgtttgcacgatttgctgcgcatcggcacaaccttgcttcgtattgaacgtcatgacacgcactgttgcagaaggttgcatggcacgatcattggtcggaacgacatacccccaatgccaaataatctggatgatcacgcacaatacgctcaacgcgactaaaagttttcgtttgccgacagtgcgaaaaactgttgcaataattgcgataatcacggaaagcaagccaagccaaggcatgagcgcgacgatcagaggcacgtagcgtttaccatcgagactgttcggcagcatgcgcagaagcatcgcgaacacgatgacggcggatgcgaaccacagcaacgccgtaagcagtgaagtgcgcgtttcacgacgcgtctcacttcgttggacatcgccaagtcgagtcatgcgcgctcctttcctgttccatattcccgtttcatcttcctgttcagcgcaatccgcaatcgtatgcaatcacatgttgcaaccgatagtcttacgcatcgtttttcacaacatctctcacaacatctcttctcgtgaacgctacccgcgttcatccccgcatatgtttcccgcgcgcattgagggtgacgctttcacaaaagcgccactatatggacactttccggcatttggaatcgttctgatacgttcatccgataatctataggttacaaaacggcgcttaacaaaagaggtagtcatgagcgaagaggcaatgcgagaagaagtggcgcaagctgtggaagtggccgcaaacaaggccgccgaagaggaaatcagcaagctggccgaattcgaaagcgccatcgacgaaacgctcgcctccggatatttggacgatacgctcaccgtcaccgacgcagacggcgtggcgcaagtgctgccagtgctcgattccgagccgatctcacacttggtggaaggcttggaagccgtaggcgggagcgccaatgtgttcgtgcacaccagcgcaggcgtggtggccctcagcgtagtggaatacaagcccaacgaagaggagtagccgtcgcagcatgcacggtcaggcggcacgcctacggttgagggcgcgttgcacggtttcatgcgtggaaccggcaccctggccgcgcacgccgaagaacaccatcagcaccatcacgaagcagattgctgcactgatacgaagcgcccactgaatgccgaacacgttggcagccgcatacacggcttttgtgccaccaagcgcagtccaacgaagagacgtgaacgtctccatcaaaatcaccaacaccggagcgccaatcgcgcccgcaatctgacgaaccgtattcgtcaccgcggatccggcgctcacctcttccggttccaaacaattcagtgaccatgtggtgatcggcatcaacacgaaacccatgccgatctggcgcacaaactgccaaatcgacacccaccaaatccacgaagtcatggaaatcaaactcatcatgaccgtgccgaaacacaaggtaatcgtgcctatcaacgccaccggacgtgcgccgaaacggtcaagcaccttaccaccgaaaaactgcgaaatgcactggcccaaagcacccggaagcatcaccaagccgctaatcgcagcagaatagccacggcaatcctgaatgtacaggggcatgatcaccataatcgaactgaacgcgaagaacgagagcgcggccgtgatcgtgccaacagtaaaactacgattcttcaacacgctcaaattcaacagtggcggctgcgcttcaggattttcaatctgcctgcgcgcgccatgaatctggcggagcacaaaccaaataattcccacaacgccaatcaccattggcagccaaaccataggatttacaaacgaatacgattcaatattcgtaaagccgaacattagcccgccgaaaccgaaaatagacagtccaacggaaaaaaagtcagccttcgcggttttatcgttctcaccgaaattatgcaatccaaaataggcaagaagcagcgaaattacgccgataatggtcaacgtgaggaaaattgaacgccaaccgttcaagtccgtctgcacaccgccaagcgtcgggccgatcgccggagccacgctcatcgccatgccaaccgtacccattgcgaaaccacggcgagacagcggataaatcgaaaacaccgtgatctgcaacaccggccacatcacacccgtgccaaccgcctcaagcaaacgcccgatcagcaccatcaaaaaagttggaccaagccaagcgaacagtgaaccgatcgtgaacacaaccatggaaacaagcacgatttcgcgcgtcgaaaaacgtctcgtaaggtatgccgtaagcggcaccatcacgcccatgaccagctggaaaatcgacgtcagccactgaccggtcgtaacggaaataccaaaatcactgacgatcgtcggcaacgcggcgctcaactgcaattgcgtgaaattaccgacgaacgtaataaatgtaagaatcgcaatggaaataaacgccgtgcgcgttaaatgaccgttctgatatgattcctctcgagtaagcgctcgggacatgttccgcttcgctgacatcaatcaccttctccacattcaaacgcacaaactatatgatagcccgtatgacagaggcatggatattcgcctgcggattcctgtttttgtcatttcggggtaacgctcccctatttagaggtatcatggcacacgaaagaggtaggcaagttttcgacgcaggcagcgtcgaaaggggggggggtggaggataatgacggtcagggccatgttccacatctgcatggagttgtggggtattttcatatgcctgatttgcgcaggcggaattttcattgcaacaccacacaaaaccagacgaactcgcatcaaaatactcatgcagatcgcctgcatgcttcttcttggaaccgacgcgctcagctggtattttcgcgtagatgcagacgaaaccgcatactatatggttcgcataagcaatttctcagtattctgcatcaactatgttttcatgagtttcttcgcaacctatgtttggttgacagtgagcaaacatcagcatcgcaaaccagccgcattgcgtgctgtctacgcattatccgtaattggaattctcttacttatcatcacacaattcactggtcttttctactatttcgatgaccacaatctttaccatcgcggtaatttctatcttctttcgcaggcaattgcggtcttgggaatcgcattatgcctcttcatgttgatctcatatcgcaagaatcttgatcgcattattttcctttccatgatgtcgttcttcgtgctaccagtattggcgaccatctaccaagcactggcatacagtttttcattgcaatgtttggcgatcgtgatttccacacagattatgttcgtcatggacaccgtggaaatgaacatgcgattccactcgcaacaggccgcctacgaaaaagcacggtacgaagccgaacatgacggcatgaccggtttgctgaacaaggaagcgggatggaaacacatgcgcaaatatttcgaccgcatgggttcgcacgacgaagcgatgctaatgttcgtcgacatcgacgatttcaaaaccatcaacgacacatacggacacacggtcggcgatttctggatccgcgaggtcgcatcccaacttcggcacatctaccggcaagatgacattatctgccgatatggcggtgacgaattcttggcgcttattcgcaacaccgccagcgaacaggtgcttgaaaccacgctgggcatgttcttccaacagttggcacgcacctcggaacagcacgggcaagacgtgcattgcagcgtaggcgtgtgccgcattgcagccgctgacggtgccagccttggcacggggcgcgccgatggagacgcgatcggaagcgtggatttcgaccaatgcgtcgcacaggccgacttggcgctgtacgaaaccaaacgattcaacaaaggaacgttcaccgtctacaactacgaccgttcccagccagcacccgcaaatatccgcgcctaaatgagcagcttcagctttccggcaattcctgcgctgggcaaccgtgcaatacggaaagcatcgcccgcttttcctgcgaagtgacagtcagcccgtacttgtctttcacgccaatctgccgggccacgtaatcgcaacggtattcactgttcgtcggcagccagtatgcggccgaagcggaacccttctgctgattcgcgggcccatccacggccagcagattgtacatgtcgttgccgaattggtacagcttcgcatgatcccacgtgttcgcgcccgactgccacgcattttccaacgcgaccacatgatcgatctgcaccgccgaagacgttttcactccacgtacgaattggatggtctgaccggtatacggatcgtcaagcgtgcccgacgcaacctggcagctacggccgttcttatattgcacgtccgtcagatcgcgcgcgagcacgtcttcgcgcacgtcgcaaccgttgccatcgtcgtcggtttcgcggaatccgaacgcatcgcgatcatatccggccttgctgggattgtcgtcgacggtaagtttttccaacgtttccgcagctgtgccggttgccgtgtactcgccggtgatttcgcctacggtcggattgactttcggcagcagcatgccgatagtgacgccgattaccgcaacgactaccagcaaaataagaatacgttccagcggaccgtcggcgttgatccaactttttttgaaccgcttgccggcccgctggatatcacgcacgtcgcgttcaatattccgataattataagaattacgattattctttcgaggcataattattaaaaataatacgaaattacggaattacggagtatcaggcgtacgtgaacgtcatcggatcatgtccggcgcgcgtcggaccgtcaagcgcgtcgatcgcggcatgttcttcaggggtgagcacgaatccaaacaaatcgagattctgcttctgccgatccgcatgcaccgacttggggatgatgatcgtgccattttcgatatgccaacgcagaatcacctgcgcaggggtaaccccatgctccgctgcgatgcgctcaatcgcaccgtttccggcgttcaaatcagcaccgcgagccatcggcgaatatgcttccacggcaatgccgtgcgccttgcaatagtccacgacctcgtgctgctgccaggtcggatgcagctcaatctggttgacggcaggatattcgccggtctcctcatgcaagcggtcgagatgctcgggcaggaaattgcacacacccagcgtgcgcacgcgcccctccgcgcggaattcctggaacgccttccacgtttcactggaacgccagtcgaacggggtgggccaatgcagcatgtacatgtcgacataatcgagctgcagcaagccaagctggcggtcgaacgccttgcgtgcgctgtcatacccctgctcggaatcgcgcagtttcgtcgtaacccacaggtttttgcgctgctcaccttccgtgaatcccgcattgttcagcgcgcgacccacgccggcctcattgttgtaccccgccgcgccgtcgatatgacggtagccggcttccagcgcactctccactacggaggtaacgccctcatcgtcgatgcgcagcacgcccaagccgatttgcggaatcagattgccgtcgttcaatgtgaccatgggggtatggaaagttgccatgcgttgtcctttcgaaggctgtgtttcaggcgattattctcaaccgttctcatgcttgttccagcttagccgcaggtcgccgcaattcggccatatttcgtggcacatgcctcgcattgcgtcttggaacggttcggacgcgccgttgcatgagtcgcgcatatgccgacagatgatatgcgcgtacgtaacataaccgcgcagtctcgtgcgctataacattgctcggataagagggcgacgaacatgaacagtacagacgacgcgaacgatatggacggcatgggaggcatggtcaatgcgggtgcgacggatggcgtggaatgctgggaaacggcacgggcgaatcacgatttctcttcccgccacgggcacgcgcttgccggcatgcttggacctgcttttgtggcggccgtcgcctacgtggatcccggcaatgtggcggcgaatatcacatccggcgcgaggtacggatatctgctggtgtgggtgctggtactcgccaattgtatgagcgtgctcattcaatatcagtccgcaaaacttggtatcgtcaccggaaaaagtcttcccgaaatcctgggagaacgacttggcgacggcggtcgattcatgtttttcatgcaagcggaagtcattgcaatagcgactgatcttgcggaagtaattggcggcgcaatcgcactgaaattattatttggacttccgctttttattggtgggtgcataatcggcattatttctacggtcttgcttatttttcaaaagagtgccacgcatcatatttttgaaaagctgattatcgcattgctgctggtgattacttttggatttattgcaggcctttttattgatccaccaaatcctgcgcaagttttacaaggtcttgttccgcatttcaaaggaaccgaaacggtattgatggcaacttccatgctgggcgccacggtgatgccgcacgcgatttacctgcattccacgctggtgaacgaccattacgtgccaggagagcccaaaccgagcgtaaagaccctgctacacggaagcaaaatagacgtgttctgggcattattacttgctggatcggtgaatcttgcactattgattcttgcggcgaattcattgcatggcatgaccggcacggatacgatcgagggtgcgcaacaggccattcagcatgtgctaggtccggtgatcggcacgattttctcggtcggcttgctggcttccagcctgagttccacgtcggtcggcacatatgcgggcgccgaaatcatgcatggactgttgcggatcaaagcgccgatgtgggcatgccgcgtggtgacgctcgtaccggcgttggtggtgttgtggtttgctaagaatccgacggaagcgctgatcatagggcaagttgtgctgtcgatcggcattccatttgcgattattccgctgatgaaatacacgcacgaccgttctttaatgggcgattatgtggatggtccggtgaaattcgcgatcaatatggtagttgtttcgctgattgtcgcacttaacgtgattcttgtaattctcacgctctccggtcgttcctgatgtgggtcccatttcggtgtccgcacagtcgaccggcgcagctgcgtccgcacagccgcctcgcgcagttgtccgccagtcgaccggcacagctgcccgcgcaggaattgccggaacaccgaggttgattcgggtctgcacaaacatcgcgagctgcgtcgcgaagccaacgatacgaaatcaacagcacaaagggcgatagcgcgaaatcaacggcacgaaggacaacggtacgaaaccgatggctcgaagggcgacggcacgaaaccaacggcgagctacacgcgcgtggtggcgcgggcgatcacgtgcgactgggtggtgatgtaactcggctccagcacacgcgtgccgtcgatccggtcgagaatgcgactgaccgcagtcggcgcaatccagtcgagacaagaatccatggtggtcagcggaggctggaaatatgcggcttcttcaatattgtcgaagccgatcacctgcatctgttcaggcacggaaatgccgttcgcagccaaagtgaacagcgcacccaacgcaagctggtcattgaacgccacaataccgtcgaatggaatcccggaatcaataagctgctgcgtaatgcgagcgccggaaccaatcgtccaatcctgcccagtgctcattaccagtcgggaatcgaatgccgctccccgcgcggcgcacgcttcgagcacgccgcgaagtcgcagttgcgcattgccttccactgcttcacgcacggaatcgatatgctccggttcggttcgcgatccgaccaccgcgagccgggttgcgccatggtcgaacaggtattcggctgcgagtcgggcttcctgaatatcgtcgggggtaacgtggtcggctttgccgtgtgtggaacgcgcgcccacgcatacgagcggatagtccacgtccaagtccgccgcttcaaggttttcgacttcggagatcgacaggatcatgccgtccgagacggtggtgttgaagttgcgcaggagtgattgcgctccttgtgcggatccttcggcgtaggtggtgacgtatacggagtagccgtagccgcgggccgcgtcgattacgcggttggcgagctccgacaggtatggggcggtcaatgttggtacggcgagtgtgatgaaaccggttttgccgcggttgagattgcgcgcggacacgttcacgcggtatccgagtcggtcgatgacttcctggactttttctcgcgtggagtcggtcatacggccggaatggttgatcacgttggatgcggttttgagtgaaacgcctgcctcttcggccacgtctcgtagggtgacgcgttttttgtccggcttcggctccggctttgactcgcccatgttcgtctccgtgattgttgaatatgccggtaaaaagtttaccagttatggcaagcccgccattcttgagtttcagaatggcgggctcaggttgtgtgagattgttgtgttacgcaatcaattgcgcgaaattgcgcgaaattgcgcgaaattatgcggaattatgcgcgctttacgacgagtacgccgttgcgatgcacggtgtagctgcccgtctgttcctctgcttccgcttggaacaggtagattggttcgccttcgatgccctgcaatgcgatttctttcttgccgcgcggcagatagaaatcgaaggttgcgtcggcggacttgcgcacggtgtgcagtacgtcggaatcggtcggattggcgacatttgcggaatcttccacgatattctcgcgcacgaattccgtaagatcggcgacgttgagatcgcagccgacgaagtatgtttcgccggaaccgtacggattgcgggtgattgcggcggtgccgccgagttcccattcgtcggcttcttcaccttcgtaggtggctaatacctgcgcgcgttcgccgtcgacgttcacatcgttctgccacaggcgggtgaccgcaccggagctcaaacgaatttcggacggttcgccttcggcttccgcgccgagaatgttgaattcctcgccgcgaatacccagcatttcgcacagcaggccgtctccggctcccgggtatccgccgagccaggtgtggaagttttcgtcgatcagtccggttgcgtaaccgatgaccacacggccgccggcagctgcgaaatcggccaaacgctgcgtatcttcggcgctgagcatgatcacggtcggcagtacgacggtcttgtatgcgctccaatcgtatttcaacggcacaatgtcggcacgggtgccggcgttgaggaacgcacggtaccagtcgcgcacgtcatgccaatggttgagcttcatgctcggcagggtttcggagcgtgtggcccattcggattccgcgctgaacaggatcgccgtatcggactgttccagttcggtaccctgcacgccagcgtcgccgagggttttcagcgctgcacccagttcgcacacttggcggaacagtttggtgtcttcgcccgcgtggggcacgagtgcggagtggaaggattcggctccgaatgcggaggcacgccactggaagaagttgatggcgtcggcacccatggccacatgcgcaatggagtcacgcacggtttcacccttgcgcttgcgtgcgttgagcggcttccactgcacggccgaagtggaatgttccatcacataccacggcttgccgagcgcgagggaatccatcaaagcgtcggagcagaacagttcgtcgatatgcgattcgccctcatggaagtaatggtcgttcgacacgaaatcgacttcctcggcccagtcggcgtagtccatgcagcactggtcggtggagaccatgaagttcgtggtgaacggcttgtcggggcagatttcggcgatggcgtcgcgttcggccttatagaagtcgagcagcatatcgttgccgaaacgctcgaaatcaagcttttgaccggggttcaccatggagtcggcgcccatgaaacgcgggatgagcacttcgtggaaaccgttcatttcctgaccccagaaggtggtgccccacgccttgttgaggttttcgatggtaccgtatttgcgttcgcaccacaggcggaaggcattgagcgcgttgtcggagtaatcgtaacggttgttccagccgtattcgttgcccatatgccatgcggtgacgtacgggttggtgccgtagcgttcggccagtttgcggcacagggtgagcgcgtattccttgaacaccgggcttgtcgggctccaggattggcgcgatcccgcgttgacgggatggccgaatttgtcttgcggcagcacttccgggtgcttttcgtacagccacagcggcgcggtggcggttgcggaggccagatcgaccgcgatgccggctttgccgagcttgtcgatgatgcggtcaagccagccgaaatcccaacggttttcttccggctgaatgcgatcccagctgaaaatggccacggccacggtattgacaccggcctgtttcatgaggcggacgtcgtcgtcccacacgtcttccgaccactggtcgggattgtaatcaccgccgtatgcgatgcctttgccgttgtcggtcagcagttccggccatttgaacgtgcgatgcatggattactcctttgtgtgcgtatggcatccgctataacgctgaggatgccagctcgacagcttcccttcgaaagctctcgtaaaatctttttataaaatctagtatatatatttactaagatatttgagatggtcccggggatgtccacgatgacacccccgaggtcttattttttgttcttttcggacgattgccgaaaaatcggtatgcgctttaccgaaatttcagcatgcgaccgttgcgatcattccttgacggcgcctgcggcaaggccggactgccagtacttctgcaggcacaggaacgcgatgaccaacgggagcgagggaccatcagacctcaccctttcgcacgcgcatgcaatgccaatctcaacaagtattcaaaatcaacgatatgcatcccacaacggggatggaaacagcatgttttccatctgagcccactctttgcataaatcaacttcaggctcgcgcaaccaccataattgcacaccatccatgatttccatggccttacgcaccaccggtcgcatgctcgacttccatgaacccaattgcggaggaatcagccaaggatattgcgaatagttctcccaaatatcgtccatacgagcagtgaattcatcatgcaacggatgttcaggattcaacgattccacagaaagcacggtaaactttgaaacagacacccccaagtatgccaaaaccaagcgtcactatatgtggacgcagcaatgaacaattcccctatgacaactagcatggggagacattatttgtaaagcataaaagaaggtccattcaaatggagaagccgaacgatattaaaagagactccatatcagtgaattactttttgaatactgctgcgtacagcggtctcttctcccttctttcggttattctcaccggccaagtttctgcggcgtcatcgctatatgttggactggcgctcggaattttatctcttttttctagaggcagtactgtttttataggtagcctgattgagcgtttctcaacggtatccctcaccgaggccggtttcggattcatggttttttcacttttgctgctacaaccggcaatgggtggttttatcggcttcctttttgcggatttggctttgctgggactcggtctttcattggttaattttgccctacgagggcatatcatcgctacagtaaaggataaaaaaattcaggcttctttgtttgctttagtgactatggcagccaatcttggatccgcgattggacctctgggctcgaattacatatataaagctttcggacaaacgctctttattgcaatcatcgtcggactctatgctttttctgctttactagctccaatagcgctgactcatcatgtcttcatacgcaatgagaaaagcggcgaggaaaacacttcctccatcgtgaagaccattacagactcgctgaaaagtcccggtacggttcttgccatcctggcggtgttcgtgggcagtataatgaatggtcagctttttgccggaatggcattggaattccactcgttatccgatagtccagtcataagaggattgttctattccattgatgccatatcggtcatagcactgcaaatgccggtaagtaagatcatctcgcgcaatatgaccaaagaacataatgccacctcattcatagtcaaaagcctggggatttatggaatttccttcgcactattcgcctgcggagtctcgtcgtactggtggatatgcatcatttccttggttgtgttctccattgcagaatgcatctatgcgccattaatcaatattgctctggtagaggcacagccagataagcctttggtggacattctgaactatcggctgataattgcagccattggtgaatcggcaggctcattccttggcggttggatcgttccggcactacgtcctgcaggattgacggcttggtattggtgtgcactggcgttagtgggaataatgcctgcagtcgtcactaatcaaattagaaaacgtggacaaagaatcattcgtcattgaaagaaaaagtcttggtgagtacaccggaaggggaatgacatgaaagtattattgctgcaacagcccaaatctttctcaaattatcctaaatggattgaggaaatccaagaacgtttcgattgtttagaagttatggtcttcacctcgaacgatcgagccgcacaccatagttggccgagctccgtcatcaaggaaatcgaggtttccgattattcctctgatagcgctaccgcaaaattctttgatattgtcaggaaatttaaaccagataggatagtttccagctcagaggaagacgtactgagggttgcagaggcgagaagtttatttggaattcccggtttacagcatgaactggcgttaagctgtcgagataaagtcacgatgaaacaatcggcccttgatgccggattaaagattattccctataccacctgccaaggctttggagatattatttcggcgttcgatcgttgggagacggttgttctcaaacctcgatggggcgcagggtctgcaggcattacgatattgcattcgaaagatgacctgcccgctttagctaccaagccggaattcatacgaaacgtgcattcaaaccagtattacttagaggaatattgttccggttccgtctaccatgtggatgtagtctatatcaattccggttcgattctgatctcaccatcacggtaccttgtcccgccactggatttcgagaaacaaaacaccggttccgtgatgttggatgagaacggtgccgactattccgagctgctccgactgacaaagcaattaattgcatctttcaacgatcagacgattccgaatgtgatgcatatcgaattctataagaatgaaaccggtgatttcgtattcggggaaatggcggcacgcagaggaggcggtctcatcaagcaggagctggcagccgcctatggcatagaccaaagcaaggccaacttcctattggaacttggtcttgtcgatgcggatgcgaatattacgcgatcatctcagtatggcatactgctggaaaccgccggattgaactggccaaaggaaaaagaaatcccggattgggcggttttggaatctgtgggcgagaaaaaaggtatcgctcataactctgttgattctgacaggaaatttcttatttccggcaagaatgaatctgagattattcaacgttctaattatcttataaatagtcaatataatgagtaaaattaactttttacagagggacaattgtaactaattctgcagcaggttctatatatgacgaattattatgtagaattggtaattctactgaatctagactcttccgtaaaataatgatactagtatcgctagggatgttgggagccagcattggcgtctatacgggaagcgcagcaggtagtctgactgcatcaaaatggtcgacatctcaagaaaccagcatgtctctttcagcaaacttttcaggcactaccacaatagaagataagcaaaatgagggtggccgtcaggtcacccccgaacgtatgcggaacacacataaaatcagcggcatgcatcccagaggggcgcgggaaacagcagattctccatttcggaccattcctcacacaagtccacttccggttcgcgcagccaccacagctgaatgccatccatgatttccatggctttgcgcaccactggccgcatgctgccggcccatgcgcccaattgcggcggaaccacccacgggtatttcgagtagtgttcccagatgtcctccatgcgtcccatgaattcgtcatgcaatgggtgatccgggttcagggattccaccgacagcacggtgaacagctgcaccatcatgcggcggcgcgagttgtgtttcaccaggtagcgcagatacgcgggaaaatgcggcgcggacgggtcgctgcccggcatgcccgaagagaagaagtcctccggcgtgccggtctgcccgtagtattcgtcatataccagcgccagcattttgtctttgttgtcgacgtatcgcaacacgccttgtttggagatgccgaccctgtcggccacgtcttggatggaaatgccattgaatccacgctcactgatcagctgaacagccgcatccagcacttcctcacgccgctcctgcggtgattttcggatacgtttcgaagtctcttcctctgccatgattccgagtctaatgcaccttgcgtcgattgccattgattgactgcctatggcacgtcatcgtgagaggtatccgcccgaatccatccatgacgccatacgcgagtcagatcccacgcctcaagattgccgccgttgcgaggatcccgcggcggtttcccttcgccactacccggtttcgcggagcgcgcaagctggtagctccaatagatctgccccgccgacacgtcccatgccgcgcgttgcaatcgtgacacttggcggtatgcagccgatcggttttggctgtgtagggcccactgattctccacgcaccactcgcccaccagcacgggaatacgacgagccgccgaacggatggcgatgctactcgcgcccaccagcatccggtacagccatggcagtcgtcgcgatcgcaggtacagccggcgtgccggtcccgaaaacagcggatcctccatcgcgatgagatactgatgggtgtcgagcatgacattgcgcatgccagcacgacggaaccaaccaccccagcggagcagtcggaaaccgtcatggaatacgatcacggtttccggacgtagcacggcgcgcaaccgggcgtaagcgtcgcggtagaagcgcttcagaaaacgcagtgagacatacgtgctaccggaagcctcatgagagtctttcgccgtgttcgacgtgctatggaacactgaccagctcactggttcgttgagtacttcgatgccgtgcagggccggttcgtcgcggtatcggcgagccaatcgctccagcacgttcagcgtgtactccaccaagtccgtattctgcgcccatttgcacacacccgtcagaccgccgttgtcgaaaccattctgcgagccgggcacggtatgcaggtcgatcatgatcttcagtcccgtctcccgcgcccaacggaacgcgcggtcgaggtacgtgatgcagcccggatgcccgggccagtcgccgaagatgaaatacggtatgggaatgcgtacgaggttgattccgtggtcggcgatgatacgaaaatcctccaaggtgatgtaggtttcgcggtgccggcgcagttcctcggctagattccgttcggaccagagggatacgtgcgtgcggtgcatccagatttcatcgtcttcggcgctgcgggtgaacggtttcggatccatccatttctccagcaccagccagttgccgaggttcacgccgtcgattcgctcgtcgatgcctagcaccatgcgtctcaccgcccttacgttcgggggttgcccgacttttcgtttccgcccatcacaacccatggcaaaacccattcggcccaatgggccaaggaaccgcgcgtcattcgcaacgttccttggtccattgtatgcgccccgcgagcggccacgcggccgctcggaatcggatcacagccggatcagggtcgttgaatgatcgtggtggccggccgggcgggatcagtcgacgggcttcgtctcgtccgcctcgtagtcgaagaagtcgaagtcggcggtcttctcgtgcagagcggcgtcggtgacggcgatgccgaccatagtgccggtgaattcgccgtacttgcagtattcgtcagagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccgtcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttcgtggtgacggtggcgtacacgctggtgagtttgcgtgcgatcaggctcgtgcggttgagcgatgccaacgattcctcgccgcggatgcgcagccaaccggggcgttccgtcacgttggcgaaggtggtcggcatctgccgcggcgaataataccagttgccgatcgcgccgccgtcgaagtcgtcgtgcccgggaatctccggcatcggcgcatccggcagatccggctcttcgacttcgagtttggccagattggagccgtccgccatgcgcagccagccgtcattcgtccatgtcatcttctgaatggcggtttcacggccaagcgtacaacgtaattccggcacaaacggacggctggtcaggtgcacaagatatgtctcgccgttcggcagatccacgtaggagccgtgcccggacttctgcagcacggaatccgggttgaaatagcgcggcttcaaatgatcgtcatcagcacgctcgtttgactccttcggctgcgaagtgacgagcggaccattcggatccggctcatacggaccccacacattgcgggaacggcccatggtcacggcatggttgtagccagtgccaccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacgcccggcttctcatagccttcacgggtctcccactccaagctgacgatgtacttcttgccattgtcatcatgtaaaatggacgcgtcgaaaccagaagatgtcagatataccggctcgctccacggaccttcaatgctctttgacttaatcagataattattcacgtcgaaatagcgtgcattcatggagttcataacgccgtaaatcacgtaaaacatgtcctcttcctcacaatacgtgagacatggagcccaaatgcccttagcgctcggcagcttggtgaggttcggcttcgtatcatcagtaagcacgtgggtgagcagctcccaatgcttcatatccttcgaatggtaaatcggaatacccgggaaccattcgaatgtagagacagcaacatagtagtcgtcgcctttacggcagatggccggatcaggattgaagcctttgaagatcggattatgcagcattgtcgttccttaatgttcttgatatcacgcgttgctttgtacgattcttgcgtccgacggaatcacttttggacggggaaccagttttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctaggccccggtacagcgagcgcttctgttcggcggtcagggtttcgacctgagccccttcctcgccgttgagcacgctttggccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcgaggaccacgttcttaaactcgggcgcgagcttgccgtcggggccgcgcatgaagtccttccactgttcgatgtcgaaaccgtcgtggaacaccacgactttgtcggtcggcaacgcgcccttgtcagcgtcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggtggtgttcggctcgttgatgatttcgatgcccatcagcgcccgacgatggccgtaccgcttggagaggcgttcgagcacggacagcacgaattcgacttcgtcgggcagctgcgcccacttgcacacgccggagatgccgccgttgtcgaagccgttttggctcatcggtgcggtgtgcagatcgataaggatggtcaggccgtatttctcggcccagttgaaggccttgtcgagttcgtcgatgcagccgatgaacggcgcgcggtcgccgaagatgaagtacggcacggggatgcgcacggagttcagtccccacgatttgatggtggcgaagtcgcgctcgttgatgtattcggcgcggtgggtcctgatacgggcctcgtagacggccggatcaagttgcgtcggcagatagtattcgtcatcggcagtggttccatcgaataatgccgggttcatccacttttccagaaccagccagttacccaggttcacgcccttgatgtaattaaggtccatatgcactccttcgtacgctttcaatcatattttttattacttagtaattactaagttagatgatagtacatttttctcctccccgcaactcgtctcggacatctctccgaaccgctgtcgcactatttcgcataaagcaccctttgcgaaaatcgtgggaccgacaatcaaaatcgtgcagcaatttcacagaatcatgcgattaatcataagaaaaagcctctttcttgcgggaagaaagaggcaacctgcagccggagagacgattactgcttatcgctggcgaatcgttacgtgcaaggcactcaccgaggcagcgggcaacgttaccgtcagctcggcaccgccggcagattcgtgcacgctcacggcactatccacgtccacggcatgagtgcgcaccagatccgaatgctccactgtgttgcaatcatgcggatcttcggaagcaagcgtttccatcgaatcaacctgagcgccgcacggcaaatgcagccgcacttcggcaccatcgttcatatgcgcattggtgagattaatcagcagctgcgtgccatcctcattacgtgacgcaaacgtatacacggcagaatcctcggaatcgttacgcgccacatcaagtgcggtcatgccacgatgcgccttatacatcatgaacacatcgtagttaggcgtaaggatggtccgatcgccttcagtcaagatcagtgagttaagcacattgatggtctgcgcgttacacgccatggtcaccttgtcgcaattacgctgcagcagatccaacgtaagcgcggtggtgatggcgtcacgcatggtcacctgctgcttgagcgcagggcgtgcgaagaatgcggtcttgtgccaattgccccattcgccgatgattagatcgacatgcgcgagcttggaatccatagccacctccggctcatgaataagcgccaggccgtcattcatcaaacgccactgatcacgcagaatatcttcaagttcgaggcatccctcaatcaccgcattccagccgtcttcatcgaaccgggtgggagtgtcggcatcgttgtccacattccaattgtagaagtgcagatcatagccgtcgatattcggctgacgatattcggcaagaccacggaagaaatcctgggtccactgcacgcgttcgcgcggcttgttgccgtcaggaccactcgcaatagcatacattggggtcggcgcgaacacatcggtggtgaagctcggcatggcggatgcgaacctgcggtattcattgaggtaggtccgcggagtcatggtaccgccgccagcccacacttcgttgccgatcccccaatatttcaccccgtaaggtgccttatggccgttagcctcacgttccttggcaagatcagtgggctgcgcacgattgcagtactccatccaatccttcatttcggcgactgtgccggaaagcatgttgatattgatccacggttcagcgccgagcatttcacacaaacgcaggaattcgtcggtgccgaagctgtgatcgtccagctcataggtggcgaaattctcgttgaaagtggttttacgttcgctttgcgggcccacaccgtcacgccaatggtaggtatccgcatagcatccgcccggccagcgaataaccggcggctgcaatgcacgcaaagcatccaatgtggccttgcggtagccacgctcgttttcgatcggggaatcctctcccacccatagaccttcatcaatgcattcgccaaggaattcaatgaattggccatgcagtttcggatcgatacgaccaatcgtactgttcgggtcaatgcagacaaccatggtttgctccttttgccgtagtgctcacatctgcaacgttcgtaattcgtatggttcttgtagttattgtgccgcacaatatatgcgaaatggccgaagattccaggagagataatgaaagaatctccggccaagttatttcgaaaagcgccgacgctacttcacctttttaatcatcagaatgaagatgcaggcgagcgccaccataatgattgccgtcgggaacaccagtccgtacgagccggtagctaccacaatggcggaggtgacaatcgggccgaccatctgaccgagagtagtggcaatgttcaaaatgcccagatccttcccggcctcttcttcattcggcagaacgtcaacattgagcgcctgatcgacggaaccgtacatgccgtagccgaagccaccgatggcggagaagagaatcatgcccaacgcgttgtgcatgagccatggcagagcataaccgatggcgagcagcacgcttgcggccacaaccggaatcttacggcgaccgattttgtcggaaatcggacctgcggaaagcgcggaaatcagggagacaaccatcagcaccaagctcatggtagaaatggtggccgcggaatcttcaacactttgaccaatgtagtcctgcagaatatacagctggtagttgagaatcatgtagtagctgaacagcagcagggaacggccgataaatgccagccagaagtcgcgagcgcctttggtcggcggacggaagctcatgataatacccttgaaatcaaccttttccttaggcatatccttgctggacttttccttcggccagaagaccacggcaagcacaccggaaagacccatagccacaccggacacgatgaagcccgggagctgcagggtgatgaactgcgcaccaacaatctgaccaagagcagaaccgaacaacgtacctgcagagataaatgcggacatggtgccgcgcatatcttcaggaatacggtcagacagagatgcgatgaccggtgcgatcatcatgttcagaccaaccatggaaatgcagtagctgatgccaatgctcacaccgtccggcagaatgccgatgaggaacagcgaaatgcccgcaacaatgccgcccgatgcgatccatggcgtacgacgtccgaagatcgagcgcgtacggtcagacatgttgccaaccacgaggttggaaatcagcgaagccaatgccgtggccgaattcagcacgccgaaaatggcgtctttgctgtcgggcgcgatatcagtcaaacgctgcggcagcagcactgcagcaacgatctgtaacgccagcatccatgcgaacgagaacacgaagaacgctacgcagaaacgcgttttgtcgattttggaaagctcgttggcatgctccgcaggccgtacgtcagtcatgcttgtctccttatctttctttttcaaagtcagccctctacgtttttttgccgaatcttcaatgatcatgcaaacaacaggcaagagaggcgttgtgttgaagtcaactctcatcggcttcgtcagttatcttatatcttaaagatataagataacaaatcggcgtgtcgaacaacgacctactttcaagcacagcaatcaaccgcataaccgcaatatcgaaaccacatgaaaacgcatgtggacagcggcaatagtattcttcaaatcagtatggaatcacaggaaaacacatcagcaaacagcatcaagagccgtccaatcaaccaaagaaaacgactctccccagcgcagcgacgaaaacaaatcacacaagaagcggtaaccctaatcacgcaatacgggtcatacggcttcccaatgcaagcattagccgatgcagttggcatgaccctgcccggactcaaccattacgtcaaaaaccgagaagaattactctcattggtcatcgaaacgttctacgactccgaagaaggcaatgcccacacgacattgggcgcagccatcagccactgcgaccaaacagattcagcaaccaaagaacgccgacatctgcccggcacattgcacgaaaccgtgcgcttcaacgccaaacgtcccgaacttgtcgcactgttcatgcgcctcgccatcgaagcgtccgatccagaacacccagcccacgagttctaccagaacagacacaattcgattttgatcgacatgaccagcgtggactgggaactaccggaagaataccgcgatccagaacgcctgcatgacctcatcgtcaccgcgttctttgccatggacggcgtgcaaatccagtcgttaaccaatcccaacgaatccatgatgcaactatgggaacgcgcagaacgcatcctgttcccctcccccacatgggacggctaccgctgaacagagcgcaaacaagcaaagacaccgcaaaagcaaaaaggcgtttgcctgcggcgaccggtaaccgatcaccataggcaaacgccccgcaacacaacaccggcttgcgaagatggcaggaagagaagggaaacctgccatccggcattcaacaaaccgctgccacaaccaagccgacgcgttacgcacacattcgcatcagccaggcagctcccgtcagtccagcacaaacgtgttgaacgaacgcggagcaagcgtcaccttgataccgcgatcggcattgcaaggatcggcaaattcaaacggacgctcctcttcgagagcgttctgggccaccaccacaatggtgccatccggattacggaacgcaatagccatcgaattgaaatgacccgtagtgccaagcacatgcgcacccggcttgacgaaatgcgagaaatgacgcatcacataatattccggattacggcgaacctcatgcgtatccgcagtaatggtgaacagtgaattctgccaccacccccacgtagaatcctgatcgtcaagaatcatattccaataagtgtaagcagtcgcgccattacgcaaataatggttgatcaagtggaaaatatactccgcatattcccacgtattatcgcccataccgcattcggattcagactgaatcaactcgatttcaggccaggattcatgcgtacgcgcaatacagttctggccggcccactggtaagcgatgcccttgatgtacttgcgagcgccatcgtcgaacagaatattgtcgacaaaacggttgtaattattcagcttcatgccgtaaccgccgcccgtccaggccatgtcctccggcccgttgagcgttcccagccaaatgtcggtgctgagcccggcctcgtcgaatgccggcccgaggtaatcgcggatgaacaccttgagcgcttcggaatcccacagggcgctcgggaacttctggtcggcgaacacctcgttctgcacgtgcagctgattcacggtgatgccatgctcggcgtaggcctgaatgtatttgacgaagtacttggcgtaggctttgaggttctccggggtctgcacgagacgtccgtagttgtaggccttcgggcgcttcatccatgtcggcgggctccacgggctggagaacagttgcatgttcggctgccattcctgcgcgcgatgaatatacggaatcagcgtctgctcatcatgctcgacggagaaatgctccatctcataatcgccgtcggtctcgttatagctataccaatgatcggcgaaatcattggcaccgaccggcgcacgattgaaggtgaagttcatctcatccgggctgaacagttccttgatgatctgatcacgttcctcttcagtaaccgtctgcagaggaagccagccaagctcgttgaagcagccgccgaagccacgcaatgcctgatattcattgccatcaagctgcagatcggaagcggaagtggcatgcgtggattcaatttcggatgatttgtcggcaagcttgttgtcttgcgttgtcgcgatccaagtagtcatggaaagtccttagtattgtcgctgattctttggatttatatttattcgtttttttgagttgtttttatttgattattgggatttagttatcgatatttagtttttgagattgaattattgagattgaattatcggcaacgcaatttcatttcagtaagcgcaaaaaccgcaggatgccgcgataatctattcacgacacgctccaggccgctctagccaagtctttacggtcttaaacagattatcgcggcatcctgctcgtaacgctatgacgttacgtttgcactgttatttagttttgcattgttgttcagttttggaaaacttcctattacctctcttcctctcctctttcgaaattgaggggagggggaagggatggggttacttgaccttcttgatggccatgatgaagaagcagccgatgatggccaaggcgatggcggtcgggaaggcgaagttgtagccgagggacaccacgatggtggacatgatgaccgggccgcacatctgaccaagggtggtgcccatgttcagaatgcccagatccttgccagcctcttccttgttcggcagcacatcaacgagcagagcctgatcgaccgcggagtagacagcgtagccgaggccagcgatgccagcgaacaggtacatgcccagggtggacgggatcagccacggcatggcgataccgatagcgaagagcacggaagccacgacaaccggagccttacgacggccgatgagatcggaaaccgggccggagatgaaggagccgaccagagacatgaccatcatgagcatggcaacgacagacacggtgacagcggattccttgacggactgaccaatgtagttctggatgatgtagagctggtagacgttgatcatctggtagctcatgagcatgcagaaacggccggcgaaagccttgtagaagtcgtgggcgccagcgaacttcggcggacggaaggatacgaggacgtccttgaaggagccctcttccttcggcaggaagtcagcggactgttccttcggcaggatgatcacggcgacgataccgccgaggaacatgagcacgcctgcgacagcgaagccggcagtcaggttttcgatgaagaatgcgccgatcatggtgccgatcggagtaccgatggtggagcctgcgccatagaaggcggacatggtgccgcggatgccagacggcacgcggtcagacagcacggcgaccagcggggcaatcatgcagttgaggccgaacatgcaggcgcagtagaagatggtgagcagcaccgcgttgtgcgtggtgccggtcaggaacagggtgacgccaccgagcaccgcgccgaaaacgatccacggagtacgacgaccgaacctggagcgggaacgatcggagaagttgccgaacatcaggttggcaaccaaggatgccaccgcggtgaacgcattgacgatgccaacgagagcgtccggatcggcaccttcgatggtcttgtagtgcatcggcagcagcacggcggagacgatgccaaggcccgacatccacagcacgccgaacagcaggaagcccgcaccgaaacggatggtgttgaccttgctcagtggcttgccggtttcaggagacagctgcggatccttgtctgcagcggcgatgttggcgttataacgcaccaaacgctcctctttgcttgcgattgcttcactcatgaaactctctccttcgattcatgtttcagtagtgttttctgtgatattcctgttttccgatagggcttctctgcccagccagctaactaccatttggtaactagccggttttcatcatagatgccttttcgaaagaacgcaagtcagacgcgaatttttccgacggcagcgttttcaaatagcaatccacaacgattcgccccatacggcaacttcagtttttattacttagtaactgcttagttaaagcatattacaatctcttgtatctgtcattttccggcgtgccccaacgtttccaacacacttcctctcccccttcttgtaacttagtaagcacaagagaggagaacgcatgcgtcgccacatcgaaagcaaaaccaagaaacgaatgagcgcagaagaccgcaagaaagcgattctcgaaaccacggtctctttcatctcacaattcggattctggggatttaccattcgcgacgtggcacaagctcagaacatcaccgaagcaggactcctttactacttcaaatccaaagaacaactccttgaagcgacactcaaatacgccgatcgcactaaccaaatcgccattgcagagcatcttggcgtcgaaggcgtgaccggcgaagtcttgcaagacggcatcgcataccattgcgatctcggactcaaggccatctccacgggaaccgtggaaaccaacgcaggccgacccgaaatggttcgcctctacaccctgctcgaaagcgaggccctaagcaaagaccatccggtgcacgagtatttcgaacagcgcgaaatcaatctgctgaaggaatacacgttcgcagccaaacgagatggcgtcgccgatccggaacgcaccgcactgcaggtgctatccgccatggaaggcttgcaattgcggtggctcaacggatctcacgatatcgatttcgttggagaatggaaggccctgatcgaccttctcattccctaaacgttctcttctcgagttctcttatcgcagatttcagccggcgatcaccgcaacattccagcggccaatcgtcaacggatcaccctgcttaacggctgcaccttccttcagcacgacttcagtatttgcaacctcatcaatactgccgtcggtggcgatgacgaccggagcgaccactacttcacccgcaatcgggcttgcaacagtaacttcgtcggcggaatagttgagcaaatacgtcacgttctcgccgagggcattcacaccctggcgaaccgcgacctgtcccgcgagcgcggttccagcgccctcgacgccggcatgctccacagcctctcgcataaccgcacgaatggaatcggcgtcaagcagtgtggcgacccactcggcatcgcccttgccgaatgcgtgacgggtgactgcggcgtaatccttccaagcgtagtgtccataagatgcgagcacctcagtatcggcgtcggcgttcaacagttcgatcagcgactgagcatcggtggacgcggtttcggcgagcgcacctgcgaattccacggaaacgtggccgtttgggcgggtgaactggttgtacgtcatgccgaacacgtcggtgagattgtgcggcgcgcggtcgtgccatacggtcacctcgtcgtcggtcacgaaggagcgcatggtggagacgaggtgtccgccgttggagacgaattcacgcaggcgatcggtcgtttcctgcggagcacagtacagcgccggggtcacaatcatctcgtatgaggccaaacgctcggcgggagcgtcggaggggatgaaatcgcattccacgttgagctcgaacagcgcgtcgtagacattgcgcaccacgtcgttgtatttgagggtgccgccgaatgggaagccggcttcgatgaggaaccagtcgagcgcggtcagcgattcgttgctgaccatgatagctaccttgttgtgcttcttcaggtggacgagccgctcccccacttccggtttggcaatctcgcgaccgaatacgccggcttcgcggtacgtggggttcggttcgaggtcgtggctcagcaggcccttccaatatgtttcaaaggaattatggatggagtgccagtgccagtattccaccatgtcggcgccggaggcgagatgggagtaggcctgcaggcgcagctggccggggaatggcacccagccgtgctggccttgggcctcggtttcgagcaccaggtagttctggccgttcttggtggagcgggtcatgtcgccgccgaaggcgatctccttgccggtcaggtcgtcttcggtcgggtggtagatgtccacgccggtgatgtccaccgcggtcgcggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctgatcgcggcggaacttgtcgaattcgccgcccagggactcgttgatggtggcggtcacgtccgggaagtcctcccaggagtcgatgcggttggaccagtagtcgaggccgaagtggtggttgagctcgttcagatcgccgtggaacttctcgcgcagatacttgacgaacagacgctgcatgtcgttggacacggaatcgtagtacttggtttcattatcgacctggtagccgatcaccgccggatggtcggcaacgtgggaaatcagcttgcggatcacgcgctcaccgtagaaacgataggtggcgttgacgatgtccatgatctggcgggcgccgtacttgccttcgccgttcggggtgaccgcgagcacgctcggatcgatcttgacgagccagctcggcaccgcgtaggttggagtgccgacgatgacgtcgataccgacacgctgtgccgcgtcgagagcacgatccacataggtgaagtcgaacgcacccggctgcggttcgcaggtgctccatgtggattcggcaatacggataacgttcagtcccgactccttcatcatcctcatgtcttcatcgacgcggtcgatgcctttcatcatgaggtattcgtcgtaatatgcggcaccgaaaagaatgtgatctgcctcgtaacgccccatggatcctccatcgtcttcattgacttgttactgattgctactgtttctgcgtctaaggctgttcttctgcggtatctctgggatatatccttgggatgcatcctcggaactctcatatctaacagccattagatatgagaaatataaatcttccagattcagttgtcaagaaccgcaaaatttcatggcgtgtcttacctaacaaccattagatacagcgtttccccttaactaaaaccaaccaatcaccgcacgccacgcaaaatgctatcccagcaggcaaatccatccagccactggaggaatcaccccgcccaaaaccttccaaaagtcctgattcttccagcgagtggaagaattgggacgcgaaaggctatagaaacacagcctgcaagagagttggacatggcttagcggtagccgtcccagacaggtgaggggaagatcatcttttcgaaggcgagccattcatcgtagaaatcgatgggcggcttacgcgtccaacgcagttgaatgccgtccatcgcttccaagctttgacgcacaatcgcacgcatattctcccaaccaccgatttcaggcggcaatttccatgtgtactgggaatagtgttcccacacgtatttcggacgattctcgaaatagtcgtgcaacggatggccctcgctgaaagattcggtttccagcaccatgtatagctgcagcaagctacgtcgactctcattgtaacgtaccaaaaaacgcaggtatgcgggaaacaacatgccttccggatcgctgcccggcaatccggattttgcaaaatcagccggagtgccttcctgatcataattgtcggtgactagcagcgacaacaaccgttccttattgccgatgtaatgcagcagtccaggctggctcatgccgatcgcatcagcaatgtctttcaatgacgttccgtaataccccttttccccgataagacggctcgccgcagcgatgatttccttcttacgttcctcaggtgatttacgaacacgtttcttcccctcattacccataaggaacagtgtactatctaccgttcattagacagacaaaatctgtatcagaccgttgcatttccactcgccacacaaaaacgagccgatcttcaacagaccagctcgaaattacattcaaaaccacttcgagatcacattcagtcagcctcgaccaaccaaaatattcgaaaagcagttttacttctggaacacgtcagggtgtttcggatcgccaggttcgtcggcgaggacaccctcgagcccgaggaactcctgccagaattccagcgaattgccgtacggagctgcctgatggccgcgcgcctgcaggttcgccttcgcctcgaacacatcctcctcgcggatgccatcgaaatacgattcgagacgctcacggttcgtcggatcatagaacagcgatccgatgatttccgtcagtcgttccgcacgcgctaccggcagcgaatcccagtgacggaattcaatgaagttcttcagacggacatcgttgaaatgcgtggaaatcacatgattgatttcgtatgcgttgagttctcgatcgggatacacgtcgttcgcattctcatagaacgcaggatgatgcagatcagttccgggagtttctaacgcttccggagtgtgcgtcagatcagcgaacatcatcggcgtgctcaacacgtcgaccgcataatcttcccaaccgaagcgaggatcaaacaatcccggaataacgttcgtgcgctgcaaatccaaataatcccacatgcgttggcgcagcagcggatacggattctcctgtccctcgaaatacggggtgttacggaagaaccatgcgagaatcgggccgaccaccgtacccaaacgcagtttggaaatcgcgtcctgttcggaaacatagtcgatgctgacctgcgtcgaagcggagcaacgcatcatgcacggaccgaactggccgacgcgccccaaatacgcggtcatcgccttgtaacggtccttcggattgacgggaatgtcggcatagccggacttcggctgatacccgtaattaaccaagcggaagccgagatcgtcaagcacgggatcgacttcgcggcggaacgcaccgtaaatcgtgcacagatcttccggcttgtgcagtatacccagcgagcattccagctgaccgcccggctcaagtgacacggaaataccttcgcggccaagaccaacaagcctgccgttctcccagtattccttgctttcgtcgtaatatgggcgaatgcggttcagcaacgcctcggtaccgttctcctcgtaatagttcacggcggtatcatcgctgttatgcaccggcagatgctcgatttccacaccgaaaccaccggttccacgctcttggcagcctgattcgaagaatttgaccagactttccacatgcttcggattcggctcggtaagcaggtgcgcataagaaattcgtggcgttgtcatgtggcaatcctatcgaaactcgttgatgagcacggcgtgattgctatacgaaaaactgatagccaactcttgcgtatatcgaatcgaatacacattttcggttacaacagacatgctctgcaaagccgaccaataataattaacagctattaataaagtcagaagcaattaccgttatttgaagaattgtttgtataaatcaaataaaaataccgacgctgaagatgttgtcagcgtcggtattttagtcaattccagtcagtgcttattgatttatccgcctatgatcaggcggctttttcgctttgcaccgtctcaccctgttacgcagccttgtgagccttcttggcggctgcgatcatcagtttgatgcggttgagctggttcgcttcggatgcgcccggatcgtagtcgatggacacgatgttggcttccggatgcaggcggcgaatcttgccgaacatgcctcgaccggtcacgtggttcggcaggcaagcgaacggctgcgcacaaatcacgttcgggcagccggattcgatgagctcaaggatttccgcagttagcagccagccttcaccagcctgcacgcccacggaagtgacctcgtcggccttcttcacgagttccggcatcggcaagtcctgggagaacttgccgtgcgccaaatcgatcgccttgcgtacaggagcgttatacaagtcaagcgccttgcgcatcagcgcgtagccaagcttgttgccgcccatgccgaggtaatgctcgttccagtcggaaatgtacgggcgggtggtcatgaattccatgatgcccggcaccacagcctcgcaattctgcgattcgatcacgtcgaccacatggttgttggcgtccggctggtacttgacgagaatctcgcccaccacgccgacgcgcaccttgcgcggttcgtccttcaacggcagtgagtcgaacgatttgacgatttctttgacgagcgtcgaatatggcaggtatcccttgccaatgaacttacttgccgtcttcgagcgaccgtggttctcgagcgtttcacgcacgatggtgttccatgtcttgtacagctgattcgcactgcccggcgtcacctcgtacgggcgcacgcggtacaggcatttcatcagcaggtcgccgatgataagcgccttgatgacgcgatgaagcaatgccggcgtcgctttgaagcccggattgtcttcaataccctgcgtggaaatggcgatcactggaatttgcggatatccggcatcgatcagcgccttgcgaatcagaccgaaatagtttgtggctcggcacatgccgccagtctgcgtgatggcgagcgcggtgtgctccggatcgtatttgccgtccagaatcgcgtccacgagctggccgataaccatgatggccgggtagcaggcgtcgttgttgacgtatttgaggccggtttccacgttttcgcggctggcgtgttcgagaatgtcgaacttgtagccgccggagcggatcacggattccactagggagaagtgaatcgggctcatctgcggagccacgatggtgtagtccttcatgtctttgccgaatggcacgcggttggcgtatttcgacatggtggcggaattgtgtgcggacttcttcgcttcgtcgacgccgttttccgcggcacgcttggatgcagctttaacggcttcggtgagtttcggattggctttcatcacagtgtcaagcatgacttgacggcccggagtcggcgcttcggttccggttttgcggaattcgccctgcttgttggacacgctgtctcgcttgtcgggcgtggctgtgccgatttcacgctgtttgttgcgttcacgctcttcgacggctgccttgagtgaacgaaggcggattttcgctgcgcctaggttggagacttcgtcgattttcagcatggtgtacacgtcggccttgtcggcgaggatttcgcctacctggtcggtggtgatggcgtcaagaccgcagccgaaggagttgagttgtacgagttcaagccctgggtaggaggccacgaaattggctgccgagtataggcgtgcatggtaggcccactggttggtgacgcgcaatggcattttggtgaccttgcggtcttccacatggcggaagccgtctgcattcttcttacgtggatcgtcttcatcggcggcgaggaattcgctcaggttgagcttctcccccggctgcagttcgcagatcgaatcttcagataataccaccataccgagcgagcatatggtttccggaatgccatggttgacttccggatcgatatggtacgggcggcctgcaagcacgatgcctcggcagtcgtgttccttcatgtaggcgagtgccttgaggccttccatttgcacgtcgtgtttgaagacttcgttttcggcatatgccgctttgactgcggttttggcttcttcacgggtcacgttggcccaagcgaattcttcgacgatacggtcgaccataagttcatggttggccatgttgaagtatgggcgcatgtagcggatgccttctgcacgcagttcgggcatgttcgcgccgatgaccacgggatagttggctaccaccgggcagttgtagtggttgtcggtgttgggtaccaggttctcttcgtagctgacgcacgggtagaagatgtttttcacacccttgttcagcagccatttgatgtgtccgtgcacaagtttggccggatagcaaatgttttcggatgcgatggattcaatgcccgtttcgaacagttcgtgcgagcttcgtccggaaatcatcactttgaagccgagcgaggtgagcagtgtgaaccagaacggatagttctcgtacatgttgagtacgcgcggaatgccgatttcaccgcgggttgcgtttttgtcggtgagtctgcggtaggcgaagcaacgcttgtacttgtaatcgtagaggttcgggcgatcggaacgcttctttttcgcgtctccgcctcgttcgcagcggttgccggtcacgtaacgggatccgtcttggaaggtggtgatggtgagcttgcagtggttttggcacagcttgcacacgtctcgttcggaggtcatcgacaggttgtcaagttcttcgccgctcaaaatgttcgatgcggtatgacgtacgtctgcaatcaccgcttctttggtgtcggtggtatcgacgtcttcgtcttccgcttcgtcggcatagtgcatgcgtgcggtcagtgcggcaccgtatgcgcccatgagtcctgcgatgttcggtcgggtcacttcacgttctgtgagcagttcgaatgcgcggagcacagcgtcgttgaggaacgtgccgccctgcactaccacggtgtcgccaagttcgccggaatcacgcagtttgatcaccttgtagagggcattgcgcaccacggaatagcacaggcctgcggcgatatcttcgatggacgcgccttccttttgcgcctgcttcacggacgagttcatgaacacggtgcaccgggagcccaaatcgaccggatgggtggagttaagcgccgcttgggtgaattcctgaatggtcaggcccatggaaatggcgaacgtttgcaggaacgaaccgcagccggacgagcatgcttcgttcactgcgatggagtcgatcacaccatcgttgatggcgagatatttcatgtcttggccgccgatatcaatgacggcggtgactcccgggcttaccatttcggcaccgcgatagtgagccatggtttccactacaccttcgtcaaggtgcaggccggtggtgatgaggccttcgccgtagccggtcgcacaggatcgtgcgatccatgcgccttcgggtagttcggcttggatttttttaacgatctgcacggctgccgtcaacggactgccttcgttggtcgcataagaggaccatacaatttctcgatcgtcgttcaccaatgtcgctttgatggtggtggaaccggcgtcgatgcccaggaagtgcggtccttgggctccttcgagcgtgccttgatggatatgctcgcgatgatgtcgttcgttgaatgcggtgcgatccgcttcggtagcgaacagcggaggcatggtcggagtgttggacggcaggttttccagttcgtccagtcgcgccagcaggtcggcgcaggttcgtgcttcgtaatgcttagtcaaggtcgtcaccatcctgatcggcctgcaatgcggcaccgtatgccacatacaggtgagcatcggtcggaacaatgaattcgtccactttgccgtcgagcgcccgcttgaacgcggctcgcagctcggacatgaagaacaacggaccccccaggaagatcacggttccatgaatcgggcgtccggaggcaaggcctgcaatggtttgcgtggccactgcggtgaagatcgatgcggccagatccggtttggccgcgccatcgttgataagcggctgcaaatcggttttggcgaacacgccgcaacgtgatgcgatcggatacagggtttcgtattgcgcggccatttcgttcagaccagcggcgtcggtgtcgagcagtgttgccatctggtcgatgaatgcgccggtaccgcctgcgcaggaaccgttcatgcgctgttccggagtcggcttgagataggtgatttttgcgtcttcaccaccaagctcgatgatcacatcagcctgcggatattccttgtcaatggcttcggtttcggcgatgacctcctgaacgaagggcacgtcgaggctgtctgcaagagcaagaccgcctgaaccggtaatggccagacgaatcggctcgtcgcctcggccaagcttttccaattctttgtggatgtcggccagtagtccggccacggtggcgcgcacattcgcgtggtgacgccgataatcggagaacagcgcgtccgcgagcgcgtcggactgatcgagcaccaccgccttcacagtagtggaaccgatatcaagacctacacgcaacggctttgtgccgtgcgtttcggtcacggcttctgctgcttcaaccatgtatcaacctctatcgttctatccgccgggctgcattccatggcaggcatggaagcccctaccccggttatccaatcatgtaatcgtagtctgtgcccacgcctaagcgcttcgtgagtgctcgcaatcagcataaaaggcacgacacagcgcataaactagacaactaatccagtcaacgtgcctaattatgtatctggacgctcgacgaatgtcgagatcgcaaacccttccaagcatttccatgtcaggatgcgctgccttcccctgcagaacggtctttgccgtatatttcgggaatgaatcgtgtttgatcatgtagtttcgaccagatcaccacttgtccgctttccagtgatttcggcacgtcgatgatgcgttggttgctgcttccgcggaattgcagcagggaatcatgtaattctttgatataacggccatccacgagaatgtcgatcagttcgagcagctcgcgcttgtcggggctttcgccttcgcgcatgagctcttcccacgtgtagccggtccagcaccaaatatctttggtattaccgaaccgttcgcgtattttgcgcgcaaggggcaacagcacgcccgtgttgagcaatggttcgcctccgaggaaggtgatgccttgcacatacgattggcttaagtcatccatgatttgcgcttcgagcttgtcgctgtattcgtggccggcttggaaatcccagattgacgtgttgtagcattcctcgcaatggaacgggcagccggacacgtacagcgagcatcggatgccttctccatcggtcatgaggaaccgtttgtagtcggcgatcatattgcggctcatgcggttggtccattgccctgctttgggattgttggaacgagttgtgggaatgaaaggtccgcgattggtttcgtccgccgcaaagtcacgacgttgaattgctggattcgcgctgctgatcatacgttgtcccttcacgttttgccgttacgtcgcgtttttgcgattgctgcttgcctcatgattgtcacagaatgaaagagggtggaaacccaccctctttcatatttcgtttatgtttgctaccgacgcggcccttacttggcttcctcgaaccattcacgttcggaaccgtcactcaaggtgacatgaccggtttcgccgctcatatgcttgacgcggtgcgcgatctcctcgtgacgtccatgcaccatcgggcgctgcaccgggttgcccaagtagccgcaggtgcgcttggtcacgttgcagtggtccgggtcggagttgccgcactccgggcacttgaaaccttcctcagtgggctcgaagtcgccttggaatccgcaatcgtagcagcggtcgatcggcgtgttcgtgcccaggtagccgatgccgatgttgtaggcgtaatcccacaccgcttcgagtgccttggggttggactgcaggcacgggaactcgcagtagttgatgaagccgccggacgcgtagtacgggaagtccttctcgtagttgagcttttccattggggttggctgcagccagaccgggtagtggaaggagttggtgtagaagtcgtggtcggtcacgccttccacttcgccgaacttctcgtggtccatacggttgaagcggtcggtgagggattcggccggcgtggagtacacggaatagtggtagccttccgcgtcgctccattccttgcacagctcgttcatgcgcttgacgatggacagtgcgaattccttgccttgcggatcccagccgtgatcgcgcatccagttcttgccgtagaacacgctggtcgcctcatacaggccaatgtagcccaaggaaacggtggcacgttcgttgcggaacagctggtcgacgctgtcgttggcgccgagtcgaccgaaagctccgaaacggaacagggtcggcgcattgaccggcgcggcctgcttgcaacgcatgatacggaattgcaatgcctgatgagccacggccatacgctcgtcgaagatcttccagaagcgatccttgtcgccgtgggattccagtgcgatgcgcggaacgttcacggtgacgacgccaaggttcatgcgtccgtcttccacgtccttgccggtcgccggatcaatccaaccctgcaagaaggaacggcagcccatcggggctttgaaggagccggtgatcttcacgatgttctcgtagaagatcacgtccggatacatgcgcttggtggcgcattcgagggcgagctgcttcaaatcgtagttcggatcgcccggatcggcgttcacaccatgcttgatggtgaacacgagcttcgggaaaatggcggtgtgatgttcggaaccgaggccgcggatacggttcaggaagatggcacgctgaatctcgcgggcgaaccagtcagtgcccaaaccgaagccaacggtcacgaacggggtctggccattcgacacacgattggagttgatctggtattccatggtctgcatggcatcgtagatggccttgcgggtctggatcttcgcccacacctcacgcaactgctgcaaacggctggcatccttgttgaacggctcgtccatcggcagggccggacggtccttttcgaaatgcagacgcttcggttcgacatccttggccaagcgcacctgacgttcggcgatttcgatcggcaagtcgtcaggcatgatctcatgggcctgctcaaggaacttgtcgtaatccttgcgcgcgtattcgacgaagtgctcgtcggcacggttggcggtctggccaccatactggctggatgccacgtccttcatgatctgggtgatctgcgtggcggcgatggaaatgctgttcggcgatcccatcggcgcgttgccgagagtgaaaccgttggcgagcatatcccagtagttcggcagcgagcagttggattgtgcggtgaacggcgagtagtcggcgtcgtggaagtggatgtcacccttcatgtgggcgttggagaccgcgtccggcagcatggagaaggcggacgccttggacaccgcgcccgccagcagatcgcgctgggtggagtagacgttggaatccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcgtacaggtggtcttcgatcaggccgtgctcaacgagattctggatgtcttcgatcttggcgggaccgttgtaacgatccttgatttcggcttcgacctgattggcgatatcacggatcagctgttcctcctgcggcccgatcttcttatcaaggtcggcgaaggctgacttcaccgcgctgatgatgttgatcggatcgaagtcgaccacacgaccgtcgcgcttctcgacgagcaccttaccggttcccgttttaacggttgcggagatggcattcagagcctgcgtttccattcatcatcctttccgggtcggaccccatccgaccaggttttcatgcttcgttatgcatgccagattgttgctacgtccatgactgtacgccatagccagcactaaatgtagtagcggcacgccggcagtaaaactatatattccatttttcggcttgattccgccattccttaacttgtgtgacaaaggtaacgatttcgccacggagtgtcgcccgagtgtcgatttgacgcactcaccgaagagggactatacaaggcggggtaccctcacggaattcgaacatgtgtttcatttgtccgcaagatgatggaatcttgaactatgacttggaaccaggattacacacccccggcagcgcagccgaacagcaaaccgctgccacgactggccggcgaaaccactgctgacaacccctggccggtaagtctgctcagcgagaaattccatatggccgtcgaacggtggccatcggtttgggtggccgggcagatcacgcagatcaacaccagacgtcagggcagcgcctatatcactctgcgcgatgattatcaggacattgcgttggaagtcaacggtttcgggcagttcgccgcagccgccacgcctttcgtgcagggcgaccgcgtcatcatccatggcaaaccgaatctgtggatgaaacgcacgtcactgtctttacgtggcgacgccattatcgcggccggcgcaggaggcagcctgaaggccatgatcgacgaattacgcaagaaactgaaaggcgaaggcctgttcgacgctgaccgcaagcagcctctgcccgagtttccgcattgcattggtctgatttgcgcgccgcaggctcgcgccgaaggcgatgtcatcaccaacgtgagattgcgttggcctgttgtcgatttcaaagtgacgcatgtgcatgtgcagggtgagcagtgcccttccgacgtgatcaaggcgatcgcgcagatggatgccgatcctgatgtcgacgtgatcatcgtggcccgtggcggcggcgctttcgaagatctgatcgggttctccgacgaaggcgtggtacgtgccgcggcagccgcccatacgccgctgatttccgcgatcggccatgaggatgattggacgctgcttgatctggttgccgatctgcgcgcatccacgccaacggacgcggcgaagaaagtcgtgccggacgtgcgcgagcagatgcaactgatcaacgtgaacatcgaacgcatgcgcatacgcatcgacgccaccgtcaacaatgaaacaagactgattgaaggctatgcgaaccgtccaagcctcacacagccgctcaccatgctggaaccacatcagcgtctcatcgatgatgcaagaacccgcatgagaatcggcctgacacgtattcttgacgacgcaagcctcaccatcgaaaaagcgcacgcctcactgaccgcgcttagcccgcaatccacccttaaccgaggctatgcggtagtgcagggagcggacggccatgtaatcgacgatgcgaacgccgtgaacaccggcgaccaactcaccatgacattgaagcacggcgtgatcgtgtccgaagtcaccaccgtaacgaaggagtagcaatgaccaacgaaaccacccccgcatccagcctgaccgacaaggaacgcgaagccatcgcacaaatgccttacgaagaggctcgagatcagctcattcaggccgtgcaggcacttgaggccggcggactcaaccttgaccagtccatgcgccagtgggagcttggcgaagccctcgccaagcgcgctcaaagtctgctcggcgaagtgcgtgccaagcttgacgcagcacaggcggaacaggccactgcggccaataccgctggcacgcaagacaatctggcctgaaaatctcaaaaaccgccaatatatcgtttctacatgactgtgcgccacgtacttcatgcagcgtacagtcatgcataaatttcgaatttcttcatttcgataccacactcgtccggaatgtgtgtagaatgaagattcgttgcctcagtagctcagtggatagagcacttctctcctaaagaaggtgtcgtaggttcgattcctatctggggcactttttatgcggatacgcagccgatatgcagttgcgccgacactcttctcacacatcgaattgcacggttgccagcaacgccttgtgatcgcttccatcgattttcaacgatttggcccgacctgccaacatgccggaatccaatacgatatggtcaatgcccgcaaacgtcggtacataatcgatattcgcaggccacgtgaataccaatcccccggccgcttgtttggccgcatccgtgaaccgtgttcccaagaaattacggaacggcgtatggtcgtcggtcgcgttgaaatcgcccatgaacacgtacctacgagacgtatcgtaccggagtcgaccaagctcatccagtgaacgcttccactgctgccaatatccatcggtcggagacgtggtatgcaccgaaacgaaacggatctgcgtccgaccatcattgaatgcaaccgtggctcctggcatgaacgacgcgctcgaatcaacatcatcatcagccggatcaacaagcggactcgccgaccacaaaccattgccatacacgccgtctgagcttgccacctgcgcatacggcagcaaatcgccaataccagccttgttcaactcgtccacgaaagcatcggtcgtttcttgcaatgccagcacttccacacgctcgctacgcaccacatcgacaatttcctgcgcgtcggcacgacccttaaacacattgcatgtcatcaaacgagcataatcatcctgcgtattggcggacgctcccgaaaccgctgcgatcgcggcacgcggaagcttcgtctcattgtagaaaaacggatactgccaccatacttgcaacgcgatcgccgcaatcgccagcaataccgacattgttcgtttcgagacaatgccgcaaatcagcgcaatcaccgcaagaatcgcaaaccaaggcaccaacgaaacgataatgggaacatacggccacgcctgaatctcagcaggcagtatgtgcgaaacagtgcccagcaaagctgcaatcgacagaatgccagccagaaaaccgcatatgatattgcgcacgcgatgcgacttagttttcttcaacgtgcgaataggcttaacagccttcgcctgcgccgtacgcggtttcgtaggcgtaccagaccgtgccatacatcctccaacatgggcattgcgttccatcagtcaatacatcaatcatcaaatcagccatcaaaaccgagttcatgacgaacgccatcggcaatagtgcggcttcatagtaccccaacttccacattcgctggcaaatagtcgcaatcgtctccataaatttaacgaaaaacaatcgaaacacaaaaatcaccatcttgccccaaccattaaatactattacgctgggcacataagaaatcgtaactaatgggggtacgacgccttacgcaagagcaatggctgctcatgtataccgagagggggctataccatgctggaacttgatcacgtggggttttcgtatggaaaacgtctgattttagacaatgcgagcgcattattcgaagaaggttcgacaacggcaataatggggccttccggctcaggaaagaccactttgctgcgtttgatggacggttctttacaaccagacactggctccgtcaccattgatggcgcaaatgtcaattccattgatcgaaaaaatcttctcggatctttatgcatgcgcatatttcaggattacaggctcattccatatcttaacgtgcgagaaaacatcatgctggcgtttgaagcggcgcataagaacctcggacaaaccaagattaaggaaacttcccgcgctgaaaacaacacaatcgataacttgcttgaagaagtgcatttagcaggctatgcaaaccatttggctggccaattgtcaggaggagagcagcaacgtgtggccatcgcacgcgcgatcgccatgaaaccacgtgtgattctcgcggatgaacccaccggcgcgcttgatgaggaaaatacgcaggcaatcgcaacattgctttcagatattgcccacaaagagcgatccattgtcataatcgcaacgcatgacgctacggtcgcgcagcacagtgaccgcattgtgcgcattcaggaccacaagttggtggagcaatgaatggaatgccttaccacagcactggaatcacgaggcacgttacctctggatatttgagattccatccgatgctcaccatctcactctttgtggtggcattattgtcggcgatgctacccgtggtggccttaaacagcttgaatctatacgtacaggccgccaaagaaggcgcagcaggtcaatccggagggtacacgtaccaaatttcaggaggcagcaacgatgtagccgaagaactcaggcaacaggtccaaaacggtaaggccatcggcgtcaaatccacacaaggatcagtaggcctcacctccgccagcggctcttcacgaaacaccatcgcagacataactttcctaacaggcccctcacgatatggcacgctcatcgaagggcatcagccgtcgcaaaaaaacgaaatctccctgtctcgggccgcagctgaacaaattgacgcccagctgggagatatagtcaccgtgcaatgtgacgattccgcattatcaagcgactataagctcattggcatcaccgtcgatgctgcgaacaccaacaccgtgtatgcaacagcagtgtcttccaaagacaatctccaaaacatacaaatgtggctcaccgacgatgacgctactgtaaatcagggagaagtcgcaaaagagagcgcaaccaacaatgtcaatatcggatacatcaaatcgacaatacgaaatgccgaagaaacggttcgtactcgcgatctgccaggatgccaatggtacggaatagttctgttcctttgcttgctgtgcgtacatatcgcagcaatgacggcattcttccgagcaggtcagtgttccggagatgctgtggtagaagctctggtagcttgcggattctccctcaccaccagcagatggacagtgttccgaggattgcttatttgcacaatacccggagccgcaattggcatcgcggccggatatgcggtattcggtcttagttacaggaccataggcaacatattcgcccaatattgggaatggcaaccatcagcaacttccctgctgtccatcttttttgtcgcagcgattttgctgtgctcgctatgcttgacatggttggttttgttcttccgcatgtcctttaagcatgacatcacaaccagaaacgcattatggtacatcattctttcctcggccgttctgctgttttcttgtgtggcgatagaacgttatcatgcagccgcatggccgtttggtggatcagtgggctcggtcatgggggcttgcgctctgggacctatgctcctttcactgccttggcttttccgcacgccagcacaatgcaatgcgatagaacgtacacgaagtttgtctgccccagtatgcgcattggcactcttattgttaggtgccagctcattgttcagcgggcaaatgatgatagcgacaggcaattcggataatgggctgttcatcgccgattatttgactcaggatgacttaaactatcttgccggcaaatatcccgagactctagacaaagccatcgtgctcacggcaccggatgaatcccggtatctggtccgcgccgcgacttcccatgcttacgattgcgtcattcaacatggttccgacgatgcggattgctactcagattccgataatgaaaccactgtcatgcttgttgatagcaactcgtctttagccggtaaaaccaacgacgttcatattgccgaaggcggtaacgctggtatcattctcatcgataccgcaacccaaaaaataactcaggcagcacaagttcccaccgagggcaccgactcgctgctcaatgattacaccatgcccggcgtggttcttggaatcgactcaccgcaggcaaagacgcttggccttgcaccgagcaaccggcatactctcgttattactgatttcccgtcaatcgcttccggcgttcgcgattcgattcgatccgacatcattaaccgttgcgggtatgcattcattaccgaacacgacaccacctcttaccgctcctacatggcacgcgccattgccataccagctttggccacaattatcagcggcctgacattcgccgcattggccatatcaacacgtcaatcgcagtcagcgttacgctggacgcttcaagaattcggtgcatcacgattccagctcatgcgtttgttcagacctttaggaataaccatgtcgttgggatcgaccatagccgtattcttggggtggctgggctcgcatccttggattattgcgcccgcgaacgaattcggcaccacaggctggtggtggctcataccattacctgtcatttttattgaaacggcattgttctgttggtggttttcgctacctgagcgccgcaatcagtgaccactggattcgccttcgcacataatcgggtcataattggacttgggcgaatcacgtaacgaaaaatcccgaggagcgatgctcgactcgggattcaaaaaagtttaagtgcggcgacgtgctactctcccacaccctctcgagtgcagtaccatcgccgtgctaggccttagcttccgggttcggaatgggaccgggcgtctcacctaggctctgatcaccgcaagacgaaataatacgcacacatgcctcaatcaccaaatcacggcgtgtcgcagattgcaatcgtctatcacagccgcacggcatggcgaacagagcgcgcttgcgccgatacgccatcccacttgcgtcgcggatgtcggatcggtggtggcggcacgtgtgcagtcggcgccgttggccgcacaggaggtgaatttgggtgctccccgatcgtcgaccggatcgccacaaccggctttgaccaaagaggcgacttgcacactggaggtgacgggcttgacgaacgatccgccgataccggttcccgcgatggccgaaaaaatgcattcttttgctcaatacatggagacatcatccacgcgcagttttatagattcccgccagtcacataccgacgcgccgttatcaaaatttgcggctcttgcgactactgttgccccaataaccgatatgaaagcacgaaagaaggccagcaatgacgatcgcctcctgcggttccgtttccgcactcacattgggtctgccgaactcctctgcggttcccgcagaaaaggcaacgttgccgaaaggcctgttcatggcgagaataccggtttcagccaaaacaaaacaacgattggcgaacgacatcgagacgatcaccatgttgtctctgctgcggccaagcaatacacggcttgccgtcggaacacgcattccggaagtactggcaatcggattgcgcctgcatgccaagaacgccgccataccgacggatatcgtcgagctgattgccatgcaacgcaagtcgggaatcgtgttcgtatgcgtgcgcgacgccgacttcgaaggtacgaagcggcaggagtgcgcgttcgccgtgagacgcgcgctgccgggacgcgccggtcacacacctacattcaaagtgttcgtctcagattggaaaccggccggcgaagcgatgctggacatcggcgatcctgcggtcgattccatcgacgcgctgtgggagtcgttatgctcgcaggtgacgctcggcagcgcctctcccacggcactggacgcgcgcatgacacggcgtatgcaggccgcacagcttaccgagcagatcgataagctcacgcgcgatcaccaacgggcaaagaatcccgaacagcgcaacgaaatcttcaccaagctgcacaaggcgaagaaccagttggaggaactgaggaagctggaagcctaggaaccgctagaaaccaaggctcgtgcggccaaactggtcgagccagcgcagaatagccccttcccgcaacgcccatgggcagatttccacttccttgacgtcaagcgccttcatgatctcgtcgatcaccaagccgccaccgacgatctgatacgtgcgctccggcgtgacgcccggcaatgcggtacgctggtccggcgagatggccgcaagacggggaagccaatcctcaagctggtcaatcgtcatgatcgaagtgtccacgcggccgggctgacgcaccacggcaccggcgagacgagccagggaacgaatggtcttcgatgtgccgacggcatgcatcgggtgcttcgatttcgggaacgccttgaccatcggctcaagaatcttacggatgttcctgcgcgcgtcttccaaatccctatcattcgcaataccgttttccggtaggaattcacgggtcacacgaccggcacctgccggcacggacagcgctactgtgggatcctcatccgaacccatagccacctcgagagagccaccaccgatatcgatgaccagcagccgaccggcatcccaaccataccagcggcgagctgcaaggaaggtgagtctggcctcatccacaccggacagcaccgtgaccggctggccgacgacgttttcgattcgtttgaggatcctgctgccattcggagcctcacgcaatgcggatgtggccagcacgagcagttgggtaatctcatattctttgaccagccccatggccttttccacagctgcgaccacagcttcgactccggcctttttgattgtgccatcggccttgagatattgcatcaatcgaacagtgcttttcgtgctggcctcaggttccggacgggcgccaggcgccgcatcgacgatgagcatgtgaacggtattggagccaatgtcaagcacgccaagacgagtgacatgcgaatgtaaactaaccatgatttcaagcatagtgacatcgcactccccctttcacctgacattacattgacaacctttgcaaatattcgagtggccatcctattcacctaggatggccacgcaacattcacagcgccgacaacgattgcaaagcgctcacaaacatcatccgtgcagttcggctacgaaatctccgattcgcctcagaccctcacgaagcgcctcacgggaggccgcatacgaaagccgcacatgggtgtcggcagtggcctcgccgaaatcacggcccggcgtcaacgccacgtgcgcttcctttaacgcacgttcgcagaacgtccacgcgtcaagaccggtgccggaaatgttgaagtacgcatagaacgcgccattcggctcaacctccagcggcagaccgatctcagccaatccgtcgaccacaatgcgacgacgctccagcaactcctgacgacgttcctcgcacacggccaacgtttccggagtgaagcacgcgagcgccgcatgctgggtgggagtatgcgcgcacaggaagaagttggtggcgagatcgtccatggcttcgagcgcgcattcaggcacgaccatccaacccagtcgccagccggtcatgccgaagaacttggagaagctggagcatacgatggcgtccgggtcgcaggcgagcacggatttcacgtcggagccgtccggttcgcggtcggccaggtcaaggtaggtttcgtcgacgatacgccatgcgccgcgttctttcgccaggtcgcacacggatttcagggtgtcgaaggcgatggtggtaccggtcgggttcgacggcgaggtgatcatcaccgctttggtgcgatccgaccagtattcgtggcacagttccggtgtgagatggaatcgggtggtcgcattcgtcggcacgtccacgactttgccgccgaacgcgcgaaccagttcgcgattgcacgggtacgacgggtcggcgatcagcacctcgtcaccctcgttcaccgtcaatgcggcggcaagcagcagtgccgtggaacctccggccgtaatcgcgatacgtttcggatcgacgtccacatggtggcgttccttgtagaaatcggaaatcgcctgacgcaattccggcaaacccattgcggcggtatatggcaatggacggccatcatactgttcgcgcatcgcatcacgcactgcgagcggagcgccgaaatccggctcccccaagctcaacttgaccacatcggtgcctgcggcgatcatctcgtcggccatcgcaccaaacaccatggcacggaacggattagcaatctgggcgcggtgcgacatctgcggcagcgcgctgttctcagcatttcccatagttcgtttgtattcttcagacacgacaaatcacgctgaatcacaagcatcgtctcaccgacgttacataccgtttcgaaatcaagaaaaacaagaaattaatcgagcatacatcacgtatgttcggcaagaatcacgcaattgcaagtagatcgcataaatgtcgatcaagcaggttgcgtgccgacgatttcatgataaagccgttccagccgttcctcacgtacttttttggcgagctcgcattcccacaccacgatcactttccagcccatcgtttcaagttcggcatgctgcctgacatctcgttcgtggttgcgcagcagtttcgcactccagaattccacattcgatttcggcacgcgcgtggctttcgggcagttttcatgcatatgccagaagcagccattgacgaacaccatcgtgcggtatttcggcaacaccacgtcgggatgtcccggataccgcttgtcgtttttgcggaatcgcagacctttcgaaaaaagaaaactgcgtaccatcatttcaatggatgtgtctttgcctcggatatgcgacatgatgtagcttctcgtgccacgctcgtatttctctttttttgcggatttccgaggttttccggtcttcttaacgtgttcctgcgctgccacagcacaccattatggcaagatccggcaaaatacggcaaatcagaaaagcatccggacgaacgcgtgcaagtgcgatatggatcaacgcgcgttgcgatcatgcatggcgtacgctggaacttgcaacgcagcaatataaatgaatcaacactattcatgcagtttacgaaagatggggtttgatatggctcgtattcgtgtcgcgattctcggcgcaggccggatcgcgcaacatatggctgacacgctggtgaaaatggccgaagacgttcgttatgcggatttggtggaaccgtatgctgtcgccgcacgaaatgcggtgcgtgcggccgatttcgccgcgaaatacggttttccagtttcatacggttcatatgaggaacttgtggccgatccgaacgtggacttggtgtacatcgctacgccgcacaatctgcatgcggaacaggcgatattgtgcatgaaagccggcaagggtgtgctggtggagaaagcattcggcgcgaatgcggcacagacccgtgagatgttagccgttgcaaaagaaaccggcatgctatgcgcggaagcgatttggacgcgatacatgccgtcccgcgccattatcgataagattctcgcctccggtgcgattggtgaaatacaggcgatcgatgcgaacctgtgttaccccaccaccgcgaaggcgcgaatcactgatcccgcgcttgccggtggcgcattgttggatgttggcgtatatccgatcaatttcatcgacatgatcatgcataatgcgccgatcgctcgcattgaatcgtcgatgcgagcgtacgaaaccggcgtggatgcgcataattccatgacgttctattacgagaacggtgtgatggcgaccgcgcaaagttcgattctgtgccatagcgaccgcacgggatccgtgtggggaaccgatggttatatggtgtgccagaacattaataatgttgaggcgattgacgtgtatgacggcaatcatacggttgttgcacattacgatgttcccgcccagctcaccggctacgaatacgaggtggcggccgccgcacaggccgtaatcgacggtcgcaccgaatgcgaggaaatgccccacgcagacaccctgcgcatcatggaactcatggactccctgcgccgcgactggaacctcacctaccccttcgaacgttaagctccaatattagtttcagcgtcggcgaattgcgattccgttcacacagccgacgctgaagcattcattggcagcacatataatttctccttgcactggttgaggaggaacattatgggattgctgagcaagttcatgaacgcgcttattggagaaccgcccgtctccaaaacggcgactcagcccgggcccaagcttgcgcggcaaaacgttcccaatcccacgcaacagcagacgacgcaacgcaagtccactgtacaatcacgtcaaacgcaacagcttacgcaaccatcccaatcatcacagttggcgcgatcgtcataccgcgcgcaaacacaaaccacagctcgcaatacttctgtcacaacgaatcgttcgcgagcgcaatctcatgccaattcacaaccggctcagaaacttatgccgcaaccaatgctccctgccgagcagatcgaacgggcgcgaaatatcatcggcaaaatcgaaaagcatgagttaagcgacgagcagatcagcgccatcgccggagcgggtcacaatacgctagtgctcgcaggtgcgggaaccggcaaaaccactaccatcgtcggctatatcgcatggctgctgaacacaggaaccgccactcccgaagagattctggtgctatcgttcaccaaagcttccgccgacgaaatgtcgagccgcatcacgcaaagcaccggcaaagtcattcgcgcatgcaccttccatagcctcggactggaaatctgccgttcctccaccattgccaatcgtccaattattgacgggcacacgtcaaacaatgtggtgcgtaacgcatttgaatacctgcttgaacacaatgtttcctatcgtcttctggcatttaaacttatgtcgcaacagttgcttgataaatattccacagctgcacgacttgagaatttccagcttccaacagacgattatgcattcaatcaatatcgtcagaatcttatcgataccacacaaactattattcagcacatgcgatcaaacaatattgacattgctggaatgcaaacccttaacgaacgttatggcggtaaaaacatcggtcgcaatcgtgagatgctgcagctcatagaaccgctttatcatgcctatatacagaatttcaaaaccaataatggcattgattttccgggaatgatcgttgatgccatcagttgcgtcaataatggctcgtaccggcacccatataaatatgtgctgattgacgaatatcaggacatgtcacgaccgcgctatgaattaattcgtgcgcttcgcttacaacatgatttctcactattctgcgttggcgatgattggcagtcgatttatcgttttgcaggcagcgacattcatctcattctcgatttcgaccgaatttggcgcgcctggggtccgaccttcatgttccagatcaccaccacacggcgcttccgtcaaagccttattgacgcaagcggagcattcgtgatgcgcgataccaatctgtatgtcaaacatctcaataatcccagcgataagaaggattattcgttgaaagcacttggcggacatactgaggaagaacgattcaatgtgattgtcgagcagttgcgcaaactaccgaaaaccgcgtccgtactactgctgggccggtatcgcagcgatatcaatctcatgattcgttgcgatcaagaaggtctgttctccatcgaccaaagcactggaaatattcgttttctcgaaaaaccggatatggatattcgtttcatgaccgctcatgcgtccaaaggattgcaacgcgatttcgtatttctgctgtgctgttccggcggattgaaaggctttccaagcacgattcccgaagagccgctgcttggtctgctattgccggaagtggagcgatgcccgcatgcggaggaacggcgactgttttacgtggcgatgacccgatgcaagaagaaactgttcttcatcgtggatcagacccgtccgtcgcgattcatgtatgaactgcatagcaagatctgtccgaacattttccgaggagtcaagcttcctccgcaatgcccgaattgcggcgaagccctaagcttgcggcacaatcgcaacgatccgaaccgctcattctacgggtgcaccggcttcccaaactgccgctacacccaacaagcaaaataagcgtggcatacgtgatgtgaaagttttttcttccaaagatcatttccagctcttcgtcaatgtctgcatgccctatactgctattttgtttcaatcttttgggcctggcgcgatcgcccccgttgtatcctggatctgattttccgacaagagaggaagccgcgatgtcacgtaagatcatcaatgttgtgggcgcggccattatcaaagatggcgaagtattgtgcgcacgccgtggcgaaggcaagtcgctggctggatattgggagtttcccggaggcaaaatcgaacttcacgaaagcgcttcgttgcaccgatgatgagcttggattattttccggaacgagtaaaaagcatgatcgtaaatatgtgtttgccactgtgcaaaccatgtctcgtccggaaattcttgcacaattcagcaaagatgatttcgattatattttgatcgacgaagttcaccatgccgccgcggattcatataagagaattatcgattatttcactcctgatttcatgcttggcatgacggcaacgccggaacgtactgatggtgcgaatatttgtgacgtgctcccgccacctgaccgcttcgcggtctgagggggcttcctgctcaaggctcctagcggagtcagtgtctacaggctattcccgtgcgccccacggttctcgtaagttttttgttatcattcctgcacgagtcgtcgtgtttcgtgcatgatgttggtcgcggcgttcacgtccctgtcatgccagaccccgcaatcggggcatgtccattcgcggatatacaggttcttcgtatccttattgcggtagccgcaatcggagcatagttgactggacgggtagaacctgtctaccgtgaccagctgcttgccttgtcgttcgagcttgtatgcgagcatggtgcggaacatgccgtacccgttgtccatcgtgcttttgccgagtgcgagggattggctcatgtccttcatgtccaagtcctccacgccgacgcaatcatatcgggcggcgagccggttggccgtcttgtgcaggaagtcggctcgctggttcctgaccttggcggcgagcttggcgatgcgccgcttctgtttcacccaattaccggaccccttgaccatgtggctgagtctgcgttgctcgcgcatcagccgtggctccatctgccggtagaaacgcgggtagtcggcttgttcgccgtcgctggacacgtacaggccgtgggaggcgtaatccaatccgacgatatgcacgggtcggacgggttcgggtgcttgggtctcgtactcgaacagtatcgtcgccgtgtatccaccgctcttgagatgttccaccgtggcgcttttgagcttccagtcatcgggaatcgtcttgtgctggcgggcgcgcatcacgcccactttgggaagtttgaggtatctgcctccttcgatgagtcggatgttgtgtgtgatcgaataaaggtgttcactgtcggcacttgttcctgaacaccctgagcgttcaatttggacggtgtcgccatcgttcagcagccacacctgagtgccatggtacgggtttgcggtgccaattgccagaccggaatcggtgacggcgaacacgcgtagaccgtggttgttgttatctccgaaaccgttacggctgatggtctggaagttcgtgccatcggaggagacgatcaggtcaaagccacgagtcttatcgttggagtaatgcaggtagctgagcacgcccacgaagtcggtgaagttctccagagtctcttcggtaagccatttgtcgagctcgttggtgatggattccggcagatactgcttgttcttgttgtacaggtcgagcaggcgctgcagggatgcgaggaactggtaacgatcgtcgagcgtgtaggtttcggcagactgtggagcgacgccgtcaggggagaccacgtcggtctgcttggagctgaggtcagcgcccatatcctccagcagctgctgcatggtggccacgtcagcagccacttcgtcggtcttgccggcttcttcaactgcctgtgcggcttgatcgctttcggacgtttcgtcgccctcgttcagcggcatgatgtcgtcatcgtcgcccggcttggtggtttcctgagagtcggactcggtaggcttggtggcttcctgagaatccgtgtcggtagtaccggaagtgccgttctggtcattcttcttcagagagtcgaagaagatcttgatgtattcgatctgcttcttccactcttccggagttcgcttcagaatgtcgccgttggcgaactgggttgccgggtatgcaagatcactgatgtcgaaggtgccgacgtacagcttgccgctgtaggactgcatacgccacacatactggttcaggtgacggctctgctcgtcgctgtcgcccaagccggacagcatggtattgccatcgatggtgcctttggaatcgccgaagtacttgttgttggcttcgccggcgagcatttcgaagttttcgttgccgtcttcgtcaacgtccatacgccacaggttgaccgggctctccagatccttgtacagatcggagaaatccatttgcatggccttctccaaagcgttcatcggatcgttgtagccgccgatgtacaggtggcccttgtataccaccatgttggctgcgccggaacgactcgctccgaaaccccactcgtacttggcgccatctgccggatcgccgaccagcggcttgaaggtccacttgccggtgctctcatcctgcgtgccacggagcaaagcgaaggactgcttggtgtttttgcccttgccggtcaccacggtgacatacaagttgcccttgaatccgaccatatcccatacgcagccaccgaacacgttgtcggtcacagcacatgccggatagttgtacaagcccttatcctgagtggcgatggtggcgaaagaatcctgacctgcggacgggttagaggaagccacgatagcggcaccgttgtcggtgatcatgctggcgataagctgattgttgaccacggtcaaaccacggataccagcagtgtagcccttcttcagaccagtggtcatggcagcggaacgatacacgatttcagtggcatcaccactgttcggatcaacttccagtaggtacggctgaccctttgcggcggcagcaaagtacagtttgtcatggaattcaacggctgcacgatagccgttgaccgcatgctctccgccaatcgcattgacgatgatcttcacttcaccggtcttgacgttgatcttgagcagcaagctgtggttctcgccattgtcgaggaacagctcgccgttaaacgcaacatccaaagcggccttgatgctggcatacttggtgcccatggtgttagccatgtatttcagcgtggaacccattgcggaatagcaggtgcccacatacatccagtcgccgtagccggccgaagcccatgaatagttctgaccacgctcgggcaaaccctgcgtgagatcatcaatggattcaccgttcaaaacgtttacgataccgtcatcttcgcccagccctgcattggggtgcgaaatcttggtggccgtatagccggcaccaagtacggcggtatttgaggattcattagcattggcgctgcctactaccggcagcaacatggcgcaagtcgcaagcgttgcgattgcagcattaatcattttatggtggttgaccatattttccctaatctcgtataccccgaaaagatatcccatcgtatggcatatccaatgaaaaaataccaaaaaggggtgacctaaggtactatacggaaaacatcgggaacaaatctcgccaagtagtgctgcgctaactagtatttgcgtgactttgcggatgtgcgcatgcgaaatcaggctttagaagcgcgtgcgacaagccgcttctgcacgtaaagtccaatggacattgtgcaatggcggaatcagatcgttaaccgtcaacatgcataacgaaatcagcggcgtagccaatgaagcaatgtgaaaatgtttgacgagtgcgaaaaaacaggaatacgaaacccgcaaatcccagaatatcggacgcaaagatatcgtatccaaacgtgtcgagagtactggggtggccagtcaatgcaacgactacatcgggaatcccatcgcgcacgatattcaacagaagaaaagcgatgagcgtggtgcagcctcgttttacaatcttgcgagggttggcgtcggagaagaccagattcgacccgagactgatcatgaacacggatggtccaagaatgtacagatacagaaacactcgccccactagctgatttcatcttggaagaaagtaccgtcaagcacttcgtagagatgcgccgagggaagaccgagaggggcggaacgcgcaagatcgaagctgccgtagttattttgtctgctctctcatgattacgttatgctcactccagtgcccgaacattccctccatacccgaaagggaggaatacgcaatctgtcaagtggacttccgtcgacaacgaatgccagagaaagcccgtatcgcctaccttaatcagcaagcagaatcggcgtggttctaccttaaagccactggcgtcatgcttcgagtgtggtgtttgcgggctgtgttttctctgtgcatatgaaacgtgccaccaggcggtcggatgacgcttgcggagggatgtcttgtgcacaaaaatgtgtcgtacgagcgcttaagcttggttatcccgcttacgtatggtagattccgtgctttatcctgagacatctcgcttatatatggcaggtcaggttgtcatgacagctgttctcataccccctaagtacgcttttccgaggtgtatctgccatacataagcgagatagggataaaagggggtatcgatgtccgagagaacgcgtcttcattatccaacggtgtatgtggttcatacggaagataagaacaggtataaaagcgttcctgactatacggtatacgtgggggagacgaaggtcgccgcggcgcgcgaccacgtcgagaacggtctgaccaaggcggaggtcatggccatgcacgggatcgcgagcgtcacacccctggaacgctggtgccgcgagtaccgggccggaggtccggggaggcgctcgggccgaggcccaagggcaggcccagaggctcgaaatccaaaccgaagcccgaaccgacgctcgagcaggagctcgccgaacaggtcgcctatctgaaggcgaaggtcgcgtacctggaaaaactccgggccctgcgggcgtccaagtcacgcggcgcgagcgaagcgccgtccgagcgccgtggcgttgatcgacaaggtcttcaagcggatacttgagttggacggcaacccgcgcaacaggggcgactatggcggcaaggcgtatatccgccattgcatggaagaccacaacggccaggtcccgttgtgggtgctggccaaccatctttctttcggccagacggtatggttcttccaagtccagtccccggccgtccgattggcggtcgccgaaagtttcaccggtttgtatgcggacacgcacgacgggccgcggcgcatcaccatcaagcggttggacagcatcttcaacagactggtgttctaccgcaacctgtgcgcgcatgacgagcgctgctattgtgcccggtacgatgggcgcgctaacgagaacgtgtaccaggccatcggtgatcttggctatttgcttgacaaggacgattacttggaattgttcggtcgcttctccgcattggtcgcacgggcgacctccgccatgccgtcgcggagacaagcgatcctgtctgctatgggcgtgcgcgaacgggaactggccgacagggcggaaatcatactgcgcagctgaccgttcctgccattgggacggtggcgtcgcaggcggctttggactatgagccagctgatctgggctgtctgcaataggcctgtgggattcgggatggatttgggatgtcattggcggctgggacggttgtatgggccgcgtatcgttctgtctattgtccgccatggagacgtgctgccgggcgaatgcttctgggcaccacccaggcggaacatcatgaaaccacagggggtattgcacttttccgtgccggtcggcgaagacgctgagcgccggcagggtggtggaacgttcccggattattttcgggtgtctggaggtgcctcgtggaaaacgagggtgatagtcaggtttcccaaaaaatgaaaaccttggaacaaagccaaaaacgaccacacgcgattatcgtcagaggtgcgcatgatagctatagtcatgattttcatgcttatgcccctgtgaggcctgctcggtcgtgaggactattctcggagagacgtgatgtccggggtggttatttccagttaaacgtgtagctctggtccgattgttcctcgccgtgggtggtgacggtcgggatgttgccgtgccaggttacggtgaagttgtccgagtccaatgatttgccgtcgttgtgcaggtccgtcttgatttctgtgacgttctcggctccgatgacgttggaatcggtgtcccaggagactttgatcgtgatggtgcttgggccgaagaacatgggcgagcctagttcgccgatggccacttcgcaggtgccgtcagaggatgtcgtgttcacgatgctgtggggcatgtctatttgcgtccatatgagggtacagccgccggcccagaccagtgcgagtacaaggacgatatgctcgataatgcgcgccgctttatgctgttttggtaatgttcctgtcatcaatgcccctgcaatcgtgccgcgcctcttttgtctttgaagtagtttatcgatgttctggatggttcgaggttatacggtgttttgagattaccatacctgacatggcagtgggattgttccttcttgtctaggcgccactaaacaagatatcgccaaacggctcggaccgagcgagaccactgtgcgcccctgcatatccgagtttttcacggcgctcgggtacacgaaccgtggcgagctgaccatcaccgccattaaagccggatactgattggtttctgacttgaatttcggtgcatggtagagtgtccttgccgtgaatcccatcatctcccatcgagtcggggaaatgcggagcaaaaacaggttatatcatagattgagttgctgaactcaacaagtaagcgcaccacgtagcagtgttttcgcatacaagaatcggatccgaacacaattattcagacccgattcttgcatataggagcatgaaagcgtcggtttagcgctcgtgatggtcgatgtggtcggacgccacgtcgccgatggtctgcacgatctgtacgaggatgacgcacagaatcacggccacggtcatcacgtcgtactggtaacgctggtagccgtagcggatggcgatatcgcccaaaccgcctgcgccgacggtgccggccatggcggagaagccgaacagggtgatgaacgtcagtgctgcgccgcgcaccagcgacggcaggctttcgaacagcagcactttgaacacgatctgcagattgctggcaccgaagctttgcgcggcctccaccagacttccgtccacttcggcgagcgactgctccaccacgcgtgccacgaacggcgccgcggtgatgaccagcggcacgatggctcccggcacgccgagcgaagtgccgacaatcagtcgggtcaacgggatgatggccaccagaagaatgatgaatggtacggaacgcacgatgttcacgatccagccgagcacggtgttgagtgtcgcattcgggcggatgcccttctttgctgaggtgatgagcagtacgcccacaggtaggccgatcacatacgcgagtagcgtcgctaccgcggtcatgatgatcgtgtcacgtactccctcgaccagcagttcgccataatcggcgatgaattgcgagataatctgtcccatttcacttcacctcttccttggtcggcgagtccgtctgctcatcggacgaagcggaatcatgcttatggcgatggttctccactttcgcatcggtgatcagtgttttcagaatgtcgctttgcggattggagaacaattcctccgtatcgcccatctccacgatgcgtccgccatcaatcatggccacacggtcgcagatgttgcgtgccacggacaacgaatgcgtgatgatgaccagcgtcacgttgagctcgcggttgatgcggcgcagcaggtcaaggatctgcgcagtcgtggtggagtcgagtgcgctggtggcctcgtcgcacagcatgatggacggattgttggccaacgcgcgtgcgatggccacgcgctgctgctggccgccggacagctggctcggatagcggtcggccagatcggccaatccaaccaggtcaagcagatagcgggcacgctcctcgcgcttgtttttcggcgtatggttgagctccagtgggaacgtgacgttgcgcagcactgtgcgctgctggaacaggctgaaattctggaagatcatgccgattccggcacgcacgtccgccagctccttgcctttcgcgtcggtgatgtcctcaccatcgacgcgcactttgccggaagtgggacgttccagcagattgatgcagcgcaccaacgtggacttgcccgcgccggaggagccgaggatgccgaagacttcacccgaatcgatggtcaggttgatgtcgtgcagcacctcatgcgcttcggcgccactgccatagcttttgtgcagatggtcgatctgaatcgtcataatgtcctgttcctattgatgttccataacaagaatgccgcagggtagtatacctgcggcattgaattcttgcagccgaagcgggtcttagaagaccggcaccacagcgcccttgtagttcttgttgatgtagtcgcgcacctcgtcggacttcaaagccttcttgagctccttggtcttggcggtgttctcgttgccttccttcaccacgaggatgttctggtaggttttcgcggccaggccgtcggccttttcggtgaccagtgtgtccttggtcgggtcgaagccggcttgaatggcgtagtttccgttcagtgccgcgatgtcgacatccttgatgacggtcggaaccacggcggcctcaagctccttgaacttcaggttctttggattggaggtgacgtccttcggagtggcgttgatgtccttcggattcttcagcttgatcagaccggcatcctgcagcagcagaagcgcacgggcctcgttggtggcgtcgttcggcacggccacggtggcgccatcctgcagattctgcaaatccttggtcttgccagggtataggccgaatggctcgaagtggataccctccacggacaccagatgcgtgcccttctccttgttgaagttgtcgaggtacggcttgtgctggaagtagttggcgtccacttcaccatcctcggtggcggtgttcggctgaacgtaatcggtgaactccttgacttcgagcttataaccatctttctcgacgagcgacttgacggccttgtttaggatttccgcgtgcggggtcggggaggccgccacggtgatggtcttgtcatcctccttggaggcggagccgttggagccagagtcgccgcagccggccagaccgaaggtcgcgagcgtggtgacggcgagcagcgcgccgagaagcttcttgttacgcatggttgagttcctctctcaattcgttatacgggccgcccgtttgccacgcggcggacccaacgattgaccaatatagaggaaccatcgacggcaacacggcgttcacttattgaaaatacttataaagggcatgaaaaacgcagaaattcgcgaaaaccgtcttataaaatcgcaagaaaactcttaaaaaccttttctacagaatttcaaaatgatgcaatgcattcgagattccggcatcgtcgacactgtcggtgacgtaatcggctacggtcttcggttcgtcagtggcgttgcccatagccacgcctatgccggcgaaacgtagcatatccacgtcgttgccgccatcgccgaacgcgatcgcattgtccctcgaccaaccaaaatgctcaagcacgacctgcatgccgaccgccttgccgccatccgcaggaatcaggtcggtgaagtcgggatgccacctcacaccgcgcacgttgccgcacatgccggcgatttccgcttccgttgccttatccacatatgggctgatctggaatgtgcgatggtttcctatacgttgctgcggattgcatatgtcgattttcggcgcggttttgccaaggctgttccacgtacgttccaaagcggcgttgatgcgattgaaatacccgtagttgctttccgcgtaattggcgacgacatcggtatgcgattgcagccagtcggtgatgatctccacatcgtgcaggtcgattggatgacggtaatcgaggccgtcgcgtgttgtgcagaactggccgttaaggccaacaatgccatcaaattcgacgggaatggtgtcaagcaccacacccatataggagggtgcgcgccccgaacagatgaacaccttcacgtcttttttctgcaacgcatgcaatgcgtcgatggtggatcgcggcaccacatgcgtgacgaaactcgtcaaagtgccgtcgatatcgaaaaacgcagccttgatgtccgatgacatgccgatctccccgtgaatccgttcaaaacgtcatccagcttacggggaaaaactgcggaaaacgccattgtcggcacgaaaaacgaacacgaaaataggaaaaacgtccggttgcgcctacaatcgtcaaccatgagcgaacatattgagatcacgccggagatcatcgagatccgtcattatctgcacgcacatcccgagcgcagtttcaaggaatacgagacaagtgcctatatcgagaaactgctacgcgcgcacgacatcgaagtgctcaacaacccgcttgaaaccggcgtggtcggcctgatccgcggcgagcaaccaggcccgcgcatcgcattgcgcgccgatatcgacggtctgcccatccaagaggatactggcctgccgttctcgtccgtcaacgacggtgtgatgcacggttgcggccacgacctgcacatgtcttacatgctcggagccgcattctggctcgcaaaacgccgcaagcgcatcaaaggctccattaaactgctgttccagcctgccgaggagctcggtctcggcgcgaaagctatggtcgatgcggggttgctcgccgacgtatccgccgccatcggcgcccacaacaatccgaattacgcgcccggacagatcgccgtaggccccgacccgatgatggccggctgcgtgaaattccacgttactctgcatgccgccggctcacatgccggatatccacacaagggcactggtcctatcgaggcgctcgccacaatgattctcgccttgcagaccatcgtcagccgcaatgtctcaccattccatccgctcgtgctgtccatcaccgaactgcacggcggccacgtgtggaatgtcgtgccggacaaggccagcttccaaggaaccgtacgctacttccataagtccgacggcgaactggtcgagaaacgcttcaagcagcaggtccaatccatcgccgcgggctacggcattaccacagacatcgactgggatgactttcagaatccgctcgtctccgacatggaactatccaaaatcgtcgctgacaacgtgcgcgactatgcgcagctcgagccaatccatccttcgatggcgggggaggatttctgcgatttcatgcccgtcaccatgccggtgttcgccttcatcggttccaatggcgagaaaggctgccccgattggcatagcccgcatttcgtcggtctggatgaatcactgcaggccggcgtggaattctacgccaacgcggcgctgacggtgctcaacgaactttcgtgacacgcgtgcggtccgctttcaattcgcgatcgtaagaaaataaaacgttcaacaaatcaacggtaggttaggcagctatgacagacattcgcttcgcactcgctcaaatcgacacctgcgtcggagaccttgattccaacgccggtaagatcatgcgatacgtccgccgcgccgcgcaacagggcgcgcaagtcgtcgtattcccggaaatgacattgaccggatatcccatcgaagacctcgccctgcgggccaccttccgcaaagccgcgtggaacaaagccaactggctcgccaccgaactggctgccgatgggcttggcgacctgtttgtggtggttggcacggtcggcactgatcgcgagacatccaagccacgcaaccgactcgtcgtattgcatgacggcgtggtttgggccggctatgacaagcacttcctgcccaattatggcgtgtttgacgaattccgcattttcagtcctggcaataagtccatggtgcttgatgtgaatggcgcacgtattggtgtggctatttgcgaggatatctggcaggatggcggtcctgtggcagaacttgccgagcagcatattgatttgctgcttaccatgaacggttctccgtatgaggagggtaagactgatactcgactcgatcttgcggtacgccgtgcggctgaagtgaacgcgccgatggtctacctcaatcaggtgggtggtcaggatgatctggtgtttgatggcggcagttttgtggttgacgctgacggtacactgctggaacgttctccgatgttcatggaggatttgagcttctttgatttggatactgcctccgaacatcagcaggttggtgttatcgcggccaagcctgatccggatgaggaagtgtataccgcttgtgtgctcggcttgaaggattatatggccaagaaccatttcaagggcgtgtgccttggcctttccggcggcatcgactccgcattggtggcggccatggccgcggacgccgtgggaggagctaacgtgtatggcatttccatgccgagcatgtactcgtctgacggttcgaaagatgatgccgccgatctggcgaagaatattggagcgcactacgacattcagcccatcgaaccgctgttcgtctccttccagaagcagctcgatcttgaaggtgtggccgctgagaacctgcaggcgcgtattcgcggtgtgattgtcatggcatattcgaattccaaggggcttctggctgtcgccacgggcaacaagtcggagcttgcctgcggttattccacgatttacggcgatgcggtcggcggatacgctccgatcaaggatctgctcaagacccgtgtgtgggagatctcccgctggcgcaacaaggctgccgccgaaggcatgggcattggcggactgcatatcgtgggcaacgagcaggggtctgcggggacgccgttgccggacggcgtgatgattcccgtcaattcgattgaaaaggctccatccgccgaacttcgcccggggcagaaagactccgattcgctgccggaatatgagctgctcgatcaggtgttggcaatgtacattgaacatgcgcatggtcgtgaggatcttctggcagacggtttcgatgagaccaccgtcgacacggttatgcgactggtcgatcgtgccgaatggaagcgccgtcaatacccgcttgggccaaaggtgacggcattggcgttcggccgtgaccgccgcttgccgattaccaacgcgttccgcgaatagaacagcggcggactattgtttcgttacgcgcttcgtaaggagtgatatggaaaagcaatggtatttcaatacggttaccgaacagcctgaactgggcatgatctcaccggcgagccatcgtatgggaccatacaaaaccagggaagacgcgctcgatgcatggaagatcgtgcaggaacgcaacatcaaatgggaagaacaggatcgcgaatggaaacgctggtcttccgatgaaaagtagttgatgcgatataagaaatcgcggtgtctggattacggcaccgcgattttttcttatacttcgcaagtgtgacatatgtcacttttatttcctctcaaactcaggttctttacaggttcgtgcagctagaatcggtaactagcgacgacgtaacgatgcgtcgccaaaccaacacccagaaggagtggaaatggcagcagttgatgcgacggcagtctccccggaagagcttcaggctaaggcttgggaaggcttcgctgagggcaactggcagaaggacattgatgtccgtgactttattcagaagaactacacgccttatgagggcgacgagtccttcctggctgacgccactgagaagaccaagcacctgtggcagtacctcgatgacaactatctggcagtagagcgcaagcagcgcgtctacgacgtcgacacccacacaccggctggcatcgacgcattcggcgccggctacatcgactctccggaagtcgacaatgtggttgtcggtctgcagaccgacgttccttgcaagcgcgccatgatgccgaacggcggttggcgtatggtcgagcaggccatcaaggaagccggcaaggagccggatccggaaatcaagaagattttcaccaagtaccgcaagacccacaatgacggtgtcttcggcgtgtacaccaagcagatcaaggttgcccgccacaacaagatcctcaccggcctgccggatgcctacggccgtggccgcatcatcggcgattaccgtcgtgtggcactgtatggtgtgaacaccctgatcaagttcaagcagcgtgacaaggactccgtgccgtaccgcaacgacttcaccgagccggagatcgagcactggatccgcttccgcgaggagcatgacgagcagatcaaggccctgaagcagctgatcaacctcggcaacgaatatggtcttgacctgtcccgtccggcacagaccgctcaggaagcagtgcagtggacctacatgggctacctcgcttccgtcaagagccaggatggcgcagcaatgtcgttcggccgcgtctccaccttcttcgacgtgtacttcgagcgtgacctgaagtccggtaagatcaccgagaccgacgcacaggagatcatcgacaacttggtcatgaagttgcgtatcgtgcgcttcctgcgtaccaaggattacgacgcgatcttctccggcgatccgtactgggcgacttggtccgacgcaggcttcggcgatgatggccgtacgctggtcaccaagacctccttccgtctgctcgacaccctgaccctcgagcaccttggacctggcccggagccgaacatcaccatcttctgggatccgaagctgccggaagcctacaagcgcttctgcgccaagatctccatcgacacctcggcaatccagtacgagtccgacaaggaaatccgctcccactggggcgatgacgccgccatcgcatgctgcgtctccccgatgcgcgtgggcaagcagatgcagttcttcgcagctcgtgtgaactccgccaaggctctgctgtacgccatcaacggcggccgcgacgaaatgaccggcatgcaggtcatcgacaagggcgttatcgagccgattcagccggaagccgacggctccttggattacgagaaggtcaaggccaactacgagaaggctctcgaatggctgtccgagacctacgtgatggctctgaacatcatccattacatgcacgataagtatgcatacgagtccatcgagatggctctgcacgacaaggaagtgtaccgtaccctcggttgcggtatgtccggcctgtccatcgcagccgactccctgtccgcatgcaagtacgccaaggtctacccgatctacaacaaggacgccaagaccactccgggccatgaggacgagtacgtcgaaggcgccgatgacgatctgatcgtcggctaccgcaccgagggtgagttcccgctgtacggcaacgatgatgatcgcgccgacgagatcgccaagtgggttgtctccaccgtcatgggccaggtcaagcgcctgccggtgtaccgcggagcggtcccgacccagtccatcctgaccatcacctccaacgtggaatacggcaaggccaccggcgccttcccgtccggccacaagaagggcaccccgtatgctccgggcgcaaacccggagaacggcatggactcccatggcatgctgccttccatgttctccgtcggcaagatcgactacaacgacgctcttgacggcatctcgctgaccaacaccatcacccctgatggcttgggccgcgacgaggatgagcgcatcggcaacctcgtgggcattctggacgccggcaacggccacggtctgtaccacgccaacatcaacgtgctgcgcaaggaacagctcgaggatgccgtcgagcatccggaaaagtacccgcacctgaccgtgcgcgtctccggctacgcggtgaacttcgtcaagctcaccaaggagcagcagctcgacgtgatctcccgtacgttccaccagggcgccgtcgtcgactgagactgaacggtaccgtgtgaagcggtagagtgcaaggggcggagcgtgaaagcttcgccccttggttttccctgtacaatgtgggaaaaccattggagagatacaacgaaaggacaccgatgtctgagaacgtacattttcgctccacaacaaggcatatgctcagagaatcgcaaaactacgtcaaccaaacgcttatgggagggttgtcaggcttcgaatcgccgatcggactggaccggcgtgaccgcatcaacgcgctgaaaagcggtgatatcggcttcgtgcattcctgggacatcaacacgtccgtcgacggtccgggaacacgcatgaccgtcttcatgagcggttgcccattgcgttgccagtattgccagaatccggatacgtggaaaatgcgtgacggcaagcccgtctattacgaggccatggtcaaaaagatcgaacgctatgtggatcttttcaaggcgacgcatggcggtatcaccttctcgggcggcgaatccatgatgcaaccggcgtttgtttcccgcgtgtttcgtgcggccaaggagatgggtgtgcacacctgcctcgatacttccggattccttggcgcaagctataccgacgacatgctggacgacatcgacttgtgcctgctcgacgttaaatccggcgatgagaaaacctacaagaaggtgactggcggcattctgcaaccgaccatcgatttcggacagcgtctggccaaggccggcaagaagatctgggtgcgtttcgtgcttgtgcccggactcacctcatccgaggaaaacgttgagaatgtggcgaagatctgcgagtcgttcggcgacgcagtggaacatatcgatgtgcttggattccaccagcttggccgtccaaaatggcacatgctcaacattccctacccgttggaagaccagaaagggccgtccgaggcaatgaaacagcgtgtggtggaacaattccaatcgcacggcttcaccgtctactaaacaggagaccacgcacatcccgtgacggcgatgcttaggcaaatcaaccatatgaaagcacctcagcgatcgaagaacaggggattcttgcgcagtttatgaaaccagcattcgccacgcggaaaaatcttcacattcgacgcgtggcgaaatgctgtgaaataccgcaaaaccggcgactctgccgtagccttgaatcatggtggacatctatgcttttcctcaaggcacgcccaacgaagcgcgtgccacaggtaggggatcgtgcgcctacgccgaccctcctgaacaaatgttgacccgaccttccggtgtgccagacaaggtatgggacgccgtgctttccgtagaacgcatgcctcgattaccaagcgtgtcgtatcgtgagattccagtgccgtgcgccatggcgagtttcggcattggagttgagatgcaatgcgacgaggcgcgttccacaggctggatcatgatgttgtattcgcacaaataccgaaatgactggcattctcattggcgttgcgtcgctttcgccgcgttgccgttgtctggaggcgaaggcgattgtctgataccgtccatgtattgggatgcgatgatggaccgtgttggttcgtgcgatgccgaacatgtttcgggaaccgtcacagtcacgaaaagcacgacgtttggcactcagtccgacgctcccgaaaccgggtgtgagattcgtgtgtcttggacgccactagactatgccgatggaggccttgacgcgggcgcccaagtgggcgcgtgggctaggttcctccggtccatgacgcaatccgaggaggattatcccgttgactgacgagccaaggttgcaggccgagccgcgtgagggcgtgcccgatgtgatcgacaccctaccggcattccgcgagtactgcagcgcattggcgtcttcgcatgggtctttggctgcggatgcggaacgtgcgtctggcttccgatacggtcatgacgattggttggtgcaattcaaaagagacggtgccggcataggattgcttgatccgcaggcattggctgcggaaggtgccgattggaacgatttcaatcgtgcggtgggcgatgcggtatggattctgcatgattcgttgcaggatctgccgggattcgttgatttgggattgcagccgaaacgtttgtttgatacggaaatcgctgcacggctgctggggctcaaacgtttcggattagctgccgttaccgagcattatctgggactgacgcttgcgaaagagcattccgcggccgactggtcgtacaggccgctgccccgagactggcgtaattatgcggcgctggacgttgaattgctgatcgagcttgaaacgaccatgcgcgccgaactgcaaaagcaaggtaagatcgaatgggctgaggaggaattcgattacgcgctgcgcgaaggaactgcgccacgtaaggagcatcccatcccatggctgcgcatctcgcatatcaccgaaatcatgagggaccgccaggccctggccgtggcgaaagcattatggaccaaacgagatgaactggcacgcgaatacgatatttcgccgacactgctgctcgccgacagcaccatcatcgaagtggcggaacgcaagccgcataacgccgcgcaattcagggcggtccgttccatcaacgagcgtgtacgcatccaagccggtgccgaacaggagaaaatgttcgaacgttacgcgccgatccaacgtaaaatcaagccaagcatgtggaagagaataatccaacaggcgcttgatctgccggaaagcgaatggccggtcatcgaaagcggcaatccccaaaaccaggaggcgcagagcatatccgctccacgagcgacgcgagtctggagggaacgttatccggaacgtctcgcaacgcttgacaaggcacgcaagatggtggcgcagatagcggaagacacgcgtacccccgcggacgtcatcatcaaaccgcagtatctgcgcaacctgtgttggaccgacgaaccgcaaaaacgtgacgttgcgcaattcctcaccgagcagggcgcgagggcgtggcaggtcgcgctggttgcagagtccgtgagtcgcgctatcatgtagaggttgcctaacggcagaaatgtgaagaaccgtatttttcaggagcgcaagcgtgaaaatcagcgtcaggaatcttgagccgaccaaggtgaagctcaccgtcaccgttgatccggaagagttcaacccgtatctcgacaatgctcgcaaggaaatcgccaagcaggtcaacgtgcctggcttccgcaagggccacgtgcccggcaagatcatcgaccagcgcatcggcttcggtgccgttgctggcgaagccgtgaacaacggtgtgccggagctgtactccaaggctctcgaagaaaagggcatccgtccgatggcccagccggaaatcgacgttcaggaagttccggaatccgccaaggacgagaccaagctgaagtttgtggccaccgttgagcgtcgcccggacatcgaactgccggaaatcgacggcatggagatcgaggtcgccaaggccgaaatcaccgacgaagacatcaacaaccgtctggaagccctgcgccagcgtttcggcaccctcgtgggtgtggatcgcccggccgccaagggtgactatgccaacatcgacctgaccgccgaaatcgacggcgaagtggtcgactcccaggaaggcgtgagctacgagctcggctccgaaaccatgcttgacggtctggatgaggctctcgaaggcctgtccgccggtgaagagaccaccttcgaaggtaccttggaagcaggcgagcacgaaggcgagaaggctcaggtcaaggtcaaggtcaactccgtcaaggctgaagagctgccggaactcgacgacgacttcgcttctgaagcctctgagttcgacaccctcgacgagctgaaggaagacctcaagaaggccgcttcccaggatgccgaaggtcgtcaggccaccgcagctcgtgacgctttcatcgccaagctcgaagagggcctggagattccggtgccgaagggcgtcaaggctgaaatggttgagcagcagctcaagggcgtgaccgctgatccggccaatgccaccaaggagcagaaggccgaagctgaagaaaccgtcgaaaaggaactgcgcgaccagatggtgctcgacgtgctcgccgagaagctggacgtcaaggtctcccagtccgacgtgttcaacttcctcgcttccatcgcccagcagtacggcatggatccgaacgccttcatccaggccatcatgcgcaacggccagctcggctccgcagtgcaggaagtcggccgttccaagggcctgctcgccggcatgcgcgccgtgaccttcaagtccgagggcgaaaccctggacctgagcgccttcctcggcgaagccgctgaagatgaagaagccgagagcgttgaagctgcttccgcagccgccgcggtggctgacgaactcgcttccgaagagtgagcttctcttaatgcctgactcgtaagagtcatctttctagggcgctgaggggtggaatccagtgtggatcccacccctcaatttatttcgtattcggatctttaaccagagcaaagagattgctgaaacgtgagctacagcaggaatttgatttcggcgaaaaactcacgaaccatattgttgacgagcatatccgggggagagccggccgcaatgccttgggcgttgtctaagccatatttgtcggcaatctgcaacgcgcgaaacatgtggaaattattggtgatcacgcctatggaagcattatcgtcgttgatcatcttcttgctgttgacgatgttttcctcagtggtttttgaatccggctcctcaagaatgcgctgttcggcaataccatgttccttaagatagtcagccatgccttgggcttcggggaacggttcattcggtccttttccgccggaaacgatgcagatggtattcggattctcatccaaatactcaatagccttgtcgagacggtaacgaagcacaaggcttggcccggacttgcgcacctgagctccaagcaccaccacataatcgagatttggttcaccttgcgcatgcattttgctgacaatgcaaccttccaccgtgccgaatgcgaccagaccgacgcatgcgactgcgattgccacacctctgaccagtcttggcagcatcgcccaccattggaagagcactccgaatccaagcacggcgaacagcgccgcgaatgctagccagacaatccagaatactgtgccggaatgcgtgttacgcactgcgaaagagtaacaaacacataccgcggcgagcactatgcatagcgcgcccgcaattcgtctaaccaacgttgccatatgaacctctcattcattgcgcgtcacacgcaatcctgtctcatcctaagcgcgtgaccccagacccccaagcgtcacacgccaatgccaacaaatcctacgcattcctgttatttcaataccatgcgcattatgtcatccgtgagcggagttttggtatggctgcggctaggatgggggagcatgacttcagaaatgattatgctccgaccgatgcgtcgcacggattttcccgcgcttgaagagcttgtccgtcaggcttggtatgtggatgatgagtcggatgataatgggaacgttccgaacgatgagcgcgggttacgtaagtataagctgcgcaaggcgattcacttgcgtaatatgcatcgactcgcggccatcgacatgcatgattttctttcccgcaccaccgaggctacggtcgctgaacgtgatggtcgggtgcttggcgtggtattgggctcgttgagatcccgtgttaccacagcgcagaggatacgtcatgctattacgcgaaattgcttggcgttgcccttgttggcaagtaaggatggccgtcgaggacttgccgatcagattgcgattttgcaggtcgatgaagtgttgaaacgagatgccggcaaaagctatcaggctgagataacgttgtttgtggtttccccggaagcgcggggcatgggcgtcggacgtaagctgttcaaccacatgcttggcgtgtttcgtaatgccggaatgaacgagtatttcctcttcactgacactacctgcgattacggtttttatgattaccgtggtttgacgcgcaaagcggaacgtaccatacgcagggattcctttactcaaggtggtttggaagacggttcgctttccttcttcctgtacgaggggcgctgctgaacgtttctgcccatcactgtgaaaggcgagtgattgaatcactgagttcatcggctatccgatttggtggggcggagccgcatggccggccaatcactttgtgaccgaccatgacttcatcggcaagaaagtcattctattcgccgcttcttcgtcatcaccgctgggcagcagcggttctgacttgacgaccatggtcggcaccggtgattggcaggaaggacaacggctctcgtccaacgcctcggccggtgaagtctcctcttgggtggagagcctcgacctctaactcagcatatatggcagatactgccccgcggagtcaagagaatctagtttcgagtggtttccttgagtgtgggagccaaagtgccggccaaggccttctctcctgggcgggaaagcggaccgactagctcatgcgcggtatacggctcttcgagatagtcggtgtctagacgcttgagcgtgccgccgatctcgtagtcgatggtccactgatggaagtccggtgaggttttgccgaagctcatgccgccaaggcatactttggatactttgatgccggaccagcctagcggcgcgtacttcatgtcggtcatgatcagatggagctcctttgtcggttggatgtgtgaaatgttgctttctatagcaccgctcggtccgcgaatgaacctaatgcgtacctcttgcctctattatacgtatatgcgtttgctgtatggaaaagcatgttcgtcactcgttatacattgacatggcattttcgtcgaggttcaatgaacgcgtattacaacgaaaggaccattatggaaaatccaagcgcattccccataggagagccgaacgacggctttgcccagtatttcgtaggtcaaagctatctcgcgtcggtgctcgactctcctgaattttccatccacaacgtcaccttcgagccgggatgccgcaacaactggcatatacatcacggcggagcccaggtgctcatcgcagtgggtggtcgaggctactaccagatcgaaggccaggaacccaaggaactcaaagctggcgaagccgtgtgcattcctgcagacaccaagcactggcatggtgcggctcctggcgaatccttctcccacctggcgttcatggttccggcaggagcccctggcgcgatgagcaacgaatggcttgaaccggtcgatgcgcaagcgtacgagtcccttgcctgaacagacgggcgcatacatgtgattcagccggggtcaagtcagactcggctgaatctattcgccactcatatgtgaaaggcttatctcatgtctgtcctaaggtgggatgggcgggaatcgagaataatcgcaaacttatcgtcaattgcctgccgttgacatcatccgaacaagcgcagttcatgcgtgcagccaaaagcgtgccgcaagaattcgtaggcgatccggcgcagcgtggcaacatggcatggacggccatcatccccgaagagctcaaagctcaagtcaccgccatcattggcaatgttgatccgggaatatgccgacagtgtcccaaactcgaatggttgcaaacctggagtgccgtcgtcgacaaataccagcgacccggcatcctacagcccggatccatgcccagggtggaattcactttgattggtcggcgcaccgggatgcaagccaggcgaggatttgctgttcactgacgggcttgaaatcccatgcgtcgagtcccacgttcacacttcgcggatcggtgccgtcgggaacgtcctgatgcgtatggccgtagagcagccagccttcggtggtgggcgccatatcggcgaactcgttccagttgctcggccagtcgccgtgttcttcggccaatgccgagagtctggggaagtggctcatggcgatgctttgctgcgtggtcgccaccgttattttgccggattcatcgagaacgggaagttccatgtcgatttcgcggtagtcgtcgatggtctcgaacacgtcttcgtatagcatgtcattgaatcggaggcggaagttgcggtcgtggttgccgatgatcaggtgcagatgttggcagttgattcggcgcaggcattcgagtgtgtgctcgacggtgcaacggtaggagaggtcgccgagaatccacagttcgtcgtcgtgcccgacggtctcgttgatgttgccgatgatggtgttctcgtggcgtgtgatgtcgcagatcgttttgaacgatgtctgattgtcgcgcacatattgtttgatccacgtgtgtgcggcggcacgcccctgcgcctgccagacatcacggtattcggtgcggagcctgccattgttcaggaatccgcgcagtgcggtgaccagagggtggccgaaatgcgtgtccgaagtgaaatagcgcatgtggttccttacggtatgcgattgctggatgcctttatcaatgatagagcgcaacattacgagaaaagccttccccaaaatgcttgttggcttgtttgtggcactgtttggcgattatggcgagtgtgagcgttggaattccaacgctcatacttcgggtttcggcgttcggatgccacaaataagacaagtagcgaaaatcaagtagtgaagacgggctgggccggcttgatttattcggtagatatcagtgaataattacacgacgcggcaagatcgatttaccaggaagcgcaatagtccgagcggtttcccgcccatcagtttggatgaggagagtacggcccgcgatcatgcggcgcatgtggggctgtgaggggctgaagcattgcggggcatgcatactgatggaggctaatcagaggaattccgtgaaaaaacaaaaaactgatgtttccgcagctgatacaccgcgtatgttttgtcgtatcctttaacgaatatctggggggcgccaatcaggtgcatgttcatcagatgggttcgaaagtgagcgagaagcctcggtctttgccaatggcttgcgatgaggattattacggataaagttcgtccctgtttgacgctctagacggtaattagcttgtaagctaatatatcggtatgggaacaatacatgagcttaacgaaaagcgcaagcgattaggtttctcacagaaaagcgtggcggaatccatgggcgtgaccgctcctgtgctgtctcgcgcgcggtgaggggaaatccgacacaggcttttacccggcgttatcaggatgcgcttgacgcgatttcgcgggacaccacgcctcagcagatagcggagattgctcgtcctatcgcgctgcggcatcatgtcaatgaactgtacctgttcggttccatggctcgaggggagggacatgcggattcggatatcgatttcatctatcagtttgacggcaccgccaatccaatgattgatgagtgggctttgcgtgatgatcttgcatcgacttttggtcgggagatcgacttggtgaaaaaacgatacattaccactgaactgcaggacagactggctgaaatgcagcgtgtgatattcgtcaattccataacctccaatccgatgttccgcattatctgaggtgtgtcatatttatcatttccttcgatactgggctttctcatgacaatgagattcggggagctgacaaatattggtcaggtggctgtgtctaatgccaccgtttaggatggcataatccccagaaatagtcatcattcgactcagcttgctttataagcatggatgaatatgtggaattcttttttattccatcgattaaatccatgagaacaataagagatttccagacggagcggtcttcataagcatatgagccatagcgctcagctgtggcatcaaggactgggggaggaaggacaatctccctgttccaaagacggcaatggtgcgagcaaatgttgcgtagatacaccatgctgtgaatgatttgcgcagcacgttgacgatttttccctagagaaagcgactgattgagttcgtcaacagctgttgtgttggtatgcaatgaaatcatttttgagagagtgtcaaagggcatcgcctcgaccgccgcccatatgggaataggctcgttgttattccgataatggcgaatgcatacttcgctggaacgttcaagccatttgtgaatgttctcaattagaacttctctggcttcggtgccgtcaggatatttgattgttttatatgaactgagatcagtgtaggagtaggcaccttcattttgggcaaggtagtaagcaaaatgggcccgaagcgtttgttctaaggatgatgttccacgaaggatgagtagacgtagctgttcatccatcaaataaggaatcatgaaatccttaatgtgcgttccatttcgaaagcgattattgccatgagaaggatcaatctgaaaggctcggaagtagccggacaatctgtaatagttgcaatcaaggaggacggtgctgaattcggagaatccggtgatatccaagccgcgttcttcgactaaaagcgtcatcatttcctgtattgtttttggctgcttcgtcatggcgtatccttgtgcgacttgataaaaaaagagcccccggatttgagcattgttaagaggcttggaggctactgttattggttacgatagcatagttggttcgcttggtcgattcgagcgtgtctcaaggaatgctctaccgttgttacagagaagaagagacccaccgcgtttcaggacgtaaacgtagccttggataggactgtacattctttggcgatttgaacatgccgcatatcatccatcgaacgaatgaaggagcagataccatgggcattaaacacagtgcgtcttatcagagtgaggagaacatggccaagaactcgagtggtcgattggccgatgtgctcgtgcgcaatctaaatggtgagttcgatgagaccggtatggaactccgcccggaattcagaaaagctaagtcctcggaagacgacgaagtcacgattcatgcgattgagatagatgactgaaaaaaaccgatgggttggagatattaaaaaggagaaggcgacgcatcggctcctcctaggtgtcgcccgaaggcttccaccgcaattaaattgttaacctagcatgaaaacgaatgccgcacgtcgataggacggtttttcaattctctttttgcaattcgccagaacacgcgatgccgttatcgcacagatgctgcataagttcatccagtgttttcgttgcacctctatccgtcgaagtcataagagctaattgtaacttgaagcatgccgtaacagtgtggcatctgctggctcatggtgttggaggaatcttttcattacagccatgttttcggacactacccgatcatgacgggattatgacgggattcggattttgatgacgcgattatgacgcgattgcgacgcgattcggattacaatgacgcgattgcagcttgcgtattccccgattcaatatctcgttgtgcgttttactgccaaggagtttcatgggagcatcgttggtttccttggcgattgaacatgccgtacgaatgacgaagtatgtgatcaagatctgagtgcgcgcatttgtgcgtgcaaatacgtgcaaatgcgcgagtggccttgattgattcgttgacttgaacgcagaatctatctgctggaagtccctcgcgctcgcgaagaaaacatggcttatggtaaatgcgcattgttcgcatatcatccatcgaacaagtaagtgagcagataccatgggcgttaagcgtagtgcgtcttatcagagtagggagaacatggctaacccggattcaatggatggaaagtggaacaggctacactttgatgggaagacaaagaaatacgaatgaagagggttggctctatgacttccgatgattcgctgtttgaggaagcgaaaagtgacaaggacacacgtaaggcggttcaaaatcaaattgcggatattaagaatttcgtcaagggcatcaatattgatgaattcaaaaatggagaatggtttgcgaagttgctgaccttctctcttgataagtatgtccagaaggtgaatgctgactattttaggggaaaatatcccaaccttcctcctgatgcaattgtccaagcccgaataaaattagcggccaaatatgcggggatagaggggtctttgactgcagcggcgtattccacagctgttattgcgaccctaggatcagctggtggtgcttcccctgttactgggccagctggtcttactgcgttcggtgtggatttagtttatgcttctcagctgcagcttcgtttggcatatgatattgcagttttatatggcgttccactggatttggacgatcctgaagatttgtggaaactgatcagaatagcttttgccatacaggttggagaggatgccggtaatgctgttctaaaaggggtcccggctgtggtccgaccagtggtaaaagcgattttttcaggtcccagactcgtcgcagccaagagccttccggttatcggcaagtatttattgcagcgcaatatcatcaaaatttcaattccggtggtgagcataccgctgtctacgggtgtgaattattggatgacgaaggtaacggcaaataaagcccgtgaaatcatgcgcaaagaggccaagatgattgaatccgcaaagcgcatggtgaatgcttcggagcattgcttggatgaattattatgggccgcttggatgattattgctgcaaatggtgcacagccggatgaggctgaatatacattgtttcattatctgactttgatcagtagcgagtcaggtgtctcagctaagacgttagatgaaatacgcaacactgtagaagtggattattccaaaatctggagcatgctgagtcaaattagtgacgctgctccgatttatcgtgcatgtactgttatggcagcggtcgatggcaagattacaagccaagagattgatgtgcttcggcgtctggcagattgctgcggtgaggcttttgatgagcaggaacttcatgaaaaagcgaaacagtggcgtagatgattcctttgcagtgaaagatgaagtcgcgacttatgcgattgagataggcgactgaaaaaggtggggctgggagcggcagctgaattgtctgctgctcccagccccatcgctcaagtagattacttgtagtctaattggttaatggactcaagtattggctgcaaggttacttatcgtgcttgaagaatccgttccagagcttttgatctcgtctaatcttgattaaattttcctcatcgatttcttcgatctgcggtatgagttgagacttccaattgcatagagttttaataatctgctgattttcggcagtgtttggaaggatgatgcacttgctattaggatcagtgaatttcagatagtcacctccgactttttggaaaaattgtttcatgtttttaacaatctcattttctggttgatcctgggcagtcacatattcaagagcataggcaaacatgacgattgccgatttaggctcaagcccggcatcaaaaaggagcagggtattgactaatccatcgtcatattcggcaagcttctgaagtgttcctctgtcgatggcctttccctttttgattagggtagttgatgcattgaggagatttggctcgtcggctccttccgtgtagtcgcggaaattgttcataatggcttccgcggatttctttaatcgtgaatccttattgcagacgatgtagcacgcttcattggggtgaagatccgcatcaccaagataattagcgaattcctgcgattccttgatccaagcttctcgcacgggccatggcagtccatccagggccttgaaggattctgccgtatcgacaacgagcccattcttgaggagttgggcatatatctcagggcaatgtgcaaggtcttgcttatccggctcgatggatgagatggggataggaccttcgagttcgagttcttggagaaggtgtattttcctatcgctattcagaatggtgggtggaagattgattgtatcttcagcgagtttttctttatcaagtttctcgtctgtatcgccctgttcgaaagagtcatgtttttggatccacgtggtcattgaggattcatgttcggtgagcgcgtcatgggcgaaagcccactgtaggttcatcggagtgaaatgaactgcatcgcattccatgagtgcatcggtataatcctcaaaatgatcatcaaaaaggggaagacgggcagctgacgaacatttattcaacagtgtatggataagcttttttgtatcttcttcatcggtttgttgacgaatatcgtcaaggatgtggagcaggtcatcggcgatattctgattagaagaacaatccaatgcatattcatctttggtcagaagatcaaaatatttctcaaggtgcccaagcgcattcgcatacactgttctgctgatatgcataatcatgttgagcgcaggaagtctattgcaaacgctatatgaaccatcctgattattatctgattggcttatggtgtccaacgcggtttcaagattacctcttgaaaatacgtataggttctgttccacgcaggggtatcgcaatccagaacttgaatccttataacccagctcggagagggagtctattctgactttcccatcgttgagaatctggactataggttcaacgagtgccggagcgatattggaatccctgaagattgagatgcttcgccaatggttctgaagaaaatcagctaggttaccgtctacggtgtattggatttctcttgatagatgatggaacgccacatcaagctgctggcaaagcatgtcagtgcctgttgttcctcgttgagctaggaagctaagtaacttttggctgcggcttgccatcttgtcgagcaatgagttagctttatcgtcaagacggtccagatatgctgaaacgaattcagaggtctcgttgtccaatggggatagcatctcgatgatttgattagtgtcctggactacttcagaatctttattctgcgacagcatgtaatgcagcagatcaatgttcagtattctccgctggctgaaaatcgttttgtctcgatttttgattcgacggaggacgtctttagtgtccttgttgtcaagtttgaattgatagtcaggattgttgccatcgatatgatgaagaataaaattcagtgcgttcctggttactccttcatctgtatatattgtggaatagagcatatagtcctggccgatccatccgtgtgagatgagtcggttcagcagagaattgtctccacctagtaaagcataaagttcttgattgtgacatggtttcgccgcttcatagtgggtaataaattcccagtctcctgaccgaagtttttcgatcgtcagtgatgtattattcttctcatctataagatttttttctttatcttttcgccagtcggtgtctagtgatttacccatgatccttttaaaagtctttattgtggagctgaaatcaaatgatggattatcatagtaactattgtgaaaagaaattcgaatgttgattcgatcggtttctttacagcgagaaatgtcgtcccagagtttcggatcgtcggcagcatatgtattttgactgttgtttggaatatttatattaattgattggcatctatctgcttgctgattattcaaatcggcaagcagatagataaggtccgttcgaagctcgctagcgtattcttcagcggctctgccatttgagatttcgttgattttatattttagatttttgtttttgtaatctaatgcggaaatatcttcctgtattatctctcttatttccttatagatgtggtcaagcctgctccggccgtcctgtaactttatggcatcatcaaggtaacagttcttgtatataaggattgcgagcatcttgacaggggacagtccaagattggtccttttcgggttaagcagctgctctttataaacaatgaactcattgcgaatattgatccaagtgcgtttatcgggaactgcatctgcaacgagctcaagaagattgatcatttgagggtcattcgcatcaagaacatcttccaatgtttctagtgcgatttgatatgaattgcttgccgagacgaatggcaccactggaatgatgaggtcaaagaacttcgcgcgagagaaagaatgagacagagattctttattactcacctgttcgtcagccaaaacatattgattgctgaatatcgcatcatgaatagcgtatacgaactgtataggtgtactgggctgagaattcttttcttctgcggaaggagagaaatgcaatcgttgactgattttctggattgtcgattctgtgtgtcgcagctttgggtcgttattaagaatctgatttaattcgcgtaatgaatcaaagatttgagcatcttgaaaacgatcaagatcttcgaaaaatacagttcggatgcctgtcttttcaaagatatatatgatctcatcaagatactgatcgaaataagagtccgagttctccccaagggtaatgcctgctgttccaacatctattttggctagatggatgcgggtgccgaaataatggaatagtgcgaacgttgctattagtagcaggccaattatgacgatttcagcaagaattttggtaatgcttgttgggattggtagccaagtcaaaagttcttgaatacgattataaggccatttatggatatcaagaataaacagtaaaagtgttccgcaagcaagggaggaaagtagctgcttgcctagtccgatttcatttatcctatggaaatgcgatgccggaatctttccggggtctgttccatatagaagttgcttaatgatctctttttgaatgagattggttgtggatgaaggtttggaagattttgggggaagtgccccgggtgcttctttcaaagtgggatcatccttatccgagacggaatcggttttcttatcatcctgttccttaagctgtgcagccaaaggcgccagcgagatcgttctggtcgtataagggcgtttttcctcaagatcttcgacgactttctcaagaatgctgctttttccggaaccatagacacctgatagagctatgttgtgtatcttcgtatcctcgccctgcaacgccttttcaagcctctttacatagggtgagtggctcgattcgtcatattgggggtatagaggcttgagctctggtatttcactttcagctgctgcattgctcttctcggtcatgtcgtaccagtgtagctatattaaatgatttactctcttctgtcggtagatttgttcggcatccgcatttgttgcattaagctgcgatggggaggtgaggattcgggaagtgataatcgaaagatatagatgattccaagtatcaatgcacgaaaacatgcgtgtatctaacattcatgcgggaaagcagaaggtttcaacccctaatgacatacaatatatgcgaaaacattgggattgagagcatatggggagcacacggcaatgaggcatggcgcacattcggaacgagaactgctttctcccggcatgagagttctgatccgcggccaagaatggcttgttgataaagtcgaaccgaacagccttgggaatcacgccgtctcatgtactggcatctccgctctggtgcgagatatgacggccacgttccttgatgatttggacacaattacacctgtcgatccggtgaagacgcgtttcattcccgacacctcggcaagagctgcgaagtcgcatctgttcatcgagagtctgttacgtgccactgcgccgaccgatgcgagggttcatgtcggcaacaaggctgccatggactccctgccgtaccagctcgttccggcgaagaaggcgctcgcctgtatttcgtcaaattgaggtggacgtgttcggcacttaatctggacaccgtcggcgttcaacttgaacaccgtctacagaatcgggatcacgaacacgaacacgaacaccaacgcgaacggccacatgaacttccaaccacgccaatccgcacggtgacggttgacgcgaacctggtccgcaggcgtatgcagcgcatccgccgcgactgctgcttgctgagacatgctttcttctttctgtatgctttttgctctattgatcgcacaaccatgtgcaattgttaatccgcaaaatcttttattgtttgaattacaggattgctatttttttgaaatctttttctattgtaagatttcgtttttaaaattatttttacgaagtgaggcaggcgggtcacgtcagacgattcccacctgccgtcgatcttcatggttgcgatggtgcgttgcgtatgtcggatcgcattatcgcgtttttcgttgtgccgcacggcagcggctgggcgccgtcagtccttgctggtgacggtgtagccctgctggttgccgtgatcggtgagcgccttgctgtagttgacgaaggcttcctccagagtgatgtcctcgctgtaggccttggagatctgatcgccgaaggtggactgcgcgtacgggttgtacggcaggtactggaaggcggagaccttgcgctgggcggcttcggagagaatctcgttcacgttctgaccgccgaagtagtcgttgaccttcttgttggcttcagtgttcggatcggtgaaggagtcggaggagaggatcttcttcaggctcgggaaggtgccggtgtcggccatggtctgggcgccgtcgccgtgggtcaagtattcgacgaacttgtaggccgcggcctgctgcttggactgggagacgaccgcgagtgcggagccgccgtcttcagcggagacctcgtcaccttcgttccactgcgggagctgggccacgcgccagttgccggcctggtcaggagcgccgttcatgaggttaaccggcatccatgcgccgatggtgagagtggcgatgtcgccttcgttgagcgcacggttccagtcgtcggaccagttggcgatcttggtgtcgacgaggtcttcgtcgatgagcttctgctggaattcgatgtacttcttcatgccggaatccttggtcatgtcaatggtgatgttctcgccatcaaccttccacggctgcgcaccggcctgccatgcctgggcggtgaagggctggtattccatggaggagccggaattgttggtcatgtaggcgccgatggccttgaccttcttggctgcctcgtaataatcgtcccaagtcttgatctgggagccgtcgacgccggccttcttgagcacggcatcgttgtagaagaagacttccgggccggaatcaatcggcagcgcatacggcttgccatcatactgtagcttgctccacgggcctgcggagaagtcgtcttcgagcttgtcggcaccgtaggcggtgaggtcaacgaggtcgccggtaaccgcgaactgggtgacggtcgggtcttccagcatgaccacgtcgggagcacccttgcctgccgcgacggcgttgctcagtgcggtctgggtgtcggatgcggtgccggtgttgttgaatttgacggtgattccgggattggccttttcgaagtcggcgatcagggccttcatggtgttgccggtgtcccagccccagaaaacgagatccgccttgtctgcgtctccggcgttggccttggcgtcgttgccgccgtcgctgccaccgcaggccgcgaggctggcgagggttgccactgctgctaccgctgcgagagccttcttcatgttgcgcatgttcttttccctttctgccatccgcttcgcatgctgattgcatgtcggtcgcatatgtttcggaacatccgccgcggaatgcacatgccgtgctttccacttggtgatgtttgtatgttcgcgacctgccaaacaatacccccgtggtgatgtttggactggtaggatggctttgtttcctttctgatacaaccgtgtaccattagctccgatgatacacggttgtatcaaggtgtcaagcaaaccggttcgatagcccccctgcaactgttgtgcgctattgaagcgccaacgaaatcatcggcgtttcgcacaaacagaatgacatcgtttgcacaataatctgcgattgtccgcgcatctcaaccaaaaaatggatcgcaagaaagctacctcacaagagaaaacatataaagaacatataaaaaggaggtctgcgaatcgcaaacctcccaaaacaacacatacgacgaagagacggactccgcaccgctcgatgtaagcctacaaactgaggaacagctcgtgaatgcgggtatcgtcggtcagttcggggtggaacgccgtagcgagaatcttgccctgacgcaaaccgaccacattgccgtcgaccgacgtttcgaccgtggcccgctcgccgacctcggcaacgaacggtccgcgaatgaacaccagagggaaatccttgagcaccaccgacgtatccgaagcctcggaagtcccctcctcaccagcagccgcggaaatcgcagaagagacagactcccccgacgcaaccaccacagcatccgcatcgtcggaagcgccgaaatcggcggacgcagcgaacgaaccaagctgacgtccatacgcattgcggcgcacgaccgcatccaacgcgccaaaatagacgttctcgtcgttatcgagacgacgagcgagcaaaatcatgcccgcgcaggtgccgaataccggctttccagcggcgatatgcgcggcgatcggatcgaacaagccggtcgaacgcagcaatttgccctgcgtggtgctttcgccgccaggcagaatcacgcggtcgatcgaatcgtcgaaatcctcggcggcacgcagcagtttccacggcgcaccaagccgatccagcatcgccgcatgctcggcgaacgcgccttgcaccgcaaggatgccggtcacgccatgctgcgcggaagccgcaccttcggcaacgtcagtcgattcttccttcgaaatgtattcaacggcaacaaccatcggatctccttacccaaaccatcgcgaatcatgcgaaacgggctgcgcgcggcgcatcgaacagacatgccgacagccgcgcacagcgcacagcgcacgaaatgacagcgcaatcactcgccgcgagcggccatgatggtttcgatctcgtcttcgttgatgccgaccatggcctcgccgaggttctcggaaaggcgtgcgagcaggtcggcgtcctgccaattggcggtggcctgcacgatggcggcggcacgcttggccgggtctccggacttgaagatgccggaaccgacgaacacaccttcggcacccagttccatcatgagcgcggcatcggccggagtggccacgccaccggcggcgaagttgacgaccggcagacgaccgttgtcgtgcacatacttggcgagatcgtacggcacggccagctgcttggcggcctcatacacctcgtcgtcgcgaagggagacgagctcgcggatctgcttgttcatggtgcgcatgtggcgcacggcctggatcacgtcgccggtgcccggctcgcccttggtgcggatcatggaagcgccctcggcgatacggcgcagcgcctcgcccaggttcttcgcgccgcacacgaacggcacgtcgaactggttcttgtcgatgtggtacacgtcgtcggcgggactcagcacttcggattcgtcgatgtagtcgatttcgatggcctgcagaatgcgggcttcggcaacatggccgatacgaacctttgccatgaccggaatggacacggcttcctgaatgcccttgatcatggccggatcgctcatgcgggaaacgccgccggcagcacgaatatcggccggaatacgctcgagagccatcaccgcgcatgcgcccgcgtcctgtgcgatcttcgcctgctccggggtggtgacgtccatgatcacgccacccttgagcatctgcgccagattcttgttcagttcgttcctgttgttggccatcgccagcctttcgtcgaatcgtattccaccctgctgcagagcggatatctcttgacacagatactaacgatttttcgttacaaaatcatgtgaactgaatatttgcacgtcttaaaaagttgcttttcttaaattctgactatcattttcatgattgtttcattttcttacgatttcgattctgccgacgattccgcaatttcattcgcttttcttgcctgatatgcgccattcgctttcgattcgcgcgcacggctcctttcgaccgcactttcgatgcacgctataagaaatacgaatgacgcatgattttcatacgaccacattgcggacgggggtgcagatggattcgcgtattgcgcactacatacgcagtatgcgatcagcgatgcgcatggtggaatcgcggtgcgacaccagcacgacggcgctcccccgctcggcaagatcattgatcgacccgagaatcaccgactcgttataggcgtcaagacggctcgtcggctcgtcgaacagcaccaaatcggcgtcgcgaaggaacatgcgggccaatccgatgcgttgcttctcaccctccgaaaggcggccacccagctcgccgacccgcgtatccaagccgttcggcagcgcatcgaccagttcgagcgcggacgccttggcgagggcttcgcgcaatacggaatcgggaatgtcgtgcgcgagatccgaatcggaggaatcagcggaattaccaccagcattactgctggaattactacagaaattactgccagaattactgtcagaatccgaaaaatcggcgtcattgcaggcaatagcgagattttcgcgaatcgttccgtcgaacagatacgtctcctgccccatcatcgtctgcacgcgccgacgccatccggcgtcaacctgcggcaatggaacatccgacagcgaaatcgtgccggaatccggatcccagtagcgcatcagcagtttcaacatcgttgattttccacgcccggacgggccttgaataccgagaatgccctgccgtgaaacatcgagtgaaacatggtcgagcaccggttgcgaggcgatgccggcaccttgttcgccggaggattgcgcttccgcggggcgtgccggactcatgccagtcgcatgctccgaccgcccgtttggcgtgcgttcgacggaaatacgggcgccggatccatagccgaatgtgacatcgcgcattgtcatgccctgatattccgggcgttcgctcccctgctcgaccacagcgggagcctcatccatcaacgcgaacaggcggcgtgccgaagcaaacgtttgcgtcagattcgccggcaacgcactcaacgcaagcgtcggcccaaacgagctggcgagcagcacgaaagccgcaaccaacgctggggcgttcgatcccacggaacccatccacatcaggccttccgacatatcggcggcagtggaaaccgcagtgcacaacgtcatcgcaaggaaagccgcaatcgccgtgaacagcatcaccaataccgcgccaaatcctgcaaaatcgccatttttcacgctcagacgcacacgtttgacccacagcgagcgcgtgcgacgctgaatggacgcaagccgggcatcgccttggccgaagcggatgatttcgccgatgccacgcatatcgtcaagcatttcgtcatcgagggcggacgactccttgcgcagttccggaccgatgccgcgcaccgcggatgcaaaaagtttcggcagtatgacgccgataatgaggtgcgcgatgatgagcgtcgccgcgaggggcggactgagggtgagtagcgcgagcgcgtagacgacggtagtcacgatggcgatgacgaccgggctgatggtgtgtgcgaagaagatttccagcagttccacgtcggtggtgaccagtgcgatcaggtcgcctttgcctttgcctgcaagcttggcgggggcgagacggcgcagggccgcgaaggctttcgcacggaatagcgcaagcagacggaacgccacgttatggttcatgaactgttcggcgtaacgcatgccgccgcggatcaacgcgcatacggccatggctgcgagcgccgcgagaacgctgaggttccagaccggcgagccgactgcagcgaaggccgccgcgatgccgaacaccggcaggaaagtggcggcgagatggccgagcgtgccgcagacgcacgcgacgatcatgtacttgcgctgcggcccaacttccttcaacaggcgcgcaataaggcgagacgtgggtattgtcttcgcgtccgattctgccgaatcggacatccgaacgcccgttttcgcaccctgtgcgtccgtttctgcagaatcggacatccgagacgtagtttcggcacgctgcgtgaccgattcgggagaatcggacatccgaacgcccgttttcgcaccctgtgcgtccgtttctgcagaatcggacacttggagacccatttccgcacgctgcgtgactgattctgcagaatcggacgctttaagtgcgtgggatgcagaggtggaatgggttgcgttattgcgtagacctatgttttccacggtttgttgggcgtggaacagtttggcgtatgttccgttggcacgcatgagttccgcatgcgtgccttgttccgccacgcgcccgtgttcgaataccaccacatggtcggcgtcggctgcattcgccatgcggtgcgtcaccatgatcacggttttgccccgatccgcaagcgcccgaatggtttgcagaatcagggtttcgctttccacatcgacgctgctggtggcttcgtcgaaaatgtagacggcaggctcccgcagcaatgcgcgcgcaatggcgatgcgttgcttctgccctcccgacaggttgcttgcgccctgttcgatggccaggtcaagttcttgcgattgcgcacgcacgaaatcgctgatatgcgccgcttccagcgcttgccacagttcgctttcggtggcatccggcttggccatcagcagattgtcacgcaacgttcctgcaaaaaggtggctttgcgccgccactatggcgatttccctcgtaagggattcgatggaaagatcgttgatttggtaccgttgcgtcgagttgtttcctgtgtttccggattgcagccacatacatccttcatatccggaaagatttccggagagcagttcgacggcggtggatttgccggatccggacggaccgacgatggcggtcacctgcccgcgccgcgcagtgaaagagacgccatgcaatgcgacgaccgaaccatcatcatctttcgacatgcctgtttttccagcaccaaccacaccggactttcccccgatttgtccagtttttccagtttccatatccgccgtcacagccgtatccgcagccacactcacagccgccgcagcatccgtattcacgtccacatatcggaacgacacgtcatcaaagcacacgtccacaccgttatcagaagcgccgaattccggcatttcctgcatcccatgcgcaggaatcggcgtatcaagcaatgcgaaaatacgcttggtcgaagtcatgccgttcatcgcaacatggaagaacgaccccaattggcgcagcggaatgaagaaatccgcggaaagaagcactatcagcagcacgccggcaagcggcaatgcggcaccactcgcatactgccagatcgatacgcccacgccggccgcggcacccccgtatgcgacgacgtccatggcggtgagcgagcgcagctgaatttgcagaacattcatggtcattacgcggaattgttccgcttgctcgcccattttcttggcggcatgcgcatccgcgtcaaaagttttcagcgtttcaagaccttgtacattgtcaagaaacacagatcccatgtcggtgtattttccccaatattttttgaatactcgggctgcgcgcattgcgaccatgccaacaatcaatacaatcaaaggcgcgcatacaagcaatgtaacagccgtcggcatattaatcggcgcaactataaaaaataatgttaccggtgcgagaatcgcataaaacagttgcggtaggaataattcgaagaagctttggatttgttcgatgccttcaccggcagattgcaccacgtcggcagtgctgatatgttgcgaatatgatggtccgatcgcaagcattttattaaaaagctgttcacgtaacgcgagtttgacacgctcagccgcttccgcgccgaaataggccgctgcgcgcatcatcagaaaacgcagtaccgcacagaccacgatcgccagcacgcatccgacgtatgtttccgcactgaatccgccgtagccaaagccgatgaacaggcgggaaatcaggccactatcacccatggagaacatggggtcgaacgccgattccaccacggcaagcgccggcgaaagcatgaccaccaccgtcaccacgaacacgacgttggccagcagtccgacccattggcagagcactttcgccgcaaccaaccgccccacgccgggagcgagggaaaacagcctcttgtcaaacataaacaccttccgtccaatgagcgcactcgcgttgccagctcgcctacggcccaaagcgcaatcgccatgcatccaacaaacgaatcgcaacaggccaatacgggaaaaccggtgcgtggcaaaccgttttcagcctatccaaggcagctcgcaatcgtcaagggcgcattgcatacagcgaaccgtcgcaatcgaattgccataatcgacctcaaatcagcaacgttgaaaagagaaaggctggatgttcgccgttgagcaggcagccctctgacgcaaggggtaaattgcgtcactcgtgagtgtactcgataaaaaacgctcgcaccaccatttcttcgcatttcgctggttttacggtcctttcggggatatatgggaagcatggcggttcccccgcaaccgttacgtcaagcctttttttcgaacggatacagcgcgacaccaaacacttgatttttgacggaatagcaccatttgtcagttcatacaaagttgatgaaatatttcttgtcgcttctcacaatgcagacttacggccccgtaacttagaatgtgcaaggtgcgcaaggggtaggaaacgcggacacacggtttgtatcgctcccgcacgcatcacaagcagaaatacgcggaaacaacgcaaaaaccgcgagaaagagaacgcttcatgctcaccgagtacaccaccccgggcgaatccgttgaggtgcgcgacgacgaatccatctattccctgcttactggacgcatagcgcgcactggcgaagataccgtgatcgcggaacacaaaaccgcccccggccaatggacgaaggtcactaccggcgaattccacaatgccgtgctcgccgccgcaaaaggcctcatcgcattcggcatcaacaagggcgatgccgtcaccatcttctccaccacccgctacgagtggggcgtgctcgacttcgcactggccgccatcggcgcggtgaacgtgccgatctacgacactgattccgcggcgcaggccgagcgtatcctcaacgattcggatgtgaaactggccatcgccgacaatcgcgagcgcttcgaccgtctcgactccgtaatcgaccgctgcccgtctctcaagcacattctgatgctcgattccaacgccatgggcgcgttggaaggcttgggcgtcaccgtgtccgacgaggagctggaagcgcgcatcgattcggtgcatgcagacgatctggccaccatcgtgtacacgtccggttcgacgggagctccaaagggtgccgagctttcgcaccgcaatttcatatcgatcacgcgcgcaggcagtctggcgttgcatgagatcgttctcgaagatcatccgcgactgcttctcttcctgccgctcgcccactgtttcgcacggttcatccagtacgcgtcgattgcttccgacgacggcgtggttggttatctgccggacacaaagacgctgctgcccgatttgcgttccttcgaaccgacatatctgctgggcgtaccacgagtgttcgagaaggtgtataacgcggcctcccgcaaggccggcacgggttggaagggacgcctgttcctcaaggctgccgaagccgcacgcgattggtcgcgcatgcagcaggccggcgaacgcccgaccgccaagcagatcgcgcagcatctttcgtatgaggcttccgtataccgtaccgtgcgtagcgctctcggcccgcgcatccgctacgtggcatgcggtggtgctcctctggacgtgtctctggcgcatttcttcaacggtatcggcctgccgatgattcagggttacggtatgacggaaaccgctgcgccgttcgccgcgacccgcgtcaccgacaatgtgatcggcactgtcggccaaccggctccgggatcgtctgtgcgcatttccgatgatggcgaacttcaggtgaagggcccgaacgtgttcaggggctaccacaacctgcctgagaagacggcggaagcgttcaccgaggatgggtggctgaaaacgggtgatttggcgtcgattgacgacgagggacgtattacgatcaccggccgtaagaaggacatcatcatcaccgccggcggcaagaacgtttctccgattccgatggagcaggagattgtgaaatgtccgattgtggagcatgtggtagttgtcggcgacaatcgtccgttcatcggtgcgctgatcacgttggatccggaaggattggaggcttggctgccttccattggactgtctgccgatacgccgttggatcgcgtggctgcgaccgccgccgttcacgacgaaatccagaagtacgtcgacaaggcgaacgcgaccgtttcccgcgccgaatccgtacgtaagttcgtagtgctggatacccagttcacgcaggaaaacaagtgcctgaccccgtcgctgaaagtggtgcgtccggcagtgaaccgcgtgttcgcacaggtgatcgatcagcagctgtactccggcaagcgctgaatcgcataatacataaaagcgtggggtacgagagaacgtttgtattctctcgtaccccacgcttttgttctgtctgtacaactttcaaggaatgcaaacgagcgccggtgatcggaagcgatccgacccgccggcgctcatatggcagagattagtgatgaatccagaatggctaacgacactccatcagccattgtcagtaaagcgacaatcagtgacggttccgtcagtgcataacgcgtgcggtaacggtgcgacagaaggcgaacgagggtacgtcgagtcttctgctgtgccgttaacgctccgttatgttagtgacggttgttgaggcggtggtacatttcggagatctcaaggtcgcgctcgaattctgcggccttggtgttcgcgtcgatggtggcgagttcgacaccggcgatgcgggcgaagtcttcccaagcctcgcgaccgacggaggtggtcatgcaggtgtggtgggaggcgccggaacgcagccagcactcggcggaggtcttgaggtccggctgcggcttccacaggccacgggcgcacggcaactgcttgagctctccgagcggctcgaccacgtcgaccaggttcatggtcaggcggaaacgttcgcgcacgtcagacatggacacgacgacggcgtccttcttcggggcgacagtgaagaccaggcgcaccggatcggccttgccaccgatgccgagcgggtggatttccagcttcggcttggcgatggtgccgacggacggggagacttcgagcatgtgggagcccatgatcatctcgttgcccggggtgaagttgtaggagtagtcttccatgagggaagcgccaccttcgaggccgtagcccatcactgcgccgatgcgcacgagcactgcggtcttccagtcgccttcggcggagaagccgaagccgtactcggacgggaagcgctgcgggccaacgcccggcagctgcgggagagcacccaagtcttcgaagttgtcaacgccggcggtgcaaccattggcgcgcatcatgttgaccatggcggcttcttccttggccgcgatgaacagggaatcgtacttggcgtcgagcagagccggatcaacgtcgtacttaaccttgtagtcttcgatgatgctcttgacctgatcgtccttgacggcttcgtaggctgcgacgagctcgttgacggcccaagtgttgatggatgcgccgaacacgcgctcggcttcggtcttgtcgccttcggtgacggccacgttgcgcatgttgtcgccccaacgcatgaccttcatgttgttggaagcatcccagccggcgcaggcgcgtgcccaggtgccgatttcttcggcaacggccggatcggtgtagtggccgaccacgatcttgcggttgatgcccagacgggtcaggatgtaaccgaactcacggtcgccgtgtgcggcctggttcaggttcatgaagtccatgtcgatggtttcccacgggatttcgaagtggtgctgcgtgttgagctgcagcagcggcttggtgagcacttcgaggccgcggatccacatcttggccggggagaaggtgtggcaccaggtgatcacgccgatgacgttcgggttggcggaggcttcgaccatgaaggccttgacgccgtcggaggacttcagggtcggcttaagcaccaccttgaccggaatcttgccggttgcgttgagcgcgtcgacgatttcgccggactgctcggccacctgacgcagcgcttcttcgccgtacagatcctgggatccgacgccgaaccagacttccttgccttcaaacgggttttccattgccatgtgattgttcctttacttcgttgtttatggagtttttaattatttattgcgattgcgaactcgcgcttcgcgttgttctgttgcgtagcgcgagttcgtacgattgtgaaattatgtaggattacggaatcgtaggattgcagctcagtgctggccgtagacgttggtgtaacgatcgttcagcttcgcgatatcctcatccgaaatcggaatgatctcacccaactgcctcgccgcccacatcgtatgagcgacctcctccgtcatcgccgcggccttcaccgccgactccgcgtccttgccgatggtgaacggaccatggttctgcatcagcaccgcaggagacttcggatactccctgagcgtctcgaccacgccctcgccgatcgcctcggaaccgatcagacggaacggacccaccggaacaggaccgccgaactcgtcgcccatcatcgtcagaccgcacggaatgttctgccccgtcgccgcccacgccgtcgcatacgtcgaatgcgtatgcaccacgccgtacacgtccggcatatgacggtagatgtacgcatgcgacgccgtatcggaggaaggagcctccgaaccgtccaccacgttgccgtccagatcgcacaccaccatgctcgacggcgtcaggtactcgtaacgcaggcccgacggcttgatcaccatcagatccgccgtatgcagacgctgcgacacgttgccagccgtccacaccaccaggttccacttgatcagctgctcgtgcaaggtcgccacgacctcgcgcacctgcttgacctcggcacgaacctcaggaccataatcagccaaagtagccataatcatttcctttcaaattgaaataagtttttaaaatatttatttacttggtttccagcggaatgctttcgattgcaacatgctcaatcggcagtcccttgcggaagcgatcgaagaattcctcgaatcctgcgacatcgccttcatccggattttccgtggtcgaagcggcatcggcgaacacacgagcgtcaaggaattcgtcgagcggctggtcggcgtgccacaggtagtcggctagcacggccatgccccatgcgccgccttcggcagcggtggacattaccttgatcggcgtatcgaatgcggctgcgagaatcttctgggcaaccttcggggtggtgaagatgccaccgtggccgacgagggagtcaacggcaacgccttcgtccttggtcatcacatccatgccgatcttcaccggggagaatgcgctgaacagctgggcgcgcatgaagttgccgaggctcatgcgggcttccggaccgcgcgcgaacagcgggcggccttcgggcagtcctgcgaggaattcgccggagcggaacgggtagttgatgagtccgccgcagttggagtcaacatcgtccgcgatggcggcgcggaacagcgtgccatacagggtgccggcgtcgaccggagtgccgattgcagctgcgaactgtccgaacagaccaacccatgcgttgaggtcggaggtgaagttgttggcgtggctcatgcctgcgagatcgcctgccggagtggtgacgaggtccacttccgggtgcaggcgttccagcttgcgttcgagtacaaccatggcgaagatggaggtgccggcggaaacgttgccggtgcgcacgcgtacggagttggtggccaccataccggtgccagcatcgccctccggcggagcgaatgtgattcccggctgcagcgtgcctgtcggatcgagcagcttggcgccctcttcggtcagcgtgcccgcaggagtgcctgcaaccagcggttccggcagcaggtcggcaagcttccacggctgggctgcgacttccggaatcgcattgaacttctcaatgaattcggtttcgtaggtgtgcgtggtagggtcgatcgggaacatgccggatgcgtcgccaacgccgagcaccttcttgccggtgagcttccagtgcacgtagccggcgagggtggtgaagaaatcgaccttgccgatgtgctcttcgttgttgagcacggcctggtacaggtgtgcgatggaccagcgttccggaatgttgtactggaacagttcggaaagcttctcgtgtgcttcggaagtgttggtgttctgccaggtgcggaacggcaccagcagttcgccatctttgccgaaggcgaggtagccgtgcatcatggcggagaagccgatgcgtcccacgcgggtgagcttttcgccgtaagcgttttcgacatcttcggcgagcgccgcgtatgcggtctgcagcccggtccagatttcttcctgcgaatagctccacaggccgtcttccaagtggctggcccagccgtagtcgccggctgcgatggtggtgtacgtgtcgtcgatgagcacggccttgattcgggtggagccgaattcgatgcccagactcgtcttgccagcgcggattttctcggcggtcagcgcgatgcgatcgtcaagtccctgctcttgcgccatagtttcaaactccttgcatccgagcgcctcacaaccacattgtcgacggaatgttagcgctcactgttaacgctcactattctaaacagaaagtggcgactatacaagttcgacgtgtcacgcaatcgtcaacgtactaccggcagatcgtcagccgattttcttgatataccggcattacgaaatccggcaatcgcagcacatgcggcaaaaagagatacgagaatcacaagaaatacaaaaatcgcaggaaatattcagcgacggctggcggtgcccaaagaagtgcggccgatcaccttcgcgggaatcaggccgacgccatgctgcgacgaggcgaacgaattctcatcgccctcccccagcaaaaacagcgtctcacgcatggcggcaacgccaagctgttcaaaatccgggcgaaccgtggacagcggcgggtacatgttgtccatggcgggcatgtcgtcgaaaccgaccaagctcacatcctgcggaatacgcatgccatgttcatgcagcgcacgagacacaccaaccgcctggctgtcgttcgcacacaccatgcacgtcggcagatttccgccggtacgaccgatgttttcgagaatatggttcatcttgccatacgcttcggtcgattcccaggtttcgcattgcacggtgacggaactcaccgcattggccgcacacagcttattccacgccatcaaacgcgtggcggcgtcacgccattccttcggacctgcgaaataaagcacggaacgatgcccatgctcgaccaccaaatgcatcacgtcggccatggccgaccattggtccactcccactacggatactcggcgacggtcggccggtttcatcaagcgcaaaccatcctgcacgctgatgctgccgtgcgtggaggtgacgatgacgcgcggctgcgtgatctgcgcacggcaggcggcggaaaacataacatccgtcggcgtgaggaaaatgaacgcgtccacgttcatctcatcgaacgttgagcacaattcgtcgaattccgcctgcgagcagagcgcctcgtgcaccatgctcaccgacatgaacagtccatgctgcctcgccatcgcctcaatcgaggaaatcgcggaaatcggaccataaaagcgttgcccgcccgcaaccaagccgatggtgcgggagcgatgcgaagcgagggcacgcgcggaattgctgggacggtatccaagcgcgtcgatggctttctgtactttttcgcgggtggcatcagacacgtcgggggaatgattgatgacgcgcgacaccgtttgatggctgacaccagccattttcgccacttcgaacatcgaggggcgtttgtttgccgcattgcgcttgcctgccatgctccgtcgccttccgcacactaccgttgttactttcgactattctacacgcaacttcggttagcgctaacagacgctatttttcagccatttgagcgagtcgcgcagcgaaattcggccagtcggtacgcatggcggtcaacagtttacgattggggacttcctcaatcggcacccattcgatttccatgctttcgtcgtcgttggccttcggctccacgcggtgccccggcttttcgaaagcgaacacggtggtgtaggcccacggtccgtggtcttcgcagtatgatccgaccacgtcgatatcttccggcgtgatgttggcttcctcgtacgattcgcgcagcgcgccctcgatcgggctttcaccgtcggcggtggcacctcctggaatgccccatgtgccaccttccgcgctccacaccgcgcgatgttgcatgacaacgtgcgtcacttcgccggtctgttcgcttcggcgggccaagagcacgccggacgcgccgttcgtgccccaatgcttgcggccgcaatcgcaatcaatccaaccatcacccggctgatgcacgttttccttgggaggaagcggcttcgcggcaccggttcgcgaatcgtgttcgacgttcggttcttgatcggctcgcgtcacattccacagatcggtccattccacgccgagctcggcggccaaacggcgcgccagcggaaggctcaggccgataatgccgtgcggatcgccttcgatggagtcgatgaatgctccgccgaagccctcaagcgtgaaggaaccagccacttccaacggttctccggtggcgatgtaccgttcgatatcggtgtcggaatattcgcagaagtgcagcgttgccctgctcgcgcctcgcgcgatacgcccggtggcgaagtcgatcaggcaatggcccgtccacaattcaccggtggcgccacgcatggcacgcagtcgttcccgagccacctcagcgctatgcggcttgccgtaacattcgccgtcaagcaggaacatggaatcgcagccaagaatcagcggaccgactttcgcacgggtcaggctcggcttgccatcaacgaaatcagcaatcgattcggtgatcgtaggaatggtgactcccgaaaaatcgcgggtcttcacatcggaggcggactgcacttcgtccgcacgcaacgtaacacgatgatgttctaaagatgcggaatccccagtattttcagcattatccgaatgttcggaagattcggcaactgctttcaacggaaatccgaccacacgatcgccgtgcgccgccgcagcggtggcggcaacgttccgatacgcctgatgtacggcttcggctttggccgtagcgagaatcatcacccgctgttccacgctcagatcgcttacggcaacgcccatggcggccgcctcacgttcgagcgccgccggctcgtccacgttcgatacgcgaatcgtggggcaaatgcccgccgagaaaagcacgtcacggcgaggcttggatttggaagcgagaatcagcggaatggagttgttcatgcgcgttccacctgcacacccttggtgtcgacgcccaaatgcagcacacgccaatgaccggaagcgagctcttcggaagcaagctgtcccagctgttcgcgagcgtcgccatgatgcagcacgagcacgcatgggccggcgccggaaaccatggaagcaaaaccatgggaacgcagcttttcgatcaacgtccacgacggttccatcaaaggagcgcgatacggctgatgcagacgatcctgcgtggcggcgaacagcaacgcgttgacgtcctgacgctgaccagtcgccagcatcgcaggattcatggcggccggcagcaggctcacgcgagacacattgtgcacggcatccttgaacgccagctggcccggcagcgcctggcgtgccttttcggtggacagctcataatccggcacgaacacggcggcggtcagatcgtcggcaacgcgatagttgatggtatggaagcccttatgcagcggttcgccgcccggaatcggcacggaaccgacaccttcgggggtttccatgtcccaagacatggtgagcccgccgtacacggccggagccacgttgtccggatggccttcgatggccgcagcaagctcaaacacggcatcacggttgagttcgtcgtcctgcgcgaaggcggccgcggctgcgatgcccgccacaatggcctctgcggaagagcccatgcctcgtgcctgaggaatgttgttgtgagcctgaagaatgaagcccacacggcccagaccaaaggtctggcatgcgcggcggaacgtggaaaccaccaagtgggtttcgtcacgcgggagagtatcggcgccttcgccttcgatcatcacctgagccgcagtgttcaccggatcggcgctcagcgtgaattcaagttcgtcgtggtagtccagagcaagtccgaccgtatcaaagccagaaccaagattggcgctggtagccggaacacgcacacgcactttacgagtaactggagtcatatctcgtcgtccttcgtcacatcttctttacaaatgtagcaccgtatacccgaaagggtacaagagtcaaattcaagcccataatcagcgggcgattgagtaaacaatcggcaagcaattgcccaacacagcagccggaatatgaataaagagacggccgcccaatcgcaacgatttgagcagccgtctcataactgttagttgagcacgcggaggatggaaggctcgccaaccacgcagtcgagtgcgcacacgtctttcacggtttcacgcagggtaagctcgtcggtcatgtgcgtgacaaggcgcagctgctgcagttcgccgtcgtagcccggatccttcagcgtgggcttgagatcctggttcacaccattgatggacacgccatgctcggcgaacttggccgcaatggccgcaagtacgcccggattgtcgtgaatcacgaaacgcaccgcgaactcggccttggaagcctcgatcggagccttcttcaaatccttatacaacggaatggtcgggccagtgcagccctgtgcgatgtgacgcgcctcggtcaccacatcgccaaccaccgcagaagcggtcggagcgccgccagcgccacgaccatagaacatcagatcgtcagccgcttcggccttcacaaacaccgcgttaaaggaaccatgcacggaagccagcggatgctcgttggaaatcagcgccggatacacgcgggcagacacaccggcctcgccattctccaccacggccagcagcttgatgaccttgttttcggcggttgcggcagcaatatcgtcggcggtgatcttggtgatgccctcaacggacacatcatcgatggtcacgttggtgtggaagccgagcgtggccatgatggccgccttgttggccgcatcgtagccttcgatgtccccggtcggatccgcttcggcgtatcccttggcctgagcgtccttcagcacgtcgtcgaaatcaagacccttggtggtcatttcgtcgagaatgtagttcgtggtgccgttgacgatgccgagcatgctcgtcaccttgtctccgacgagggattcacgcagtggcttgaggaacggaatcgcaccgcccacggaagcctcgaagtagatatcgacgcccttggcttcggcggcggcatagatttctggaccatacttggccaacagcgccttgttggcggtaaccacggaagcgccggattcgatggccgcaagcacgaacttgcgggccacgccggttccaccgatcagttcgaccacaatgtcagcattggtggccacgctcatggtgtcggtggtcaccacggacttgtcgatccacgggaacgggtcggtttccgacggatcaaggcaggcaacgccggtcagttcgatcggtcgtccgatgcgtgcggcgagctcatccttctgctccaccagcaggcgtgcggtctgagagccgaccgtgcccgcgcccaacaatccaacgcgaatcggcgcaacatcttcctgtaccaaggcatcctcccttgaatgtgaagtattggtgtaaccctgcctattgtacggtcccgatatgacgtaagaccgcgaaatcatacgaaaatggacggtttccgagctttgccccgaaaaccgcccatactgcatccacgctgcatccgtaatttgagacgaatcgccatgaacaatacgaaacacgagcgaaacgccacgaatcgctattcgctcacatcccaatccagcagatcatcgaccgtctgacggcgaatcatcacatgcgcgtcttgctcggatacggcaacaaccgcaggaatcagcgcctgattgtagttgctggccatcgtgcgaccgtatgcacccgtaacaggcaccgccagcacgtcaccacgctgaatatcggcaggaagacgcacctcgttgacgatgatatcgcccgattcgcagtgcatgccgaccacacggcacagcttggtttcgctggaaccctcacgattggcgattctcgcagtgtaatccgatccatacaatgccggacgaatattgtcgctcatgccgccgtcgacagacacgtacacgcgttccgtaaccggattgccagccttgtctttcgcggttccggcaagctgcaccggcttgaccgtgcccacacgatacagggtgacgccggtcggggcgaccgtccaacggcccggctcgaacgagatgaccggagcgggcatgccgagcgcacggttcacggtggtgaccgcatcggcaaggcggacaagttccgtatcgagatccatggaatcctcgccatcggtgtaggccacggaatagccgccacccaagtcgacctccggcagggtgtatgcgtcggtggcgtagaaggtcttgcgcagcagcatcatgcgcttcgcggcctggataaaggcgtccgcatcgtgaatgttcgatccgatatgcgaatgcacgccgaccagttcgagcacgtcctgatggcggtagatctccttcaatacggcgagcgcggggccatcagccaccatggtcatggcttcggcgagtttgcggtcgccttcggaaaccttctcgtggctcatgtcgtacgggtatttgatgtcgtactgcagttggcgttctgcgctttcgcccggagtggcttcgctttcgcctaggcgtgcgttcgaccctgcgggggtcacgtcagccaaatcgtcgagcacgttcagcttgcttgcatcggcaccaaccggcagcaaggcgacaccgaacttctggtcctcatgcgcggtagacacgaattcgtggccgcccgcatgaatgccggacgtaacacgcaacatcacgcgagcgcgcttgccgagacgcttggcgatttcggcgatgcgggccggctcgttcggctcgtccaccacgattttggcgaagccttcggtaatggcgagttcgatttccgcatcggacttgttgttgccgtgcagcacgagtcgccgtccgggaacgcccgcggcgagcgcgatgcgcatctcgcccatggtgcaggtgtcgatcagcatgccggattcggtgacgatacggcagatttccttggaaagcagtgcttttccggcgaagctgacgtgggttacggtgttgttgaacgcatttgccgcggatttgacgaatttggcggcgcgggctcgcacgtcatcggtgtcgatgacgtagagcggcgaaccaaattcgttcagcaggctttcggcagtgcggccatggaacgtgatttcaccttgctcgttcacgttggagccggccggccagatgggggtgactgccatggcgatcacatcctgtctggggctgcgacgccaagcaggtcaaggccttcggcgataaccgtcttaacggcgtcattgagcttcaaacgtgcggctgcacgagccggttccggagccttggcgatgcgcagggcttcagcctgttcgccgcgagcttccggatcggtgagctccataggcaccacgcgttccacgttgtaccacttgtggtaggtggcggcgaggtcttccaagtaatgggctacgcgatgcggggcgcgcaggtctccggcttcgcgcagcagggccggccactgggcgagcgcggcaagcacttcgccgtcggcggcggtgtcgagcaggctcacgtcggcaccctcgtaggtgatgccggcagcagccgcattgcgatccacattgcaggagcgggcgtgcgcgtactgcacgtagtacaccggattctcgttggaatgcgaagcgagcaggttcaggtcgatgtcgaccggggaattgtagtcggtgcgtgccaacgaataacgggaggcatccacgccgatagcgtcggtcagatcgtcgatggtcaccacattgccggcgcgcttcgacatgcgcactgccttgccgtccttcagcacgttgacgagctggccgataagaatctgcatgttttcgccaggttcgtcgccgaatgcggcgcacatggccatcatgcggccgatatagccgtgatggtcggcacccagcatgtaaatggcgatgtctgccggatcgttgtcacgatgacgcttgttgcgatagtaagcaatatcagctgcgaaatacgcgtagttgccgtcggacttgataatcacacgatccttgtcgtcaccatgcttggtggattcgaaccaggttgcgccatccttttcgtaaatgtcgccgcgttcacgcagatcggcgatcgccttgtcgacttcgccatcggaatacaagctgttctcatggaaccacacgtcgaaattcacacggaaatccttcatggatttgcggatttcgtcgaacatcatcggcactgcacgcttgcggaattcctcacgctgttcggaatcgccctcacccagcggattgccatcgttgtcaacgccaccgtcgacgcgcggcaggtcgagaatcgcaataccgtcggcttttgcctcatcgatgacgcgacgtgcgatctcatcgatataagcgcccttgtaaccgtcgatcggggtttcctcaccgtgggctgccgcgaccagcgacttggcgaaacggttgatctgctcgccgtgatcgttgaaatagtattcgcgcaccaccttggcaccgttcgcctcaagcacgcgggccatggagtcgccgaccgcggcccaacgggtgccgccgatatggatcggaccggtcggattggcggacacgaattcaagattcagggttttgccggaaagatggtcgttcttgccgtagttcgcaccctcgttaagcacagtgtcaaccacggctgcggcggacgcggaatcaagcacaatgttaatgaagccggggccggccacttccacggacttgatgccatcggcattggcgagttccgcggcgaacagttcggcgaaatcgtgaggcttcatgccggccttcttggccagctgcatggccgcgttcgatgcccaatcgccgtgtgcgcggtccttcggacgcatgacggcgaatttggcctgcggagggatgagatcggtggtcagggtgccagccttgccttcattcacaaggttgttggcaatattgaaaatcagttcactaagcgcttctggactcattcctccaagtctaccgattatgcagacagaatcagccttgcgtatcgccccgcgtatcatcctgcagttcgccatgcttcctgcgccaagccaccgaagcgtaatagccgatatagcagatcgcaacgaacggaatcatatacagcaatgtggaacgctgcgacgaatcgcaaatcaccaaaaccaacgcgccgatgcacatcacaatcgcagcaatcggcacgaacgggaaaccgggggcacgatacttcaaatcgtcagccgaatgcccttgatcaagccactgcttgcggaaacgcaagtggcagacggaaaccgacgcccacaccaccagtgtggccaagccggaaaccgcaaccaacgccaaatacaccgtcgaagcggcaaccacggaagacaacaacgccaacagcgatccagccatgctgaacagcaccgcgaacacgggcacaccatggaaattcgtcttgccgagcacgcgcgggatcataccctcctgcgcaagcgaccagaccatgcgcgagcacacgtacaagccggaattcgcagcggaaagcactgccgtcaacaccacgaaattcatcacatcgccggcaaacggcatgccgatcgactggaacacgagcacaaacggactcgtgtcgacgcctgaccgatgccacggaatcagcgcggacatcaccgcaatcgaaccgatgaagaaaatcgcaagacgcaacaccgtggtatgcacggccttcggaatcgcctgcgccggatcctcgacggtgttcaagttgaacgccgacggtgtccagattaagtgccgaacacgtccacctcaatttgacgaaatacagacaacctcgccgaccgcgatttcacggccgaacggccgaatgagaagtggctgacggacatcacccgggatcaaggcccgggacgggaggtgtacctctcgccgccggtcgactgccacgatggcgggatcgtcgcgtacacggccgggtccggtcccaacgcggagctagccaacaggatgctcgtcaaggccgtggaaacgctgccggaggggcgaggtccctggtgcattccgaccgcggctgccactgtcggcggcccggatggctggatctcatggaccgttacggcctggcgcaaccacgagcgtatcaaacggtcactcggttggatgagtccggtacaataccgtcagagccagggaatgactgcgtgatcatctccaagaaaacgtccgcagcctgctaccgatatcaatcgccctacatcgacaatgtattatcgacaatatattgcgataatccaagaatatttgatgattagtcggtaatgtcggctttgtagaagttcacgtaggaacggctcggcgtcggaccgcgctgaccctgataatgcgagccggtgccttgcgaaccgtacggatgttctgcgggagagctgagctggaaaaagcacatctgaccgatcttcatgcccggccacaacttcaccggcaacgtcgacacattcgacaattccaacgtgatatgaccctcgaaaccagggtcgatgaagcctgcggtggaatgcgtgagaatacccaagcggcccagcgagctcttgccctccagtcgggcggcaatcgtcggatcaagctgcacatactcccacgtggaccccaacgcgaactcacccggatgcagaatccacggttcgtccgaagccacctcgaactgctcggtcagctcgccctgattctcagccggatcgacatacgtgtacgcatgattgttgaacaggcggaagaaacggtccaaacgcacgtcaatggaagcaggctgcaccatttccggggtccacggatcgagtgaaatatgaccttcggcctgcgcggcgagaatgtcacgatcggacagcagcatcgaaactccttattgccaggcacgcgaatgtgccggtatggcgctcgccaacattcgaacgttcgcatggttgagcgtgcgaatgccggcaattgcgaaatgattattagctggctctagtctaacgcggtatcgctatatcgtggcttatatcgggctgtaacgattgccgtgtgcttggtacgcaaaatccgatgcatggattttctacgggattcttctgcaggatttcttacaagattcccggcgcgatatcatgtgctgcaagccagtcgcgcaaatcgctgaattcgttgagactaaccgcatgatcgagcccacggtagcttttcgacgtgagaaacgtatgctcgtccagccaggcggcagccgcgaaaagctccggcatcggaatcacggtatcgttcttgccataaccgtagaacacaggaatattcaactccgcgacataactgtcggcaggcgcgctaccggcgacgattcccggagcaaggaagccggaaagtgagattgatgcggcgtaccgttccggatggacgcgcagcaattgaatcgccagcaaaccaccctgcgaaaaaccgatcggcaccacagcgcgatcttcggaaacattgcgcgcgacccaatcgtcaatggcttgggcggcagcataggcgtcgcgatccaaatcttcgccggaaggcacgcaatcatggaaccacgaatacgcgccctgaccgaaaccgaattcaccggaaccagcctcctgcagcacgagcggcgcgcgcaacgacgcgaaatcgttgtagggagctacgtaacgcatcatgtcggccaaatcagcctcattggaaccccagccgtgcaggcagaggaacagcgggcgtcgtggagccgcattaccacccccgcgcgaatactgcacgtgcgtgacctgcagcggctcgccgaaccgccccggaaccacctgcgatttgcgcccgatcagaccggtcggggtgtttggattgctggaatcgtgggaatcgctggtttcgtgctcgcgtatttcactcatgcctccaatatacccgtttcagcggggcaatcctcccagtcactggaaggattgggacgctgagcggcttgtaagcgggcagattctcccactgactggaggaatccacccgttgaaggcaaaaagaaaccccggtggagagaagaccaccggggagagaaaggagagagaagaagaaagggttcaattgtcgggaactgctgtgggttcctggtcggctcttttgctgacatctcctatataagcagacgatgctgagtacatgtctggcgttttctgggaaatatctgagaatttcaattccctcatgttttagattgtggaatggcctccagtttgccacgttatacgcgtgttccgtttccgcgcagttgtctcatcctccaggttcccacagttcgttcgcaaacaaactcatggcggatcaccggctcacgccagcttgctaaccccatcagatcagcggatgctagatctgcgcgtcggcgtccacgctcatcacatacacgttgcgtcgcagctgcttggattgcgcacgcgtaatgtcgcccgcctcgtacatgtcttggatcacacccagctcgataccgtagctttcgcgcttcacatcttccgcctgcgcctgcgcctccgcgctcgtgcccacattcgggcgcgacctcagcgtagcctcgcctcgtcggtaatccagcagcagtgccgaacaatgttccgtattgtatgtgtcacggcccatctcctcatacaggcggtcgattacatgttcgatggcatccacctgcaccacgcgggtgtgcgcgaacagctcgtcgtcgctgaacagcggggtagtgcggcgaatgcggctgttcacacgcttcaacatggtgcccatacgcctctgcaacgctctgaagcggcctttggctcgccagatggtgcgtccggaattatgttccgtttcaatatggcgcagtgagctcatgatctggtcgagcaggcgctcgcatgcttcgatttccagatcgtgcgctgccttgtcgtcgttcggcgtcgctttgactttcgccagtcgcgccttgacgtattccttctcccaattgagcgcatcgatctgcaattgcatatacccttgcggatcgatttctccgatgcgctgcttcagccgtgtaatacgtttcgtatacgagtcgatgatcatcagcaccgcacgacgattgtcgggtgtgactcgtcccgtcagttcctccacggtccgtcgcagcacttcgatggtgatttcagccattttcacggaagtgtctttattgcgattcggcgccagcagaggcagcaggaagttggcgagcagcaaggttacgacgatcacgccacctgcgatgaagatcagctcgtcacgcatggggaaccacgcgcctcccgtaatggtgtacgggatcgtgaacatcaacgacagggtgatggtgcctttcggcccgccgaacgtcatgaccgcggccgaacgccaacgttgcgccgtcatcttgcgtcgcttaccggtgacggtatctcgtgcgagacgcagcatcaacgaaatccacagaaatcgcatgacgatcaccactgcggaaaccgtaagaattgcaaccagcagccgccaattgctgacctgaggatcatcccagcttgcgctcatcgcattcggcagcagcatgccaagcagaatgaacaccgtgccgttgagcgtaaacgagaataccccccatacgcttgacgaaacaatgttggtgcgagcaacattcgggccgatgccggttcggtcgaaacggatgatcaaaccggccgtcactaccgaaagaatgccggaaacatgcaccgcttccgcacccaaatacagaatgaacggcaggaacaattccatcaaaatacggcttgtggtcgtctcccaaccgaaagatcgcaacgattcaaataacaggtcggcgatcatgcctactgccaagccgaaaatagcaccgccgaagaacgagaacacgaactgtatggcagaatcgcccacttcgaatacgccgctgatggccgctgcaatcgcaaactggaagccgacgatgccggacgcgtcgttgaacagggattcacccttgagcacgctggtttgccgttgcgtaagagcggcttccttgccaagcgaagatacggcgaccgcgtcggtcggtccaagcgcggcaccgagtgccaaagccgcggcaaggggaattgcgggccatgcggcatgcaggatgaaaccaacggctaccatcgtagcgatcgctagtccaatcgccaatgaaagtgacagtttaacggatttcaacagctcgcttttgtcgatttcatgcgcttccaaatacagcagtggcgcaatgaacagcaccatgaacagttccgggtcgagtgtgacgttcggaaaaaacggtaattgcgatgccaacgcacccaacgcgatctgcacaagaggcgtggaaaccttgggaatgaaacggctgataaaggaagacagcacaaccgcggcgataatacatacaatcaattcgaataccgccaacgtgcctcctttgcgcgcattttccaaactcttccagcctaccaagaggtatttatgggtgtgtttcgccttttgcttcacgtgaatggaaccgtatagtggcggatatgcagtggagtgacgacatgggacttgcgatcgagttggctcgtgaagccgcagcggagggtgaggtgccggtcggtgctgtcgtgcttgacgctgggggagcggtgattggtcgggggcgtaatctgcgtgaggcgcatgccgatccattggctcacgctgaggtcaaggccatgacgcaggccgctcggtcgcttggtacgtggaatcttgccgattgcacgttgattgttaccttggagccatgcccgatgtgcgccggcgcgtgcctgcaaacgcatgtcggacgaatcgtgttcggcgcgtgggatgccaagttgggtgcatgcggttcgatttgggacattccgcgtgaccctcacgtcggccatgttccggaagtcgtcggtggtgtgcgcgaaatggaatgcgcacgattaatgactgatttttttgctggaaaacggtaactcgattttgcagtcgcaagaaatactttccgaaagaaagaaacacgctcgatgacgtcaacaaataaagcttgacatattatcgaaggtgacaatacaaggcaatcgcaatatgtaaaggatgctgcaatgacgctcattcagaccttccatggcaacgctaccaacggtaccgaactcactgcggtctacgccgaacagccagccgcgaacgtggcgttcgcactcgtattccccggcaatgatctgccgcgacttgtgcactggggccgcccgctcgcagccccggcaaccgcgatcgacatgttcgacgcgcaaatgccacagcgcgtttccggcgcgctcgactacacctcatggccaagcgtactgcccacgcaatccgaatcctggattggcgcaacccgcttcgacgtacgccgcgacggcgtggaactgttctgcaagttcgcagtcagcaacatcaccgccgaaaccgtggcagctggcaaaacctacgtcatgggcgaaaaagacggatacccgagctggagcgtggccgacgaacccaagcagaccccaaccgttaccgtcaccgcagaagacgtggaacagcatgtgaaactcatctggacctgcgaactcgacgaaaccggcctcatccgtcagaacgccgaagtcgtgaacactggcgaaggccagctcgaagtcggcaagatcgaactcgcattcaccgtgccggccgacgccaacgaaatcctcaccaccaccggccaccatctgcgcgaacgctccccgcagcgccaggacttcaccctcggccgcttcgccaaagcatccatggccggacgcccagacttcgatgccaccctgctgctcagcgtcggcgaaaaaggcttcggcttcacgcacggcaacgtctactccgcacacgtggcctggagcggcaacagcgtgctctccgcggaacgcctgccatacaccagcggcgtgatcggcggcggcgaagtactgttcggcggcgaaatcagcctcgccaatggagagtcctacaccaccccatggctcatcggctcctacggcgaaggcctcaacgaagtcgcagcccgcttccacagctacattcgccgagtgcaccgcgactggcttgctgaacacaacatcgcgcccaagccgcgcccggtcattctcaacacatgggaagccgtctacttcaaccacgattatgacaccctcaccgcactcgccgacaaggccgtggaaagtggtgtggaacgcttcgtcgtggacgatggctggttcggctcccgccgcgacgacacctccggcctcggagattggcagatttcgcaggacgtgtggcccgacggcgacaagtcgctcaaggcgcttgccgattacgtgcacggcaagggactcgaattcggtctgtggttcgaaccggaaatggtcaaccctgattccgacctgttccgcgcacaccccgactgggtgttgaagcccaccgaaggccgtctgcccatgcaaggacgtacccagcaggtcgtggacctgaccaatccggacgcctacgactacatttacggcgcaatggacaagctcgtcggcgaactcggcatcgactacatcaagtgggatcacaacaaactcgtcaccgaagctgtctccccacgcaccggacgcccggcagtgcaccagcagacgctcgccgtatatcgcattttcactgatctgaaggccgcgcatccaggacttgaaatcgaaagctgctcttccggcggtggccgcgtggacctcggcatcctcgaagtggccgaccgcatttggggatccgactgcgtcgacccggtggaacgcgccgacatccagcgctacacctcgttgctcgtgccgccggaaatgatcggcgaacatgtgggcgcatccccggcgcactccacgcaccgcgccaccacgcaggaactgcgtatggccatggccttcttcggacacatgggcatcgaatggaacctgctcaaggaaccgcaggaagatatcgacaagctcgccgaatgggtcgccgaattcaagaagcatcgcgaatggttcgccgtagacgcagtcgtgcattccgacgcagccgatccggcagtgcgcttggacggtgtggtcatgcctaaccaagcggccgccatctaccgtttcacccagctcaccacctcgcagacctacccggccgcgccggcacgcctgcccggactcgaccctgacaaggtgtatgaggtgtcgccgcttgacgtgagcctcgacctcgccaagcaagacatcgccaacggacagagcccgctcggctggtggaaggccggaggcgtgaggatgaccggacgcgcgctcgccacgtacggcatccgcccgccggcactgcacccggcgcaagcagtccttttcaaggccgtgcttgcgcccgtcgagagcgctgaataagccgtaatcgcataacaaaaatcctccctgaacaaaagggaggattttttgtattgcaagacaatcaatcgcaatcaatcagccaacatattgccgaattgcctgtgatgcggccgccttggcccacaaagcccaatcgtggtcgggaatttcaaaatccactggcgcggcctggctatgccgatacatgttgatgccgttacgcaagtcgtcaatgccgaatttcgcgatgaacgacgattctccggcgatcatgattttgtctggcatggcaagattggcgatggtcgccaccagggtgccgagacggaagcaggtgcggttcaccagattcgtcgcttgcggtttgttcgcgcgtgcgtcacgtgcgaaatcgtcgaatgatgcgggatgtccgatgatttgcgaatattccgccgcgatcgagttgtcggacaggcattgcgcgcatcccctgtgtccggaaacacaacgcggcccatccggatcgaccagaatatgcccgaccaaaccgtaacttttatccggacagcttaccagctcgccgttgaacgtcaacgaatagccgacgcccgcgccgaacgtcagcaccgcgaagctatccaatccaacgcccggtccaaacaggcaggcgtcaaccaccaacgaatcgatatcgttgtaaattccggtaggcaatccggtcgcctcacgaaccatgacggaaagttccacgggctgcgaccagtgcatgaacggtgcgaacgtcaccacggtaccgtcgacaatatgcccgccaagcgagattcccacagcgcacggtttcggccagcccgccatctccgcctcgtcggaacagtcggtcgtcagttgtttgatcagcgcgaccacggtctgcggggaagcgtcttcgattttcagatcatggcatccggtgatgatctgcccgattgcgttgaccgcaactgccgaaatatgcgtcgcgttgattttcatgccaacgaaagatcgcgcattcgcaatcacctgcaatccggtttgcgggcggccgcgacgttccgtattttctttctgcacgaaacctttcggcagtttgccggccttgccggacggcatcggcgtctcctcaatcacgcccgcataaatcagatcgctggtaattcgggaaacagcaccctgcgaaagtcctaaaatctgcgccaacgtaatgcgtgaaatcggaccatatttcatgatgcaagccgcgactttatgggtatattccgagccttcaaaccactgtggcagaggtgaaaccgccatctgaaccatccttcgtgctcccgttcgcgcacatcgtgcgtcaaattactttctcagagtaacaaaatctcgtcgtttttgttttccgccccgcacaggcgcgctgagttgggaatgaaaaccgcccccctctataattctcagtaacggtggtgtggtaaggaagctgctccaccgtgatagagaaaaaatacaaaggagtcgagaatgaaacctgattccaccactagtgtaggtaaattcaggaggattgtataccgcgctctcacggccacatgcgcaatcgcgttgacggccggccttgcaggttgcggcaacagcaccgctggaaccgtcactttggatttcttccaattcaaagccgaagcagcggactggttcaccgcaaaagcaaaggaatttgagaaaacccatcccagcatcaaagtcaacgtcaacaattcgtccgacgcaaccaccgatctgcgtacgcgactcgtgaaaaatcgtgaacccgacgtcatcactatcaatggagacattaatttcggtatgctcgccgaagcaggtgtcttccacgatttcaccgacgacgccatcgtcgacgaactcaatccaggcatggtgaacatcgccaagagccttgtacaaaccaacgacaaatccaagaagcgcctgtacggcctgccgtatgcgggcaacgcatccggctacatcatcaacgccgacgtgtgggagcaggcgggtgaggatcccgacaatccgccgcagacatggagcgaattcatcgacctgctgcaacgcttcaagagcaagggtgttgtaccgatcgaagcgagcaccgccgattcgtggacacttcaggcgccgttggcgtcactcaattccacgctggtgccggaatccgaatatctttccctcaaagacggatcgaagaaattctccgacctgtggggcactgtcagcgatcagctggtcgagatctaccagaattatacgcagaagaatccggcagtcacctaccagcaggccacgcaggatctggccgcaggcaaagccgcgattctgccactcggcacctacgcgattccgcagattcgactcatcaacagcgatgccaacctgcggttcgcgcaaatgccggcaactgataatgccgaagaacagcaactcaccgcaggcgatgacgtgatcctgaccatgggcgcacacaccaagcacgagaaggaagcgcgcgaattcatcggcttcctgatgaacgacgaaaacatcaaggactactccaagcagcagtccgcctttaccccctacaaagacacgtatgtgggcgatgaagcgctgaacggtgtgcttgacttctaccaggcgggcaaactggccgacttctgcgaccattacgtgccagccagcatcaacatcgcaggcttcctgcagacgctggttcagtcgggcaacaccgaaaaattcctgaacagcatgcaatccgaatacgacaagatcgaagccagaaacttcaggtgagaggaggaacggacatgactaccgcacatactgcaaatactgcgaagaaatctgcaaaaacttccaagaataaggtttcgaaatattccaagcgcaaggtcgatccggcattttattggatgaccgttccggctgcgattctggtgtccatcttcctgtattggccgttcctgcagggcgcggcatactcgttcactaattcgcagggttacggtgattttaaattcatcggattgaagaattatattgcgatgttccaggattctcgcgtcggtcacgcgtacctgttcactattctcatcgcagttttgattacgctcggcacgaatattctcggcatgttcctggcggtgctgctgaattcgaaaatcgcattcaaaaatggattccgtgcgattttcttcattccgtacaccctgtcggtgctggtgatcggctacgtgttcaagtacattttcatgacgccgctgccggcgctcggccaggcgctgcatattgattggctgtcgacgtcgatgatttccaatccggatttggcatggttcccgattgtgttcctgtcgatctggcagggcgttgcctactccacactgctgtacttggctggcctacagaccatcgacaacgagatttacgaggcggccgcgatcgacggtgtgaacgcttggcagaacttctggcagatcaccttcccgctgattggcccgttcttcaccatcaacatggtgttgagcctcaagaattcgctcggcgcgttcgaccagatcatggcattgaccaagggcggcccggattccaagaccgaaaccgtctcgtatctgatcttccagaacggccttggcaatggcgaatactcctaccagatggcgaacgcggtcacgttcttcatcgtgctggcaatcctggccttcgtgcagctgaagttcttcagcggcaaggaaaaggtctgagcaagggtctgaaagtctgaaggtaaagaggaaatatcatgactagcgcaactgttgcaaagactgcaaagactggcgttcaagcgcaagcaaagccagagaaaatccgcagggatcataaggtcaactggtggctgaccgcggttgtgacggtgttgagccttaccgtgctcgtgccgttgtatttcgctgtggtcaccgcgttgaagacgccgggcgaggctggcacgttcagcttgccgaccacgtgggaatggcataatttcgccgacgcatggaataaggtgaactatccgaaggccgcacttaactccgcgatcatcaccgtgtgcgcggtggtgttgacgctgctgacgaacacgttcgtcgcgtatgctgtggcacgaaatatggataagcgattcttccgcttcctgtattacttcttccttgcgatgatgttcgtgccgttcacggtgatcatgctgccggtcgcgaaggaaatgggtacgttgcatcttgataatcagcttggtttgattattctgtacacgattcttggcatcggcaccaacctgtttattgcgattggttttattcgttcgattccgatttcgttggaagaggcggctcgtatcgacggtgcttccacctggcgtattttctggacaatcattttcccgctgatgggtccgattaatgccacgattgcgattttgaccgcactgtgggcttggaacgacttcctgctgccgttgatcacgctgactgatcagagcaatcagacgattccgctcgcacagtacgtgttccaaagccagttcacgtcgaactatccgatggccttcgcgtcctatctgatggccatggctccggttctcatcgtctacatcttcgcccagaagtgggtcgtcggtggcgtgatgaggggagccgttaagtgaacagcccagtggtctgttcataggctctccctgagcgagccgataggcgagtgaaggcagggacaacgcggccgtaggccgtccgttcaggaagtaacacttcaccgctctgagcgggactggcctatcccactccccagcgcgggacgttccatttccctttctggaacgtcccgcgttttttatttttgcggattggtttttcgcgtccgtaagaagcgtattcttttcttgctttgcacaactcgccgcgggaaagaaagaaaaacagggttgcataccataggggagtaggcaaaatcgatcttctgcatgaagctgacatgagctgaaaacgggcagagtcagtcacgaaagatcgaacgaaaatctaacaaacgtcaagcaaaggagctccacgacatgacgaatttcaatcgttccacccttcccgacaccgtgcgttccaacggcgcgaccccgaacccgtggtgggccaacgcggtggtgtatcaggtgtatcctcgttccttccaagacacgaacggcgacggcatcggcgatctgaagggcatcaccagccgtcttgactatctggccgatcttggcgtggacgtggtgtggttgagcccggtctacaagtcgccgcaggacgacaacggctacgatatttccgattatcaggatatcgatccgctgttcggcaccttggaggatatggacgagctgcttgccgaagcgcacaagcgcggtctgaagatcgtgatggatttggtggtcaaccacacgtccgacgagcatgcttggttccaggcttcccgcgacaaggacgatccgcatgccgactggtattggtggcgtccagccaggccggggcatgagccgggcactccgggtgccgagccgaaccagtggggttcctatttcggcggttccgcttgggagtacgatccgaagcgcggcgagtatttcttccaccagtattccaagaagcagccggatttgaattgggagaatccggaagtgcgcaaggccgtctacaagatgatgaattggtggatggatcgcggcattgacggcttccgtatggatgtgatcacgcaggtttcgaagactgttgataagaacggcaagctgccgggagaagacggctgcgagattgaggattatccggttggtgaggaaggctattccagcccgttcccatggtgctccgacggtccgcgcatcgacgagttccttgccgaaatgcgccgcgaagtgttcgaaggccgcgaaggctacatgaacgtcggcgaagcgccgggcatcactccggcacgcaacgagcatgtcaccgatccgaagaacggcgaacttgacatgctgttcctcttcgaccacgtgggcatcgaccaggaaggttccaagtggaacaccgtgccgttcgaagtcaagaatctgcgcgcccgcctcgccgaccagcaggaggctgtgaagaacgccggctgggccagcctgttcttctgcaaccatgatcagccgcgcgtcgtgtcccgttggggcaatgacacggaccgtgagtcgcgcgagctgagcgccaaggcgttcggcatgctgctgcacatgcaccgcggcaccccttacatttacgagggcgaagagctgggcatgaccaacgcacacttcaccacgctcgagcagtaccgcgatctggaatccatcaacgcctaccgccagcgcgtggaagaagcaaaatgccagtccgcagaatcgatgatggcggcgctcgcgctcatcggacgtgacaacgcacgcacgccgatgcagtgggatgcttccaggtatgcaggtttcaccgcgccggacgcggcgacggaaccgtggatcggcgtcaatccgaaccatgtcgagatcaacgcagccgaggaattcgacgatcccggatccgtgtacagcttctacaagaagctcatcgccatgcgccacaacaacgcgaccatcgcgacgggcgaatggaatctggtcgcggcagacagcgagcaggtgtattccttcacccgtaccagcggcgacgacacgattctcgtcatcgtcaatctcactgataggacggcgcaggtgcctgctgaggtcgcgcaactgcttgaggatggcgtgggcgagtcgcaggtactgctcagcacctatgatgccgtgcatagcgtaaagtcggtcgctcgcggcgagctcgctcgctgggagggggtcgtgatccagctctgatcgatctttcctataaactctctgcaaaaagcgttcgtgcgattcatcacgggatcgtacgaacgctttttctttatttgtattgtgatttatcagattatgtattgcgattattcctgattgcttgtgattacttttcgcaagcaatctcacttttcatcgcgaaagccgcatgataaggcagtttcggcagacgtacgcttacaataacgctcatggaacaaaacgaggttctcaaagcattgcagcgcgatcacgcagctgaactgaaactagccgccgaacgactcaagggcactgcgcgccacacggaaatcattccgtccaaggtgctgtccgacatgaccggacatgagattctgctcaagcctgagaatctccaggtcaccggatcgttcaagattcgcggcgcctacaacaagatcgcatccctgagtgatgagcagctggctcgcggcattgtcaccgcttccgcgggcaaccatgcgcagggcgtggcctatgcggctcgcgaacgtggtgcgaaggcaacgatctgcatgccgcagatcactccgccgctgaaggttgacgccaccaaggcgtacggcgcagacgtggtgctgtacggcgaggtgttcgacgaatccgcagcccgcgcccaggaattgagcgacaccgaaggcatgatctacgtgccgccattcgacgattacgaggtgctgtgcggtcagggcaccatcggccttgaaatcctcgaagacgtgccgaacgtcaccgacgtggtcgtgccgctgggcggtggcggtcttggtgccggtgtggcgctcgccatcaagacgttcaagccggaagtgcgcgtgatcggcgcgattccggagggtagcccagcatggaagaattcgctggccgcaggtcatgtggttgccgccgaccaggtgcgcacgtccgccgagggtgtcgccgtgaagcgtccgggcgatctcacgttcgcgctgctcaacgaattccttgacgacatcgtcaccgtgaccgagcgtgacatcaacgagatgatcctgctcatgctcgaaaagcacaagctggtggttgaggctgccggcgctgtgtctctggctgcgctcgagcacctcaacctgcgctcgcgcaagttcgctgaggcgaagggtccgcatgtggtggtgccgatcatgtctggcggtaatgaagacactgtgtccattggcgctgtgattcagaagggtatgatcacgcgtggccgcatcatgcatttcgaggtcgagctgcccgataccccgggacagctggtgaaggtcgccacattgctggccgagcagcgtgcgaacgttatcgcgctggatcacgaccagttcaaggcgtccagccattacgcgaatgccgtggctttgggcgtgacggttgaaacgaatggtcccgaccacattgatcgtgtgctcgaggcattgcgggaagccggtttccagccgaagcgcatttactgatttcagtaccgtttttcagtatttgataaccaataagggtcttggaaagccttgcgatgatttctgattgtcgcaaagcaatccaagacccttttgttgtttatattgcttgactagccgttacgtcattcggatttttgtcgttgaaaaattcggattttggtaacgaccaaccaaaaccggtgtaattccaacgatttgtgccggtactgcaagacgtacgagaaaacgtatttactgtgcggcttactgctcggcggtgatggtttcgtcgacgagctgcggcagggcgacggcgatatcgtcgtggataagccggtcggccaaccgatcgtattgcgtgcgtcccatgttcataatggtgatcggcacgcccgcctctgcggctatgggcacgatgcttgccgcgggcatgacttccagcgtggatccgatgacccacagttcgtcggcctgcgttgcgagtcgatacgatttttcgagcgcgccgtccggcagcgcctcgccgaagtagaccacgtcggttttgatgagtccgttgcatggcatgttgccgctgtagggcagtctgcgatggcagtgcggatcgggttcgttgtcgagattcgccatgatgtcggcggtgtcatattttgcatggcacttcatgcagtgcgaggtaccgatggtgccatgcagattgacgatgacgtcgctgctattgccggctttttcatgcaatgcgtcgaagttttgtgtggcgagcagcgtcagcatgccagcctgttccagtttgacgagcgctttatgtgcggtgcccggctgtgcggtccacacgggtgattccttctgccaacgccaggaatacttgcgatcttcctcgtggcaaaggaatgcttcgatgtcatacactttcgtttgttcagggtgcttagtccagacgccatccggtccacggaagtcgggaatacctgcggacgtggaaatccccgcccccgtcaatactgcgatctttttgctcatatcttaggtatagccgcacgacgtaacttctgatgtttcacgtgaaacagggaacatcgggcaatcaaattcgagaaaagcaatcttaataatcatgcatggaaaggaatgagaggtgcattatgactactgatattgcacaaaacattgcagatgatggcgctgatgcggccgagactgccgaaacgaccgagacggttacggcgatcggggcaatcgatatcgaatcgatggtggcgccgccgtcgccgacacagcttgccccgattccgacgccgcgagcagactaagttcttcccgcacactgatgagtttccggaaggctgccgagtgatttccgacttggaccaggatgattttggatatcccgtgaatatcgagcaggttacatacgtgacccgtcagctggctgatgacaccagtgttgatttgccgatgtgggtattcatgcctggcgttgacaatatgcccgagggcgcaatgccggaaggtggttggccggtgattgtgtttgtgcgcggttcggcattccacgagcagaatgtgaccgattactcgaattatttcgtgcgtattgccgagcaggggtatgtggtggctgcgctgaagtatcgtcacagcgatattgcgccgttccccgcgcagatgcaggattgcaagactgcggtgcgtttcatgcgcaagaatgccgaacgcttccattgcaacaaggatcgtattgcgctgtggggcgattcttcgggcggtcatacggtgctgatggctgggttcactggcaatcgcgcgcctgatacggatgcctatgccgaggaaagcgccgaagtgaacgcgatcgtggattggcatggccctactgatttcgcgaagatgaacttttatccgagttcgcagaaccacagtgatccgcagtgcccggaaggtgtggtgattggtggcgttgacgtgcttgaacatccggatttgagcgcccaggcttcgcctatgacttatctgagtgccgatatgcccactccgtcaacgctgatcatgcatggtggccgcgatcagttggtgccgttcaatcagagttgtcgcctgtatgccacgttgaaagcgcttggcaaggatgtgacgttctacaagctcgataacgcctgccatgcctgttacggattccgtagcgcttgcgcgttgcgtttggtgttcgattggctttccgatcgtctgtgacttgctgtgatgcgctgttgatctgctgattgccgtgttgttgcgttgtgtgacacgcggcaatcagctttttctgacgatttttgggttgtgctggagttggttttgcgatttatggtgtaagaaagacggatttcgacacgccgacgctttccagtgtttgcaagggttcgcgtcttgtttcgtcatgcctgatttgcgtggaatgggattgtgctgtaggtttatctcttgctgccgctcggcgagtggttccccggttggggtgcctcgaggcgggtgagcggtggtggtttgagaactcaagagctacagaatcgggatcacgaacacgaacacgaacaccaacgcgaacggccacatgaacttccaaccacgccaatccgccttgtgtttattgacacgcacggttgccgaatgcagtggcatattggcaacaacttccgttgctgacatcattcctctccttcgaggcaataccatttcacagggcaatttacacccccgtaaaacagctccttccaaatgtttgcgttatcataataacaccatattccaaaagtgtctacttttcgcacattctagaccacatattcacttcatcgaacaaattgcatggtgacgaaaacaatacagaagtaagcatgtaaaattaagcacagtacgcattttcgttcggaaggtagatacacatggcacgcaactcagtctcgctgcaagacgtcgccagggaagcaggggtttcaccgcagaccgtttcccgagtggctaatgggagcgatgccgtacgcccagcgacgaaacttaaggtcgaggcagccatggagcatctcggatacaggccgaattatgcggcacgtgctttgaaaagcggacatttcaacaatgttggtgtactgctttcgcatatgtcggcctacgggaactcacgtatcctcgaaggcatcactacagcggccgcgaatagcggctattccatcaccattcgccccttggataacctgcaggatcagtcactcgccggcgcactgaaacttgtggaaggcctccccctcgatggtgcaatcgtgattatggaacgcgatttcaccgacttcaaccagttcaagccatccgacaacctacctgtagtgcttatttgcgaggaaccggcaaaccactgccccaccatcgattcggactcgtatggttgcgccactgcagccgtggactttttcctgtcgaaggggcataaaactgtgtaccacatcgcaggccccaccgtttcacgcgcagcacagagccgcatcagagggtggcgcgacgcattagcgcaagtcggcattcccacaccacccatgtattacggcgactgggaagcagatagcggctaccaagccggattggccttggctcacgaaaaggattgcaccgcaattttcgcaggcaacgatcaaatggcatacggtgccatgcttggactgaggacagcaggaaagcgcgttcccgaagatgtcagcatcatcggtgtggacgattcactccgcggcgttgtgccccgtcttgaactgaccaccatacggctcaagctcagaactgtgggaaaagaggctttttccatgatcgagcaacaatgcaatggcaaaaaagtgccttctggaatcaagaaacttatcacccccgaattcatcgaccgcggatccgtggcggaactcgactaatcgcaatatctcgcgactttaatcaacgcaatcaatcaaatcagccaatacgaaaagcgcctctccagcgtgggtgaaccacgtgggagagacgccttctagattgaacgaaaagctgaaatcgggtgaaatcaggcttcgatgccgagctgctgacgttccttcttggaatacatgaacgccggaagctgacggccctgcttgagccaagcatgatattcggcggttgccgcaaactccacgtcggaagcggaattcagacaggtctccacggaatcctggatgacgccgatgatgaagccaacgcccaccacctgcatggcgatgtcattgctgatgccgaacagcgagcaggccattggaataagcagcagcgagccaccggccacaccggaagcgccgcatgcgccgagcgccgacaccacagacagcagaatggcggccggcaacgaaatctgaatgcccatcgtattagcggcggccatggccatgatggtgatggtgatggcggcaccgttcatgttgatggttgcgcccaacggaatggacacggaatacatgtctttatcaagaccaagcttctcgcacagctgcatgttgaccggaatgttcgccgcggaggaacgagtgaagaatgcggtcaggccggattccttgaagcagcggtacaccagcggatacgggttgcgatgcaggtacaggaaaatgaccagcggaccgaacacgagcaccatcagcagcatggtgccgacgagcaggagcaggaggctaccgtactcggtgaaggccgccaagccgttttcggaaacgctggtgaacaccaagcccataatgccaaacggggcgagattgatgacccaacgaatcacctgagacacgccatcggccacattggcaaggaacgccttggagctttcattggcaatacccttcatggcaagaccgaacaggcaagcccacatcagaatgcagatgtagttgccgtcgatcatggcctgaatcggattggccacgatattggtcaacaacgtctgcacaacctcgctcaagccctgcggcaccacatcagcgtcagcggcatcgcccaacgatatggtctgcgggaacatgcgagacgtcaacaccgccacgacggcggacaggaacgtggtgaacagatacaggaaaagcaccgtgccgaaacggccgtcaagcttggaattgccttgagccaaagcgcttgccaccagcacaaacaccagaatcggagcgacggccttcaatgcgcttacgaacagggtgccgaattcgctgatccacgtcatatgcggaacaaccaatgccagtgcggtacccgcgataagaccgacgataatgcggataatcagtgatacgccgttatatttgtcggcaacgccacgaagcgcttttgaaatatggttcatattctctctcgttctttccagccggcttgcctttgccagccagcacaacaagagcacatcctaatcacgctcgataacacgaaatgtaaaatgtccgattatagggacgcgcaacttcaacacgccatagcgatgcgagcaaatatgagtacagcgatggacagtttttatatatcttgattcagcgagcaatacctgctgatcagaccgttaatcagccaagcggcactttcgaaacgaatgtacgaggctctcccgtcaccggatcgtcgaaacgtaactcacgagccaccaattccaacggctgcgagaaatcatcgtaagaacgctgcacaatattcgggtagaaatcatcgcccaaaatcggcaatcccaacgaattcatatgcacacgcaactggtgcgttttgccggttttcgggtgcagcacgtaattcacatatgctttgccgtcgaggcaacgtaccgtacttccccgctcaatcaacgtttgcgcattgatggtttccggaatttcgtacgcctgaagtcgcccgcgatccttgcaaatatgcgatgctcggattgccggaaagggttgatgcctgtcgattcttacgattgttccgtactgcggatgctgttcgggggcaagtggcgccaaacattcataggttttgatggttttgcgattctggaacagcatttggtaagcgccgcgcaattccggtttgcgcacaaatacgatgatgcctgcggtaagtcggtccaaacggtgcgcgggaacaatatcaggttcgccatactgttcccgaagtcgaatcaacgcggtttcgcgataccacatgccacgcggtgtggtggcgagaaaatgcggtttgtcaaccacgataatcgcatcgttctcgtaaagaacctcacattcgaacggaatatgaggttcttcaagaacgtaacgatgcctcttctgctgacgctgttgacgcatcgtatgaacgattactccacggtgacggacttggcgagattacgaggcttgtcaacgtcgtaattcttcagcttggccatgtccatggcgaatagctgcagcggcaccacgtccaccaacgggctcatcagcgtcgggcaggccggacgccagaacaccacgtccgcatagcgttcaacatcggggtcgttctcttcggccacggcgataatgtacgcgccacgggccttgacctcttcgataccggaaataaccttggcgtgcagcacattgcggccacgtgccggcggcacgatgaacactaccggttcgccttcgtccaccaatgcgatcggaccgtgcttgagctcgccggccgcaaaaccttcggtgaaggtgtaggcgatttccttcaatttcaacgcgccttccatcgcgaccgggtagccgacatgacggcccaggaacaggaaggacttcgcatcgaccatctgcgcggcagcatcatgcacggtcttggtctgcgtatcaagaacccactggatcttgcgaggcatgtctttgagggaatccaacgcctgcgcgatctcgtcgcggaacatcgcgcccttgacctgcgccaaatacaagccaagcacgtaggcggcagtaatctgcgccacgaacgccttggtggaggcgaccgccacttccggaccagcgtgcgtgtacagcaccgcgtcggattcacgcggaatggacgcgccctgcgtgttgcagatggccagcaccttcgaaccctgctcacgcgcgtgacgcgatgccatcagcgtgtccatggtttcaccggactgcgaaatggccaccaccaacgtgcgcggggtgagaatcggatcacgataacggaattcgtgggcaagctccacttccaccggaatacgcacccaatgctcgatggcgtatttggccaccatgcccgcgtaggcggcggtaccgcaggcgatgacgataatcttgtcgatcgccttgaaatcatgctcgtcgatgcgaacctcgtcaagattgagattgccgtccttgccaagacgtcccaacagcgtgcgctgcaccgccgccggcccttcgtggatctccttgtccatgaaggagtcccaaccgcccttttcggccgcggaagcatcccaatccacggtataggtcttcggatcggccacgatgttgcccatgaaatcagacaccacaaccttatcggcggacaccatcacggcctgatcctggtcgatttccatggcacgcttcgtgtaggcgacgaacgcggccacatcggaaccgagaaaattctcaccttcgccaagaccaaccaccagcggcgaatcatggcgagcaccgaccacgatacccggctgacggcagtcggtggcgagaatcgtgaacgcgccttccagcatgcgcgccaagcgtcgcacggccttgaacagatcaggcttgccggtttcctcaacgattttctcgctgattttgcctagcagtttcgccgcgacctccgtatcggtttccgatgagaaacggtaaccttccgtctgcagatcaagacgcagctgagaggcgttttcgatgatgccattatgaatgatggcgaccttgccgtcacgcgaagtatgcggatgcgcgttgatgtcattcggcacgccgttggtggcccaacgggtgtggccgatgcccacggtggccatcggcattggattgcgttccacgtcttcgattagattggcgagacgccccgccttcttacgcacttccacatgatccatgccgggcgcggtcagcgccacaccggccgaatcatatccgcggtattccaaacgctggaggccttggaggcacacttccaacggcttgccgcacgcggtttccacatttcctgcatatcctacgattccacacataacacctcagcttatcgggtaatggtgtcattttcgaaacgaaaccgtctcatcgcgctgaacctttgatatatgaacacaaaaatccccatgctgacagttttcaacatggggattttctcagccattcccttgatcgcaatccttacgacgaagaggtgtctgattcttacgattatgcttgcggcgatttacagcacgtgctgcaggaagtccttgaatcgtggttcctgcggattgtcgatgatttcaggaccgccctgttccacaacaacaccgccgtccatgaatacgatctgatcggcgacttcgcgcgcgaagcctatttcgtgggtgacaaccaccatggtcatgccttctttcgccaaagacagcatgacgttcagcacttcgcccaccaattccggatcgagtgcggaagtcggctcgtcgaacagcatgatttccggcttcatggcaagcgcacgggcgatggccacgcgctgctgctggccaccggaaagctgtgccggatagtgatcgaggcgatcgcccatgcccacgcgattcagctcttcgatggcaagcttgcgggcttcctttttatccatgtgcttgacgtggactggcgcttccatcacattttcgagcgccgtcatgtgcgggaacaggttgaacctctggaataccatgcccagtttggaacgctgctcggccacttccttgtcgttcagggtctgcagcacctgcttgccgtccttgtcgacgtacttgtagccgatcatttcgccgtcgacgtcgatttcgccgccggtcagcgtttccaactggttgatcaaacgcaggaacgtggattttccggaaccggaaggtcccagaatcaccgtcaccgagccgggcataaccgtcatatcgacgcccttgagcacgtgcaggctaccgaaagccttatgcacctgcgtggccttcactgcgggaacaacaccgttggtggttggttcagtcattgctcactcccctcacgcggtcatgcccgcgaacgttgcctcgttctgcttggcgatatcgtctttcggctcgccttcggttttgcccggcagcggcggctgcttgccgcgcgcgccggccggtcgcgcatcgaagcccttgccgaaatgcttctccaggcgagattgcagcaccatcagaatggaggtgatcaccaagtaccagatgcaggccacgatcagcagcggaatcggcttgtacagtcgggttgcgattgcggtggtggcgaactgcagttccagcgtgaacggcacggcgttgaccagcgaagtggtcttcaacatgccgatgaactcgttgccggtcggcggaatgatgatgcgcatggcctgaggaagcaccacacgacgcatgatcatggaacgcttcatgcccagtgccttggccgcttcggtctggcccggatcgacggcttcaagacccgcacgcacgatttcagccagatatgccgcttcgttcaatgcgagacccagccatgccgcgttaaacgcggtaatgacggactgcgagtcaatgctccagaattcaatggaagtgaacggaatacccacgccgatgcgaggcaccaacacggcgaacagaccccagaacaccagctgcgtatacacaggggtgccacggaagaaccaaatgtagaaccagctcacgccacgcagcaccggattgatggacttgcgcattacggccagaatcactgccagaataatggcgatgcccatggagatgaccgtcagcagcagcgtgtatttgatgccttcgagcacattctcgttgaacaggtacttccagaccacattccattcgaaacgcggattggtaatcaggccctgcagcagcatggcggcgagcagagcgacgacgaccgccgccacaatcgggcccgtacgcttaaccggcagcgccttgatgcgattcggaatatcgaggccgtcgccgtcgatttgtttcttcgccatgatgcttcagttcctccgttgttgatgtaaatagtggggatgaaatcagtcgagatcggtcgggttgatctcagccttgtcgagagcgccggattccacaccccaatgcttgaggatcttcatatacgtaccatcgtccatcagcttctgtacggccttctgcacggcttcagcaagctgggtgttgcccttcttgacagcgatgccctgcttggccacaccttcgacgtcgcccaaggcttcaagctgtccgtcggtctgggagatggcatagccggcgaccggagaatcggcatagaacgcatcggccttgcccgtcgccactgcggtggccgcttcggcctgacgcttgtacgacatcacttcggccttgttatcggcctcgcatcctttggcgatggtgttggcttcctcttcctgcacggtgccggtctgcaccgcgatcttcgcgccgcacatgccggaagtgtcaagcttcttcggattgcccttcttcacggcccacgtggaacctgcacggtagtagctcacgaaatccacggactgcagacgctcttcagtgatggtcatggcggtgatgcccagatcatacttggagccaatggaaggaatgatggtgtcgaacatggaagacacgatgtttggcttcaaaccaagcgtcttggcgatggccttggtcatgtcgatatcatagccgaccggagtcttgccgtcttcggcatagaattcagccggagcgtacgaaagctccataccggcggaaagctcgccgtccttcaccagatcgccggacggaaccagcttggccagctcgtcatcttttttaatggtgctgacatcgtaaccggtggtagcgttcgacgaatccgacgaatcgccggaattggacgcctcggaggtgccgcaagcggcagtggaaaacaacatcgccgcactcagcgcaagcgccacaacggacttgatcttcaaagacatggtatgcatatccttcttcttatctcttcattgccataccgaaaatctcaacgccattcggttgcagagaacctcagtatctcaaataggcacgataagagcgcaatgctacatgtacgttacattgcgcaaaccttacgtatcagccaagaatcgcgcaatgtagctccgtcgaatcacggaagatccatatacgaaaacggaagacacgcggatttgacccgcatgccttccgtcatatcggcgtcacagtatcgccgtgtgcgatgtctgccttacgtttgatcgttcagtcgaggtcagtcggattgatttcggctttgtcgatcgctccgttctccacgccccaatgcttgaggatcttcatatacgtgccatcatccatgagcttctgcagtgcggcctgcaccgccttggcggtatcggaatcgccctttttgattgccacggcctccttggtcacgccgacatcctcgccgagggcttctagcgtatcttcggtttgcgcgatggcatagccggcgaccggcgaatcagcatagaatacgtcggccttgcccgtcgccacgttcgtggtcacatcggtctgcagcttattcgacagaatctgcacttcggacttgccgtcggccttgcattgtttggcggccgcgttgacttcctcttcctgcgtggtgcccgtctgcaccgcgatcttcaagccgcacaggtcggaagtggcgaccttgttcggattgcccttcttcaccacccacgtggaaccggccttgaacatgctcacgaaatcgacggcttccatacgctcgggcgtgatggtgaacgacgaaatgccgatatcgtacttggtgccgatcgacggaatgatcgaatcgaaattcgacgtttgcggcacgacctcaagaccgaacatattggcgagcgccttcgcgatatcaacatcgaagccgaccggggtcttgccatcctccgcaaggaattcggcgggagcgtacgacgtgtccatgccgacggtgagcttgccgtccttggtgactgattccggcagcatcgcggctatatcgtcatccttcgtcacgccggaaacgtcataaccggtggtgttcgacgacgactcagaatcactggaagccgcggaatcggacttttccgatgtgccgcacgcacccaacgaaacgatcatggcggcgcttagtgcaaaaacagcgagtttcctcagattattgaaagccatcgcggatcctctcttcattcccaaccgtatgaatacggccgaaccgaagtcctgcaggcaccatagaaaacgattgctacggccacgttaatagtacgcaaactctattcgatatgccgtttttccttacgaaaaagcgggttttgccatatcacaatatgatcaaaacccgctttgttcccagcacgtcgccagtcatgcgatcattgaaccgtctgatccgtggacggttcaatcatggaattattcggcgcccggcgtattgatttccgacgtttcgatggcaccgtcctcgacaccccaatacttaaggatcttcagatacgtaccgtcgtcgatgagcttctgcacggccttctgtacggcctcatccatctggctgtcgccttttttgatgacgatgccttccggagcgacgccttcgaccttgcccagcatttccagctgtccatcggtttgcgcgatggcatagcccgcaaccggcgaatcggcatagaacacgtcggccttgccggtgacaacgttcgtggtcacatcggtctgcagcttgctggagatcacttcaagcttatccttgccgtcggcctcgcattgcttggctatcttgttcgcttcggtctcctgcatggtggcggtctgcacggccaccttcttgccgcacagatcggacgtgtcgatcttgttcggattgcccttcttcacggcccatgccgatccggcatcaaaatggcttacgaaatcaaccgcttccaaacgttccttggtcacggtgaacgacgaaatgccgatatcgtacttggatccgaccgatggaatgatcgaatcgaaattcgcggtttccggatccgcttcaaggccgaacacctgcgccaaagccttggcgatatcgacatcgaagccgaccggggtcttgccgtcctccgcaaggaattcggcgggagcgtacgacgtgtccatgccgatggtgagcttgccgtccttcgtcacataatcgggcaacagtttggcgatgtcatcgtctttctgcaccgacgaaacgtcataacccgtcagttcgctcgctttcgaaccgctatcggacgaagccgcatcgtcgcttccatcactggtgccgcatgccgctccagcaaacagcatcgcaacgctcagcgcacacgcggcaaccgccttcagacttttcttcgcttccatatccttctcctatgtctcgctcggtctattcgaccgaatctgaaccatacactagagagggcaagctacaaaaagattacggccaccgctgtatatcagtatgtgaaaccggaaattttccggttaccacttatcgcacctgcttgttggcatatcgcatggcacgcaaggcctcacgcttgtcttgctcctcgcgcaatgcctgacgcttgtcgaattccttcttgcctcgtgccaatgcgatttccgccttgactcgaccgtctttgaaatacaggctcagcggaatgatggtgaaacccttggcttggctttgacgagccagcttgtcgatctgcgccgcgtgaagcaacagcttacgcttgcgcttaggggcatgattgttccacgttccgttgagatattcgggaatattggctccctcaagccacatttcaccgcgacggtcgatggtaatgaacgattcggccagcgatgcgcggccttctcgaagcgacttcacctcagtgccggtcaacaccagaccggcttcatacttgtcttcaatggcatagtcgtggcgtgccttcttgttttgcgcaatcggcttcacgccttgctccttggccatgtcggacctcctttccggttcttcaaagaagtgttctgcaacgcaacaatcgacaatatcatgggagcgcgccgcccaacgattcaggcggcgcgctcccgcgacacaacgctcaaggaaagctcaaacgccccttgatgaatcagtgcacataccagaactgggacgcgttgtacagtgtgcggtacgacaccacatatgggccaccagccgcgttcatttcggaaatggtgatggtgttgccattcaccgcttccaccacacccacatgaccgtagaagccatcggcaccagcctgaccgggcaggaaggagattgccgcaccgacctgcgggctatgatccacgcgaagaccatacgacggtgcggtagcgtaccactggccaccgttacccaagtacgagggggttccgatacccatctgtctacgacgttcgtacgcccaccacgtgcactggccggccacgtagccattgccgtaatcgccattggaggttccctgaccggaattgttattggtactcggcgcgggagcaggcgtaggcgtaggcgtaggcgtaggcgtaggagcaggcgtcacattgttgccgccactattggtattgttgttgcctggccgggtctgcccttgattgccaccattgttttgattagctgctgcggcctgctcggctgcatactggcggttgaaggaatcgacctgtgactgcaacataaccgtttgcgccgcctgtttggccacgctgccgttcagctgcgactgttggctttccaattcggcacggcgggtttcgccttctgcacgcaactggtcaagcgagtcgcgctgggtctgtgcggaagcagcagcctgctgtgcggaagcggctttttcgtcagctgcggttttcagattggcgatctgcttctcgattgcagaaagacgctcgctgcggttcatcgacgtgttcaacgtattcgccgcatcacttgccgcattggcttcggtacggctcaacgcatcacgagactgcatggaattaatgaattcctgagtgctcgtggaacctgtcaccacgctcatcacagtggatgcatcggaaccatgcagatcttcacgagccatctgtgccacggccgcatgcgcgtcatcataatccttgccggtctgttcgatctgcgcttcgaggttttccttatctttttgcgcggcctccaaacgggaagccgcagcatcagcttcactctgtgccgaagcggcagtagcatttgcctcatcgactgcagcttgagctgcaggaattttcgtatttgtcaattcatccagctcgacgatcttgtcggccaaatcagacttcacaccggaaagctgtgaacgcaactgggcttcacgctgagagctggcagccttcttattctgggcattcaccagattgctgtatgtattggcttgcgcctgcggaaccgcagacgagaacggggcaatcgccatcgtggcgcacaaagcccccgttgcaaacaccgcgacggccggttttagagctttcttgcttgtcattcggtcacttgcctcccatcattggttccataccatagcatcccatgcttaaaacgcgacacagataaacgtatccaatccgtacaaaacggaatgttctcaggctttcaaatatctatgcaacgacactgtggatgcaatcaccgacaacagcaccgctcctgcaaccaaaatcggcgaaatccacaataccgtcatctgattcacatatggaatccatttcacggaggccgcaagccaatcagtgatgaataccttcaccaatgccgataaagtgacgcaggaaagcaaggagccgaccattgatgcgatcgccccttcaagaatgaatggcagccgaatggtccaattcgaagcacccaccaaacgcatgatctccgtttcggttcgacgtgacgcagcagacatgcgaattgtggtaccggtcagcataatggcgacgaccaccatcaccgcggccaatgcggcggttgcaatggtcgcacgattcagcactgcgaacaccggctcaaaaatctgccgttgatcactgacagtatcgacgccctccttgccagaaagcacttcggaaacgacttgatatttctcaggattcttcagtttcagccacaatgaatcctgcatatcgtcggcagtgagcgtacgcccctgatattcaccgttcggatattgtttgaggaaagtgtcgttgtagaaatcttccttgcttacaaaagtgatttgcgatacatcatcggcaagctcgttgcgaatggttttctgcaagtcattgatctgagtctgcgttgccgcggttcccgcggtgcagttcacggattggctggtgccatcgggacacatccacaccaccacttcgaccttggaataccaatcgcctttggctttggtgatctgcgcctgagtgagcaccgatgcgccgataaacagaaacgagatgaatgtaacgagcatcactgaaagcaacatgggcacgttgcgcttgaggctgctccaggtttcggaaagaatgaaacgcaaacgcatcagtcgttctccttgctttcggacgtttcatgctgttcatcggattgttcgacggatttcgcctcgccaccggcagtcgcggcgggcgctgccggaggagccggaggcgcgggcggagcgggaggcatcggccgtgccggaggagcgggaaccgttggctccgcggattgctcgttttcagccgctttgcttgattccatgcctgtatcaggcgaagagccagtcgcgtcggcattggcttcggtctgcgaacgtgcagccgaatcggcatgctcctgttcggcaagatcctcaagtttcagtcccttgccccaggtcagcgtagtctccaccggagcgaacgcctcgccataacgaccggtgcgaccggaatgcacggaattggcgagacgcgcgatgcccgcatcaccattgccgctgtggatggccgcagctacggcatcaaccgcgttcgccgcggtttcggctcgcgtcgcgccttccacgtccaccgcctcatcggaaaaatcagacatttcaagcgcgcccggcgcacgatatttcgagtcgacgtcgccgccgttcaacgcctgatgcgatttggattcgacttcggcatccgggaagtacagtgcggaatcgtaggatccctgctgctcgtcacgcacgattttgccggtatgcagttcgaccacacgcttgcgcatggagttgacgatttcctcgttatgcgttgccatgacgatggtggtgccagtgcggttgatggcgtccagcacttccatgatgcccagcgatgtggtcggatcgagatttccagtaggctcgtcggccagcagaatctgcggatggttcacatacgctcgcgcaatggccacacgctgtgcctcaccgccggaaagctcgtgcggatagttgttttccttaccggtgagaccgacagtctgcagcactttcggcactaacgatttgacggtggaacggcttgtgccaatcacttcaagcgcgaacgccacattctcccataccgttttgttgttgaggagtttgtaatcctggaagataaaaccgatggaacgacggtaatgcggcacctgccttgacgacaggcgcctcaaatcattacctgcgacgcgaatctcgccatccgtgacctcctcctcgcgcagcaacaggctcagcaatgtggttttgccggaacctgaagcgcccacgaggaacacgaaatcccctcgattaatgtcgagattgatgtcatccaaggcaggcctggtgcctttcggatacaccttgctcacatgttcaagcgaaatcagcgccatcgtcgtacccctccactatgtgctgttctgattacggtaatcgtggtttttaggcgtccgcctcttcggccgccgcgcgacgctgctcatgacgccaacggatgccggcctcaatgaacgcgtcgatatcgccgtcgaacacggcctgggtctgcgaagtctcataaccggtgcgcagatccttgaccatctggtacggatgcagcacgtaggaacgcatctggtcaccccagctggccttgatatcgccggcgagctccttcttcttcttggcttcctcttcgtggcgcagcaccaacagtcgggactgcagcacggccatggcagcggcacggttctggatctgcgagcgctcgtcctgcatggtcaccacgatgccggtcggaatgtgggtgatacgcaccgcggaatacgtggtgttcacgccctgaccgccagggccggaggagcagtaggtgtcaacgcggatttcggaatcgggcacgtcgatgtgatcggtcgcctcaacgagcggcaccacttccactgccgcgaagctggtttggcgacggccttggttgtcgaacggggagatacgcaccaaacggtgggtgccgccttccacgctcatgcgaccatacgcataaggggcatccacctggaaggtggcggacttgatgcccgcctcttcggcgtaggaggtgtccatgaccttggccttatacccattgcgctccgcccaacgcaggtacatgcgcagcagcatctgagcgaagtcggcggcatccacaccgcccgcgccggagcggatggtcaccactgcggaacgttcgtcatattcgccgtcgagcagggtctggatttccatgtcggccagatcgttctgaatgctttcgacttcggactgcgcttccgccaacgtgtcggcgtcttcttcctcctgacccaattccaccaacgtttcgacgtcgtcgatgcgctggcttgcggaagcgagacgcttcagctgggactgcactgccgacagtttgctggtcactttctgcgcgttttcgggattgtcccacaatcccggttcggccgcctgaacttcaagatctttggcctgcgcggtcagtcggtcgacgtcaagcgccttggaaatcgactcgtatttggcgcgcgcctcgccgattgcctgggaaaaatcaaattctgccatcgtttacaccatacatttctttatgcgttctttatattctgtcatggagcctcatacggctttcgcacaatcctcaacttcttccacgtacccacatactcgttcccatcctgccgaaccgcgaaccagtctcgttacgtatgggattgcaggtccggggaggatcataccggaccaaaggcgtcaaagacctgcgtagatagcaggaataaccagactcagcagcatcgccgcagcgatgacgatgcacaccgcccgcaccatggtgcggcgacggcgttctcgctgctcgcgttcgcttctgtagtcactcacggggtactagtataggcaaggccttctacttattatctttcggcgatctcaccatattttgccgcatcgcaatcctgccatatcatattcgcgaaacctgtgtacgcattacgcgacattgattgcatgtcatttatgatacggttcgccggcattgattttgtatgcacgatacagctgttcaagcagaataacgcgcattaattgatggggaaaagtcatttttgttcgcggcgaagcaacgcccgaaatacaagtcgttgcaagtgctattgccgtctattgaaagcatggagaaactgcatttggatctgccggtgccgctgaaccgcctgtccgccatgttcatgccgggcgcgttctctccgatcgccgtggccgatgacgattgcacgctcgccacggtacgtaccgatcccgccaccggcaaggtcacgcagggcgtgcgcattccgaattccgcggccgccttgcgtgtgctgcgcgctaccggaccgttggccgccaccagtgccaaccgttccggcgatgaaagtgcgcaaaccgttgacgaggccgtgcaggcgcttggcgatgcggttgatttgtatttggacgggggagcgactcccggtcatgtggcttccacggttgtggcggctgacccttatgggcgtgatggcattgcgattcttcgagagggagtgattcacgagccggttatccgaaaggccttgacgttgaatggcggtgctttgggcgtatgagaatctatctgttcattgctgcgattgctggcggcgtcacctatttgatcacgccgttgattcgccatatcgccattgagatcggcgccgtcggcgaagtgcgtgcgcgagacgtgcataccattccgacaccgcgactgggtggtttgggcatgctgatcggtttcaccgtgtcgatgctgttcgcatcccgcattccgttcattcaaggattgttcgcgcaatcgcaacaggcgtgggtgattctcgccggcgccattatgatcagtctgcttggcatggccgacgacttgtgggatcttgattggatgctcaagcttgccggtcagctgttgatttccgtgttcgtggcatggggcggtctgcagatcatttcgcttccgcttggctcgttggtgacggcgtcgccgagcctgtcgatggccatcaccgcgtttttgatcgtcgcgtccatcaatgcggtcaatttcgtggatgggttggacggtctgtcgtcgggcattgtggcgatcggcggcatcgcattcgccatttattcatacatcatcgcccgcaactcgccttcgtacgcttcgatggcgacattgatcgacattgccatggtcggcatgtgcgtgggctttttgatgcacaactggcatccggcgaagctgttcatgggagactccggttccatgctgctcggctatttgatcacgtgcgcgtcgattgtgatgacgggccgccttgacccggccagtattcatgccagcatttacttgccggtgttcatgccgattctgctgccgattctggtattgttcctgccgattctcgacatgtgtcttgcgattgtgcgccgcttgcgcaagggacagtctccgatgcatccggaccgcatgcacttgcatcatcgcatgctgcgcatcggccattccgtgcagggggctgtgctgattctgtggggttgggcggcactgatcgcattcggctcgattatgacgctgtttttcaaggcccaatacgtgcttgttggattcctgattgcggccgtggtgctgaccgtcgccaccatgtatccgtatgtgaagcataggattcccgagatgctggaggaggacgctgcggatggcggcagacatgcgtcggtgcggtcatcgaagcgtcggaaaaactgattaaacgctttgccttgcggtattagttaactttcataacacccttgtttgccgcttgttctgccgtgtcgcggtaagtcagcccgcgttcatatagtgggtctatggctacaattcctgatatgaatgcagattccacgtacgctccacttcctccgattttcgcacagcttggcctcgcctatgacgatgtgctgctgctgccgaacgagacggatgtcattccgtccgaagtggacaccaccacccatctgacccgcaacatcacgatgaaggtcccggcgatctccgccgcaatggacaccgtcaccgagtccgacatggccattgccatggctcgtaatggcggcatcggcgtgctgcaccgcaatctttccatcgacgaccaagccgctcaggttgacatcgtcaagcgctccgaatccggtatgatcaacgatccgttgaccgtcagcccggatgtgacgctggctgatctcgacaagctgtgcggccgtttccatatctccggtctgccggtcgttgacaacgacaacaagctcgtcggcatcatcaccaaccgcgacatgcgtttcatcgcctccgaggattacgaccggctcaaggtttccgaggtcatgacccgcgagaacctcatcaccggcccgtccaacatctccaaggaagacgcccacgacctgctggccaagcacaaggtcgagaagctgccgctggttgacgatgaaggccacctcaccggcttgatcaccgtgaaggacttcgtgaagaccgagcagtatccggacgccaccaaggacgaacagggtcgtctgcgcgttgccgccggcatcggcttcctgggtgacgcctacaaccgtgcttccgctctgatggaagccggcgtggacgtgctcgtggtcgacaccgccaacggtgaggccaagctggctctcgacatgattcgccgtctgaagtccgattccgcgttcaagggcgttgacatcatcggcggtaacgtggccacccgtcagggcgctcaggccatgatcgacgccggtgttgacgcagtcaaggttggcgtgggcccaggctccatctgcaccacccgcgtggtggccggtgtcggtgtgccgcagctcaccgcagtgtacgaggccgctcaggcctgccgtgccgctggcgtgccgtgcatcgccgacggtggcattcactactccggcgacatcgccaaggctctggttgccggtgcctccaccgtcatgctcggcggcaccctcgcaggctgcgaggaagctccgggtgagaaggtgctgctgcacggcaagcagtacaagctgtaccgtggcatgggctccctcggcgccatggctccgcgtggcaagaagtcctactccaaggatcgctacttccaggccgacgtcacctctaacgacaaggtcgttccggaaggcgttgaaggcgaagtgccgtaccgcggaccgctgaacgcagtgctgtaccagatgatcggtggcctgcaccagtccatgttctacatcggcgctcacaacatcgccgaaatgccggaacgtggccgtttcatccgtatcaccgacgctggcttgcgcgaatcccatccgcatgacatcgtcatgaccgccgaagctccgaactactccggccgccagtgattgctgaattccagtaatcaaaatcggtaacagcctcttacttctcggaaaagaccgaaagtaagaggctttactcatatctgcaacgtgaatatttataaccgaacgtcgccctatcgccaagtagcggtgtttgatgtacgaagcaaatcgctaaaacaagtgtgacttcccggtgcgtaggccttccaatctccctacctcgcggtatcttcgaatgttcagctgaagcgtgccaagcggcacgcgcacacgcaaaggaaacgaggcaaaatggttgacgcacatgacggtgaaacatacacggcgaaggattcacgcctgatctggatcgattgcgaaatgaccggcttggatattttccacgatgaactgtgcgagatctccgtggtaccgacggacttcgatctcaatgtgctcgatgaaggcattgatttcgtgatcaagccctccgatgcggccgtggccaatatgaacgatttcgtgcgcgccatgcatacccgttccggactcatcaacgaatgggagaacggcctgagcgtcgaagaggccgaacggaaagtcaccgaatacgtgacccgcttcaccccggacggcgtcaagccgctgctcgcaggcaactccatcggatcagacaaaaaattcctcgaccgttacatgccgaacctcatggaacacctgcactaccgtgtaatcgacgtgagcacgttcaaagagcttgcccgccgctggtatccggccgtatacaacaaccgtccgccgaagaacggcggacatcgcgcgctcgccgacatcatcgaatccctggacgaactgcgttactaccgtaaggcgttcatggcagcggcgcccggtcctgacgcagccgaagccaaggcgatcgccgatcagatcgtggcaaccagcattttgaacaacaactgattccacatatcgcacaatcgttggaaaatctgatattccaacgaaaacatggaaaggactccagtgagcgcagccgattggaccagcatcgaaatcccgcaagacattcgcttggtggttgccgatatggacggcaccctgcttgatgagcatagcgagattccgcaaggtttctggccgatgcttgcccggttgcgctcacgaggcgttgaattcgtgccggcatccggacgccagtacgctaccttgcgtgccatgttcgccgataaggcggcgcaggtgcttgacggcggcgaactttcgtatatcgcggaaaacggcaatgtcgtggccattgacggtaatatcgccgaagtgcacggcgtcgataccgatgtgacccgctggaccatcgacacggtgaacgcttctgccgcggctggcgaatacgatatgggattggtgctttgtggcctgcgcacggcatacgtgcagcgcacggacaagccgttccttgatgaagtcggcaaatattatgcggcactggagattgtggacgatctgcatagcgtgcttgaagatgtgatcgcatcaaacggcgaaagcgacaccatgctcaaactggcgattctcgatttcgacgatgccgaagcgatggccgcggaaaagctgacgccactgaagaacgattatcaggtggtggtttccggcaaactgtgggtcgacatcatgaatgctacaaccaataagaaacaaggcgtcgaagcgttgcagcgcgtgcttggcgtcactgcggcccaaacggcggtatttggcgattatctcaacgatttgcagatgctttcggcagggcagtggtcgttcgccatgggcaatgcgcaccccgcgttgaaacaagccgcgcattttgtggctccatccaatgccgatcacggggtgcttcaggttgtcgacaagctgattgcgtaaggaagccgtttcttcgaaattgatggtcgattgaacaggaaaggcggtgcggcatgcggcaggctgaggcattggcgattctgcaaagtggcgcgagcgtcttcctgacgggtgcgccgggtgctggcaagacctacgtgctcaatgagttcgtgcgtcaggcccgtgccgaaggtgcggcggtgtcggtgacggcgtccaccggtatcgcggccacgcatatcaacgggcagaccattcattcatggagcggtgtcggacttgccaacgcgctcaccgacaatctgatcaaaaccatacgtacccgacgcaaacgtaagctgcagggcgctgacattctcatcatcgacgaggtttccatgttgcatgcgtggctgttcgacatggtcgatcaggtgtgccgcatcattcgacgtgaccaacgcccgtttggcgggcttcaagtggtgctgtccggcgatttcttccagcttccgccagtgagtgtgagtgggcgcaaccacgatttggtcacaccaagcccggaattcgtggcttcccgcgaacgatatgcgaaagcgggactcaatccagatggtttcgtcaccgaatcattggtatggcgggaattgaatcccgcaatctgttacctgaccgaacagcatcgtcaggatgacggcagtctgctcaccgtattgaccgatattcgcaacggttgcgtgaacgacgacgatcgcaatgtgctcctcaccagactgggcacaatccccgaacctggtcaacaggccgtcaatctgtttcccgtcaacaagcaggcggacacgctcaacgacatgcgcctgttcgaaatcaacgaggagccgcacgaatatttcgccgaagccgcaggaccagtcaatctggtggaacgtttgaagaagaacatgcttgcccccgaacgtttgcagctcaaaaccggggctgcggtgatggccgtacgcaacgacaccgaccaccaattcgtgaacggatcattgggtaccgtgcgcggatttgccgccgaaaacaagggcggatggccgatcgttgaatttgaaaacggcaatatcgttaccatgaagccgaattgctgggaaatgatggacggcgacacagtgctcgccagcgtcaaccaagtgccgttgcgctgtgcgtgggcgatcaccatccacaaatcgcaaggtatgacgctcgagcgtgcggtgatggatttgcggcgcactttcgcgcccggcatggggtatgtggcgctgtctcgtgtggaaggtctgcaaggcctgtatttgaacggtgtgaacgaacgcatgttcttggtttcgcccgatgcggtgcgattggatggtgagttgcgtctcgcctcggcgcaggcatccgatatgttggctcatgatggcatcgccgcgttccagcagaacattgccgttcccgacggtgacgagttcgcgcaggacgcgctgttctagtatggcgattgccttgtttgacatgtatgatgatttttgggattcgacggatatgactgttgtgttccgtccgtgcgttgccatacgtcggtgaacgggtggttggattgggcttacgtccccttgcctgagtagttttgggcatatgactaaagcacttcgtatgtccaccatgttcctgcgcactctgcgtgaggatcccgccgatgccgatgtcgtatcggataagcttctgcagcgcgcctgctacctgcgcaaggccgctccgggtatttggacctggctgccgctgggcctgaatgttctgaacaagatcgaaaacatcatccgtgaggaaatggcttcgatcgacgcccaggaagttcacttctccggtctgctgccgcgtgaaccgtatgaggccacccatcgttgggaagagtatggcgacaacatcttccgtttgaaggatcgccatgaggccgactacctgctggcgccgacccatgaggaaatgttcaccctgctggtcaaggacctgtactcctcctacaaggatctgccggctaccctctaccagattcagaccaagtatcgtgacgaattccgtccgcgtgcaggcctgattcgtggccgtgaattcatcatgaaggatgcctactccttcacgcttgacaaggaaggccttgtcaaggcgtatatggacgagcgtggcgcctacgagcgtattttcaaccgtctcgatttgaagtatgtgccggtgcacgccatggcaggtccgatgggcggtttcgaatccgaagagttccttgccccgatggaaatcggtgaagataccttcgcacagtcgccgagcggcaaggcttggaatgttgaggcgctgaccactccggaaccggaagccatcgacttcagcaacactccggccgctgaaaagcgcccgacgccgaatgctgaaaccatcgatcagatggttgaatttgccaacgccaaccatccgcgttccgatggccgcgcgtgggaggcctccgacattctgaagaacgtggtgatcgccgtgatgcatccgcaggatgacgagcatgacgagccgtggcgcgaactggtggttgtcggcgtgcctggcgatcgtaccgttgacatgaagcgtcttgaagcgcagttcactccggctgaaatcgaagaggccaccgacgaggatctgaagaagcatccggaactcgtcaagggctatattggcccgatggcgtttggcccgcaggctcgcggcggtgaaaaggctgaaaacgccaacgaaaccggcgaagcgttgcgttacctcattgacgcgcatatcgcccgcggttccgcatggttcaccggtgccgatgaagccggagtcgactactacgatctcgtgtacggtcgtgacttcgaagccgacggcgtggtggaagccgtgcaggttcgccacggagacatgagcccggacggttccggcccgctgagcttcgaacgcggtgtggaaatcggccaggtgttccagctcggtttgaagtattccaacgcgctcggcctgaaggtgctcgaccagaacggcaagaccgtgccggtgtggatgggctcctacggcattggcgtgtctcgtgtgatggcttgtatcgctgaaacccaccatgacgagaagggcttggcatggccggccatcatcgctcccgcccaggtgcatgtggtggccaccggcaaggatgcggccgcattcgaagccgccgagcaactgatcgccgatctggaagccaagggcatcgaagtgatcttcgatgaccgtaagaaggtttccccgggcgtcaagttcaaggatgccgagcttatcggcgtgccgctgatcgccgtcgcaggccgcgacactgtcaacaatggcaccatcgaagtgcgtgatcgcaatggcgagaacgccgaagccgtgcctgtcgccgacgcagcccgggtgattgccgatcgtgtcgccgcgctgctgaagtaataatcgtattttttctgattatttcaccatataaacggaagattatggatatgccataatcttccgttttttatctggaaacaggtgggaggaagcatgattgtgaggaaaacatttatggggaaaacaaacgaaaaaccatgcatatatcggcagtgccttgcggtggataagtgagatttatccaccgactatccacgactcgcccgaaacggcgtcctttatccacatttgccggttgcgcttgtgccagtatggtcgaatcggggatagtggttctaccgcggaaacgcaaggaagcggaaaggcgtgcagaacccctctctcgcaacccatttctccgactgcgcgttgctttcgcaccttcatcggtgctttccgcggcccctttattaccaatgcgacagaaagggccgatcatggcacaacagcaagctctcatcaccatcaccggatatgtgggcgccaatcccacgcaattcaacaaggatggcatgccccatgccagttcgttcagaatggcgagcaccagacggtatttcgacaatcgcacacagcaatggaaggatcttcccaccacatggatcacggtgaaagcgtaccggaacctatccgagaacatctgccaatctctgaagaaaggcgagccggttatcgtgatgggcgcgctcgccacggaaacgtgggccgatcagaacggcaaaccgcagtcacgcatagtgctggaagccagcgccgcagggcacgaccttaaccggggagtcaccacgttgcgtaagttcgtcaagccgaacgaccagcaccagccggaagcgaaaggaacggaaccgcgtgtgggagccgatccgttcgtcaggcagggcagtgtggcgccggtcgaaatcgtggttcccgaagatgacgaagccgccgaattctcgggagataccggggaattcgacggcgacatatattaggcggcaccgatgccttgcatgcttggctccgattgccagccgatgatgtggtttgttaccagatgcgcacgcgctgatcgggatcgagccacatgccgtcctccggcttcacgtcgaacgccttgtagaacagatccacgttgcgtgcgatgccgttcgtgcggcattcggcgggggagtgcgggtcgatctgcagatactgctccgccagctcgtcacgattcttggtgcgccagatggacgcgtagctgaggaagaaacgctgcaaaccggtgaaaccatcgatttccggcgcttcagacagcgaagcttcaatggactccatggaaccgttcttctcacggcctgccgcctcgtcaagagcgaacgcatatgctttgagcgcaatgttcacgccactcaggtcgccgatgttctcgccgatggtcaaagcgccgttcacatgtggagcctgagctggatcgtcggcgtatttttcggcaagctgcgttggcacgaacgcgttgtactggtcgatgagtttctgcgtgagctgctcgaaattggccttgtcttcttcggtccaccagtcgttgagcttgccgtcgccgtcgtactgggcaccctgatcgtcgaagccgtggccgatctcatggccgatcaccgctccgataccgccatagttcgcggcgtcttcggcgttcgggtcgaagaacggcggctgcagaatggcggccgggaacacgatcacgttcatggtctgctcataataggcgttcaccgtctgcggattcatcagccattcgtccttgtcgacgctcttgccgactttggccagctgatagccggtctcatacaagttggcggcacgcatgttctcggcaaaaccggcattctcgtgcacatcaagcgcggaatagtcacgccaatggttcgtatagccgatcttcggcacgaacttggagagcttctccaacgccttctgcttggtttcttcgccaagccaggcggagttggaaatggacacgcggtaggcgtcgatcagattgccgaccagctgttccatacgctgcttcgacgactcagggaagtgcctcttcacatattcgcggccgacatcctcgccgcagatgccgttgaccagcgaaacgccgcgcttccaacgcacgcgctgctgcttctgaccagacaacgtcttgccatagaactcgaaattcgtctcatcgaattcgtgcggcaactccaaggtggagccgatgatcacatgcacgcgtgcccacagcttgagatcgtcgagatccgcggccttccagaatgcgttaagaccggtgaggaagctgggctcatgcaccaccacatggttgaaaatgcctcggaaatcaagcggctgcacctgagctgcggaagtctgatcatatgcggactgccaggattcgatccatgtgtcgagatcgtaatcggcgagcatggcgctcaattccgcataatcggtgggattataggtcttcaccgaatcacgggttgctacattgtcccaatggttcgcggcgatacgcgtctcaacatcgaggaaacgctgggcttgagcttcggcctgctcgctatcggcggcaagcttcgcgttcttcaactgcttggccaccatatcgacgtacgcttcgcgaatcggcgcataatggtcttcacggtaatacgcctcatcgggcagacccaaaccggcctgctcaacatggatgatgttggtttcgggagcgcccggatcgccatacacggcaatgccgatcaggtcagggccgccagccgggttcatcgcgcccaaagagcgggtgagttcagccttgtcggcagcgacgtcaatagccttcaactggtcttcaatggcggcgagcccggaagcgttgatggcatcaacgtccaggaagcttgcatacagggcgtgggacttctcggcagggcagtcgtcgtcttcgagaatctcacgaatctggttttcggcatcttcagcgagcttatcgaacgaaccataacgggaacgatcatcaggaagacgatacatgtcgatccatgggccgttgacatagcggaacagatcttgcgcagggccggtcacggcggagaacgatgccggatcgatacccgaattcaaagtggtactcatgacttcacactatccatctttggtgacaaaacagtgtatctgaaacgaataatcatcattccgcaacggcatgcataaggtgagatttgcataatcgtaagaaaagccagggagagccgagcactgtagggcgtacgaagtagggttagaggcatgattgaactgaaaacaccgaaagagatcgaagagatgaagcctgccggccgttttgtcggcggcattctgcgcgatctcaaggaatttaccaaagttggtaccaatctgctggaaatcgatgaattcgtgcacaagcgcatcgtcgatcgcaagggtgccgaatcctgctatgtcgactatgctccggatttcggtaccggcccgttcgcgcactatatttgcgtttccgtgaacgatgccgtactgcacggcgttccgttcgattacaacctgaaggacggcgatttggtcagcctcgatctggcgatcaacgtcgatggctgggttgccgattccgccatcagcttcgtggtcggcgagcataaggatcctgaggatctgcgcctgatcaagtgcaccgaagaggcgctcgcggccggtattgccgctgcgcagccgggcaaccgtttgggtgatgtttccgcggcagtcggcgatgtggcccgcgaatacggctatccgatcaatcttgaattcggcggccatggcgtcggccgtattatgcacggcgatccgcatgtgccgaacgatggccgcgcgcaccacggctacaagctgcgtccgggcctggtcatcgccatcgaaccgtggttcctcaagaccaccgacgaaatctaccaggatccgaaagatggttggacgctgaagagctccgacggttcccgtggcgcgcatagcgaacacaccatcgccatcaccgacaacggtccggtgatcctcaccgttcgcgacaagtgatcagacggtagcgtaaaacgcggcaaagctccaatacgacggagcgaagcgtacgaaaagaaggccgatgcccacgattattcgggcatcggccttttatatgcgtaatttcgcgcggaaatagtcgaattatttgccttgcaggaatgaagtatcggatgtcaatcgattgattttgagacgaaaccatgcttggaaacgcgcatgccatatagtgttcgatacttccgaacggttaaggagcgtgcaagtatggccacagccaatctgagtgtggaatccaaagacttcaccctgccggtggtcgaagccacggcgggtgcggacggcatcgtggtgtccacgctgcgcaacgacggctgggtcacactcgaccctggtttcctgacgactgcgcaatgcgaatcgaaaatcacgtacatcgacggcaagaactcgatcctgcgctaccgcggatacccgatcgagcagttgtgtgagcaatccgatttccttgaggtcgcctggttgctgcgtcatggcgaactgccgaatcaggagcagtacgaccggttcatttccgacatcaaccatcgcacgatggtgggtgaggatttccgtaccttcatgggttctttcccacgcaccgcgcatccgatgagcgtgatggcatccgcggtcaacgcgctcgccaccttctatccggacactactgatatcaatgattccgaccagcttgacgaggctgcgaccatcattatggcaaaggcacgaaccatcgtcagctacattttccgccgtcgccgcgatgagccgatgctgtatccggattattcgcgcggctatgtcgacgatttcctgcgcatgtgctttgcggtgccgtacgagccgttcgattccgacccgctgtacgtgcatgcgctcggacgcctgctgatcattcatgccgatcatgagcagaactgctccacttccgtggtacgtatcgccggttccgcccacgccaacctgtattccgcggttgcggcaggcatcaacgcgctgtcgggcccattgcatggtggtgcgaatgaagcggtgctccgtcagctcaaagccattcgcgattcaggcaaaaccgtcaaggaattcgtggaagacgccaaaaccagcggtcagcgtatttccggactcggccaccgcgtgtacaagtcgtacgatccgcgtgccgcgatcgccaagaagtatctgcagaagatcatggaacgcgcggacacgttgaaattgcctgccgacgagcgtgcgctgttcgacgtcgccacggaattggagaaaatcgcgctgaacgacgagtatttcgtgtcgcgtcacctgtatccgaatgtcgacttctacacaggattgatctaccgtgcgatcgggttcgatccgtccatgttcaccacattgtttgcattgggacgtattcccggttggatcgcgcagtatcgtgagatgcttgccgatccgaacaccaagatcggtcgtccgcgtcaggtgtacaccggttataccgaacgtgattacactccgatcgaccgtcgatagttgctttttcgctgtttcatggacttgtgatgctgttcgccaagccctgcggctaaagtattgcacggaaacatgcaagtaatgcaatcactgttgtgaaggagcgaagaatgaccgatcagcgcactgcgtggggttggggtctgtccagcgtggatgcggccggcaacactttggacgtatggtacccggaactgaagcttggcgaggctccggaggaggtggcacgcccgaaccataattttggcaatctcgcccatgagggcgtcgatgcgcgtggcgtgcgccgcattccggtgttcacggtgtcgaagcttgacgaaccgatcgaagacgcagccgacgcatacctgcgtctgcatctgctgagcatgcgtctcgccaagccgaacaccctgaatctggacggcattttcgcagccctcaacaatgtggtatggaccaattatggcccgttcgcggtcgaggatttcgcgctgcgcaagcttgacgtgatggccgcggccaaccagtgcgttccgggactgccgaaggttgacgtgaacgtgctgtcgatcgacaagttcccgcgcatggtcgactatgtggtgccgaccggcgtgcgtatcggcgacgccgaccgcgtgcgtttgggtgcccacctttccgaaggcaccaccgtcatgcatgccggcttcgtgaacttcaacgccggcacgctcggcgtttccatggtggaaggccgtgtttcccaaggtgttgtggtcggcaacggttccgatatcggcggcggcgcatccatcatgggcaccctgtccggtggcggcaagcttaagaactccatcggcgagcactccctgcttggcgcgaacgcgggcatcggcatctccctcggcgacaactgcgtggttgaagccggtctgtatgtgaccgccggcaccaaggtgaccatctacgacaaggccaaggtcgcggcgggcgaaccgctcgaaaccgtcaagggcgccgatctttccggcaaagacaacatcctgttcatccgtaattccgtgtccggccgtatcgaagcgcgctatcgcaagaccggcatcgaactgaacgaaaaactgcacaagaactaaatatcaaatatgaaaatctccctcattaccgtcggcaaagtcaaggaacaatatctgcgcgacgccatcgccgaatattcgaaacgactcagccgatactgcaagcttgacatcgtcgaagtggccgacgagaaaacacccgagcatgccagtgagggagtggaacggcaaatcaaagccaaggaaggcgaacgcatcgccaagcatattcgcgacgatgcgttcgtcatcgcgctcgccatcgaaggccagcagctgaccagtgaagaacttgcgcagaaaatcgacggtcttggagtgcatggcaccagccatatccaactcatcatcggcggatcgctcggacttgacccaacgattgtgaaacgggccgactacctgctgagtttttccaaaatgacttttccccatcaattaatgcgcgttattctgcttgaacagctgtatcgtgcatacaaaatcaatgccggtgagcatgccgaagcgcaggtgaaccccgaaacgggcgaaatcatctttccggcatggggcgagcggcagttcgaagaagccttatggtcactggtatggcaggggaaaatgacgaacagttcgttcgcaccagtacgagcgcttctgcacggaggcaaaaccgttcgcgcaccccgtcgtgccgcgcgtagacgcgtcaccatgcgtcctccaacaccattggcgctgagtggattatggtccgcagtatcttgtggcgacgggcgaaccgttatgccaaacaaaccactagacggtgttatcgagccgggcatgctcgaaaacagcgataccggcattggcatggcgcatacggcaagtgtagaggagcgtgagctggcgctcatcgactcattactggaccgatacggcgtgattgccgctcctttggttgacaaggaacggattgccggaggattttcagcgctctatccggtactcaaacgaatggaagaacatggcacactggtccgaggcatgttcgtgaaaggttttggcgcggcacaattcgcggaacgagacaccgtcgacgcgctgcgcagcgacacgcaatggcacagtcaatcctgcgttgcgctcgacgtgatcgatcccgccaatctcactggttccgcaatcgcctggccagaacaggattacctcaaaccagcacgcagatccgggtccatcattgtgctcaaacaaggcgaaccggtactgttctccgtaccaaaaagccataaaattgtcagcttcaccgcagacgaaacaatattaagaccgtcatgcgccgaacttgcctacgtattgcagcgccaacccagcggcagcatcagcttcagcgaaatgaacggaacatcattgaaagcacgcaatgaataccggcaaatcctttacgccgcaggtttcgtcgatagtccgcaaggcatgaaactttactgttgaaaaagatcatcatcgctaatgcatagtgacagcgcggacgaaaacgcaggaacaacaatgcccgcgtcctacgaacggaatcctaaacgattccaaacttcgcaaaacgcgggcacgtcacattgcaatgggtcagccgacgatggcgattggcgcggaaagttccgtaccagaaccgtcacgacgcatatccggcttcggcaattccacgccggcaccgccctccgtggaagcatgtaccggatatgtgcccacgaaggcgaggatcaacgtatcctgccccttaaggaaacgctgcgaacgcacgccaccggtaccgcgaccctttgtcgggtacatctccaacggggttaccttcgctgaaccattctccgtgcccggcagtgcttcggaatcgccggcaaccgtcaacaccacggctccagacgcggagaacaggccattgtctccctcctcgtaattccaagccaccttgttggcgggaatcaccgcaaacgcggcaaccgagcagccttcagccaagcggatacctgccatgccgcccgcggtacggccctgagggcgtacgttcttcgcatcaaacgtcagcaaagacgagtcggtagaaacaaacaccagtcgatcctcatcgcgcgcttcagcggcagccagcacttcatcgtcatccttcaaatcgatgatgctccatgaatccatcgtggtgggcgactcacgattccaacgcttgatcacgccattacgcgtgcccaatgcaagaggagcaggttctgcggcatgatcaccggaatcatcggcagttggcatggcaatcgcagcaatcacgcgttcgccgcgaatcggatcggtattttccgtcataccgatcaactcttcggcatggacgccgccagtcacatggagcggaccatccgcagacacaaccggcaactccacgacatgcgccacaatcagacggccggcagatgtgatcaaaccatatgaggaacgtgtggtggtagggaaaatcgaaataatctgatcgtccctcacacgtttgtcggcagaagaacgattctcccaacgttccaacgcatcttcggaggttcgcgcgatcaaacccgtggccgacagcatcaccgcacatggttcgtcgtcaatctgcaatgccacagcggccgcattgtcttcaccggccttcgtcgctgccttagcggctgcggcaacatcagctgctgcggaagagaccgttgcggcggcacgggctgcggccatagccgaagcggacacgccatcatcaccatgcgccacaacaggcacaagcttaccatcggcatcctcatccagcaatacggttcgacgaggcgtgccatacgtggcgacggcctcatccatttcggagatcaccacattgtcgagcgcttcggcggaagcgagaatacgatccaactcttcgatacgttgcttcaaatcgtcacgttccgactcaagctcgatgcggctcattttcgtcagacgacgcagacgcaagtcaagaatgtactgtgcctgaatctcatccaaatcgaatacggcaatcagcttcgtcttcgcggcatcagcatcgtcagacgaacgaatcacctgaatcacttcgtcaatgtcgaccatcgcaagcagaaggccttcgaccaaatgcagacgctccaacgccttcttcttacggaattcgctacgacggcgaatcaccacacgacgatggtccacccacacctgaagcatttccttcaaacccatggtgtgcgggcggccgttgaccaacgccacattgttgatagtgaaattgtcttgcaacggcgtgtgcttgagcagttgcgcaagcacggcgttcggatcgaaaccggttttgatttcaatgacaagacgagtgccgttatgacgatccgtcaagtcgatcaccccggaaataccttccagcttgcgattcttcacaccctcggaaatacgttccagcactcgttcgggccccaccatgaacggcagttccgtcacgacgatggctttcttacgggccgtcacattttcgatatgcgtcactgaacgcgtggtcaacgcgccacgtccggtctcatacgcctcacgaatgccgttacgcccaacgatcacgccgccacttggccagtccggacctggaacatagcgcataagctcttccaacgtggcatcaggatgatgcatcagatgcttggccgcggcaaccacctcgcccagattatgcgtcgccatattcgtggccatgccgacggcaataccggaaccgccattgaccagcagattcggaatcgcagcgggcaaaacagtcggctcctgcagcttgttatcgtaattcggcgtgaaatcaacggtattctcaccgatattggcattcataccaagcgctgcctgggccatacgcgcctcagtgtaacgggaggccgcaggaccgtcgtcaagggaaccgaagttaccatggccatccaccaacggcaatcgcatcgcaaacggctgcgcaagacgaaccatcgcctcatagatggcggagtcgccatgcgggtgcaacttgcccataacctcgccgaccacacgggccgatttcatatacggacgatcaggattgagattcatctggcccatctgatagatgatgcggcgttgcaccggcttcagaccatctctggcatcgggcaacgcgcgggcatagatcaccgaatacgcgtattcgaggaacgacttgctcatctcctcattcaacggtgtttcgacgatgttctctttgaccgtacgcgggtcaaaggctggttttgccggtttgcggtgcgacaccatgcggtgaatctcctcacggaaaagtaatggtaatcaacctagcaatgctaccagccggtaccgccgcggtgcttgaatgggaattatgagtgttgaagtgccaagcgtcgaagagctgctcaccatgaccgaaccggcatgctacggcgatgacgtgtcatctgaaggaacccgtgggggagcgttgcacctgtcatcggtacttcctgctgtttccaacgccatcggataccccatgccaacggcagtccatcctgatccgaagcgtttgcagggagcgctcggcattcccgatgcgacttccgtggttgtggcgctcgtggacggtctcggctactggaatctcaacatgaggctgggacatgccccctacttgcgtgcgctgatgaacgacaccgccaatcaacgtcccatcgcaacatgcatgccaagcaccaccgtcgcagccatgtctaccttcggtacgggaacatgccccggtatgaccggtatgaccggttacacgcagctcaatccgaaaaccgatgaaatatgccagctgatttccttcaaaaacgcaattcctccgcttgaattgcagcaacaaccgaccattttcgaacggctgagcgcgcaggatgttcgagtgaccagttctggactgccgaaattcgccttttccgcgttgacacaggcggcgttacggggcagcgactacatttccaacgatgatccgcgaaaacggattgcagccgcggcgcaagcggcaaaaacgcccggactgacgtacctgtatctgcgtgataccgataaggtcgggcacaattacggttgggattccgacaaatggattggcacgtacgagcgtgttgacgctcagctcggccttctccgccgcagcgtgcccaaaggcacattgattgtgattgtggcggaccacggtatgatcaccactgatcccgaatctgtgattgacattgcacaggatcagcggctcatgcagggcgtcgcccatgtcggcggtgagccgcgttgcgtcatgctctacgcggaacaaggcgagaatccagaagacatcgccacacgatggcgcagcgtgctggaggaccgtgcgcaggtgcgcacgcgctcgcaggcaatggatgaaggcgtgtatgggccggtggaagctcgcgtcgaaccgatgatcggcgatgtgatcgtatcggccgccaaagtcgtcactattgtggactcacgtacgcaagcagaaaaggcgatgcacctgccaagcgtgcacgggtcgctcaccatgctcgaatccgacattccctgcttgatcgacgtggcctaacttcagtcgccaaacaggatttcgtcccagcttggcacggcggaacgtccggcacgccgcttcgatttggtggtgttctggctatgcgggtcaagtgtctggttctcgttcgccatgttcgaagcaggctccggcgtggatggaacggtattgcgtgtgtcggtgtttgttgcgctggctgtattggctcctgcagcagggttctccggtcggctcggcagaggcaagtcggatgcgatggctggcgcgttcggcgtgtcaggcgtgtcggattcattagacacgccgccgattggcgcgatcggaacggaaggcgctgccgcgggacgggccgcaggcatggacggctcgggcgtgttccatgcggacaccgtttgctcgatacgcgccgaccgtgcggaatttccgggaagattcagtgacacgagaaaattttcatcggcgtgtttctcggcgtgtccttctttcgacgtgtcctgttctccaatgagttttcgtgctgcggaattcaggcagcttacggcattgtcgtgcatgttccacgaccattccgcgcagacattgtgaccggaggagacgaactgagcgctgattttccaaggctccaagccaagtctggtggccttccaagtcacatcttccaagcgcacccgcgctgccgcaaaagtgcgttcgatcagttcggaaagcgtgcgtacgcggctttccttcggcgctggaacggcgagaaactgctcgatcgcatattgcttttccgtttcgaccgaagccgagaaacgccgaacaagcgcttcgcttaacgaatatctttccgcgacacgcgcgggatcggcgccagcgcgaatcaacgattgaatttgcgaaatcggcagggtgggtgggatgcgtgtcttctgttcctcctgtacttcggaacgaatctgcttggcctccaaaatggctctttcaagcgcttcgtcgatctttacagcgaactttccggcacctgaaacaaagacgagttcaccggtgtcgctgacatgatcgaaccgcgcttcctcgagtgaattcccaggcacaacacaccactttccttcaagaatttctgtttattccattgtgccccacgtgtcggattttacgagtatttcgattcgtgtatcctatgcggggtaaaagtcatgtatcctatggcgcataagcaccatagatgacgaaaggaatctcgatggcacaggattatgattccccgcgcaacaaagacgaggacgaggagtcgctccaggctttgggcaagagctcccagaacacttccaacgatatggacgatgacgagaacgccatcgccgaagattacgagctgcccggtgcggacctcagcaatgaggacgcctcggtgaccgtcattcctatgcagggtgacgagttcatctgctccgaatgcttcctggtgaagcaccgtagccagcttgcctacaccactgacgacggtcagccggtgtgtcaggagtgcgctgcctgatggcgttcgacgaagcatataacgaaccggaaaacgtcgaggttctggtaaagtcgctggatcctgaccatccggcggaattgtattatgcccatgccggtgacgctggcgctgatctgcgcactacggaggaagtcacgctgaagccgttccagcgggcactggtgcctacaggagtggcgatcgcccttccagcgggttacgtggctctggtgcatccacggtccggtcttgccgtcaagcagggtgtgactgtgctcaatgcgccgggaaccatcgacgcggggtaccgtggtgagatcaaggtgccgctgatcaatcttgatccggaacacaccgtgacgttccatccgggagaccgtatcgcgcagctggttattcagcgttacgtcgaagcgaagttcatcgaggcggaaacgctgcctgggtcggatcgcgctgagcgtgggtttggttccacaggcgtggcttcctgagctgaacgcactggcttagtcgcagaggaatcggcaaacgctgacgtctcaatggtttcgggggtatttggccgtgcaacacgcggtcggatgcctcggatgcacggtgaggcgcgggtagtatagggagcattgcgagcgaggaggtggacgatgggtgacgttgagcgtgaggttcattctgcccgaatgttgggctgcgagatcagcacgaatccgcttgatccgcttgagccgatcctgaagatgtgcgaataccatcatcccgatgaggacataagcattcttgagcgcgcttatgagcgtgcggtcaagcagcattcttcgcaacggcgcaaatcgggcgagccgtacatcatccacccgttggccgtggcgcagattcttgccgatctcggcatgggaccgttggttgtggccgccggcctgttgcacgacacggttgaggacaccgactatacgctcgatgagtgccgcgccgagttcggcgataccgtgaccggtttggtcgatggcgtcaccaagctttccaagatggaatacggcgattccgcgcaagccgaaaccattcgcaagatggtggtcgcgatgagccgcgacgtgcgtgtgctggtcgtcaaactcgccgaccgtgtgcacaacgcgcgtacctggcgttacgtcaaaactccgagcgcgcagaagaaagcgcatgaaacgcttgacgtgtacgcgccacttgccaatcgtctcggcatgaacgcgatcaaaaccgaattggaagagctcagcttcaaagtgctctatccgaagatctacaacgagatcgtggtgctggtggcccgtcgcgcaggccagcgagacgtgtatttgaagcagattctcgcggagatcaacgaagatcttgacgaacagaacattacggcgtacgtaacgggacgtccgaaggactatttctcgatttatcagaagatgatcgtacgtggtcatgattttgcgaatatctacgatttggtgggtgtgcgcatcatcgtcgacacgattcaggattgctatgccgcgttgggtgcggtgcatgcgcgttggaaccccgttccgggccgtttcaaggattacatcgccatgccaaagctcaacatgtaccagagcctgcataccacggtggtgggccctggcggcaagcctgtcgagattcaaattcgtacgtgggacatgcatcgccgtgcggaattcggtatcgccgcgcattggaagtacaaggagaacggtcaagctggccgtgcgctgagctcgcccgataagtccgatcgtaaacgtggcgagaaccaggagctgagcgaggctgacaatttcaagtggattcagcagctcgccgactggacgagtgagaccccggattccaatgaattccttggctccctgaaggaagatctgggtgctgccgaagtctacgtgttcactccaaaaggtaagatcgtatcgttgcctgccgaggcgacaccgatcgatttcgcttacgcggtgcataccgaagtcggccaccgtaccatgggcgcccgcgtgaacggacgtctggtaccgctcgacaccaagcttgaaaacggcgacaccgtcgaggtgcttacgtcgaagtccgaatcggctggtccgtctcgtgactggttgagctttaccaagagcccgaaggcacgcaacaaaattcgccaatggttcagcaaggagcgtcgtaccgaggccatcgaagaaggtcgtgacgagctgacacgagccatgcgcaagcgcaatcttccgattgcgactctgctgactcccgaggcgttggtcggtgttgctgatgagctgaatcttgccaatgccgaagccgtgttcgtggcgattggcgaagggcagatttccacgcagaatgtcatctcgcatctggtccgtgatgcgggcagcgacgaggtgaatgaggaggtggagcaggaggctctgccgctcaagcaggtggaacgcaccaagaagaccaccagctcgctgggcatttccgtcaagggcgtgggagacatttgggtcaagctcgcccgatgttgcatgccggtgccgggagacaacatcatcggcttcatcacccgcaatcagggcgtgtccgtgcatcgtgtggattgccagaacatgctggacttgcagaagcgtcagccggaacgtgtggttgacgtgcagtggacgagtaccaagggcgtgttcatggtcaagattcaggtggaggcgctcgatcgcccgcatctgctgagcgacgtgacgcgcgtgctttccgaccatggagtgaacattatttccggctccatttccacgggaaccgatcgtgtggccactagccaattcagcttcgaaatggccgacccccagcatttgaatactttgcttgccgcagtgcgcaagattgaaggcgtgttcgatgtgtatcgtatcaccggtgccaaggactccgccgaacctcgtttacgcaaaatatgacacgatcagtgcggtcgtgagactcatctgaactgctgtagattctctcggagataatgaaaagcccctcacgcgaggggcttttcattgttttgccgtaagtcttgttgatgcgaaacttacttcagcacttcgatggaagtgatgccgaccggctcgagcggagcatcggaacggtcagttgccacggagtcgagcttgtcgacgacggccttggactcgtcatccgcgacttcgccgaaaatggtgtgatggccgttgagccattcggttggcacggtggtgatgaagaactgggagccgttggtgccgtggatcttgccgtccatgccgcggcgcaggccggcgtttgccatggccagcaggtatgggcgatcgaaggtcagtcctggaacgatttcatcatcgaagttgtagcccgggccgccagtgccggtgcccagcggacagccgccctggatcatgaaatccttgatgatgcggtggaaggtcagaccatcgtagaacggcttgtggctcggctggccggtgaatgggtcggcccattccttctcgccagtggcgaggccgaggaagttggccacggtttccggggtcttgtcgtcgaacaggttgatcttgatgtcgccttcagtggtgcgcatgataactgtagtcatggttcctagtgtctcatgggcttgagaccaggcggtagcccattgacgagttcggggctaagttcgacggtcacatgaagtattactgcgaaggcggattcgggaatccactagggtttggatggggccgaatgggtctcgcaggagcttggactatgcgtcacgagcggttcgggaattatatgcccctctacctttatgcagacaatcagcgaaaaccttcaacggcattctcaacagcgcaaaacaggcatagtcataatctgagcaatcaacggcaatggtgaaacacgtgaccttacactgcacatgcagtccccaacacgccagacgcttacgattatgaccacatcaacttcgcagaatactcacgaaacagataccgcaaacaacgcatcatgcaccaccatcagcaccattctcacactggccataccaacattcgggcaacttatcgccgaaccagcattcgtactcatcgacaccgccatcgtcggacatattggcgggcgagcgctcgcaggtctgtcggtcgggtcaaccattgtgctcactgttgtggggctatgtgtgttccttgcgtatagcaccacatcgcaggtgggacgtcttttgggcgccggcaagcggagagaaggcttggaagcaggcattgatggcctgtggttggctggaatcattggcgtggtggtgtctgtggcgctgttcgttattgcacgcccgttgtgcatggccatgggagcccaagggagtgtgctgcataacgcggttgactatgttcgcgcagtggtgttcggtattcccggcatgttgctggtgtatgcggccaacggtattttccgcggactgcagaaggttcgcatcacgttggtagctgctacgctgggtgcgatactcaatacgttgctggatctgctgtttattctcggattcggttggggtgtgtttgggtctggagtggccacgctgatttcgcaatggttcatggcagtgttgcttattgttcctgcgatgttgtggactcgtgcggaaggtgcccgtttacggccgcgtttgtcaggagtgttgaacagtgctggcgatggtgcggtgttgttcttgcgcacgcttgcgttgcgtgcatgcctggtggcgaatgtggtgctggctacgcatatgggcgtggaagtgttggctgcgtatcaggtggtgaattccagttggaatttcgtgttgaacatgcttgatgccattggtattgccggtcagacgttggttgccgcgcagattggtgcccgtcaagaggatgaagccatgcgtttgacgagaatcgctggcagggcaggattatgcggaggaacggtaatcggtattggtttgatgattgccggatggtgtgcgtccccgctgttttctcagtcgattgagatccagcatttgctcactgtcggtatggtggttgttggcgtgacattgccgttggctggttggatgtgggctgttgatggcattctgattggggcaggggattaccgttatcttgcattgacgtgtacggcgacagctgcaatatatgtaccctgtcttgctgcgattggttggatatgcgatgcgatgcaggcgtcttccgcgctgcgtatggcattgctgtggcttgcggtgaatctgttatttgtaggattgcgtgccattttcaatgggtcccgtatcggaacttccacatggttgcatatcgcacattgaaatcagcttgtgatggcagtttgacatgacgtgagatgggcgattcctgcaaaataaaaaatcccgcatgattccggcgaaccggatcatacgggattgttatatgcggacgaacttaggaatgagtcctaagaacaggctctggcaattcaggaacgcttgcgcttgaacacgaacaatgcccctgctgcgacaaccagaacagcgaccaccgcaacaacgccgattacgttggaaccggtgttggcagtgtttgccttcttgtgtgcggcaggcttcgtattctgcttgtcatcatccttcttcggtgcgttcggagtgctgtccttgatagtcacagtgaaacgcacgcgtgcaccctggttgtagaacaccaccacagaaccggtgctgccggtttcgcgaccattgaggaatgcgctgctcaacacgatggaaccgtcatcggtcacggtgtaatccgtgccggcggtcagtgactggtagtcgtactgcacgtcttccacggtattgccattggggttgatgccaacggtcagaccgttggcgttggcgctcttcttatcgctatcatacttgtcgtagtcgaatgcatcgccattcgtcagctcagcattcttgatttcaccatcgttcagcagccacacctgagtgccatggtacgggtttgcggtgccaattgccagaccggaatcggtgacggccgacaccgtccaaattgaacgctcagggtgttcaggaacaagtgccgacagtgaacacctttattcgatcacacacagttgtcgggagccggcgtcgtctcgcccccgtatgagccgtacccgcgtcgttcgggaacatgcgccgtcagaccatcctcggccatgatcccgcggagcaccttctccgagacgccggtcctgagcatggccttgaccctgcggtacccgtacccgcccttggaagcggcgaacgccccggccaccaggacacacagcccggcgtatctgtcaaccccgggcctggcatggtggcagtaggtggccgctcgttgcgatgccgggcaagcatgtcatcgagctgagtgaacacgtcgggcgcagacggtcgaccggaagcgtcctctccctgttcgacaggcgccgcaggtcggcgtccgggtctttttctgcgagcctccaccacctcccgcatcaccgcgttccccagttccggctcctcgatccgccggcgtagggcctcggcgtcgccggcgtcccgatcccgtcgcatcgctggcttgctggtctggccggcgttcctgtttttgggccgcaacgcggccataccgccctcgcgatacgccttgacccagttgcggaccgctccgagccgtccggcaccggttcgatcgccttggtcctcgtctccagtgggatgatgggtttcgccatatggccggcatacctggaatcctttgccagccagcgttccaggcactgcctggccggatagcccagatgcctcaccacccgggccgtggtcatcggcgtggcggaatacaagtccaccgcgcgccgccgttcctcaggaccgaacatacgataatcctttcgttcagtctccaagaaaacgtccgcagccccttatcagaaagagaaccacggagataattccttgcctgctaattaagccatgaagtgatgtcgggccacacgtacggaccatcacgattcaactggtataaatcttttcaacattctctcgagcattgcgaacaacacaaacaatatgattgcaatgccaagatagacgataagagcgtcggcgtagacctcactgtacttaaagctttctgatccaatgatggtcgcccgggccatgatgtccatcacggagatcgtatataacaatgaagtgttcttcagcatatcaatcaccgaattcgaaatgttcggcacagcgttaatcgcagcctgaggaatgattatacgagacactgcatgtacggcaggaaggttcagtgatttgattgactccctctggccctcaccaaccgtgaagtaagcgcttctgaaaatctcgcaaaaatacgcactggcatagagcgtgaacgtgacaatcgctacagtgttcggatagatggtcacgttactgacgaacttcggattttgatgaacgaaggccacgatacggggcattccataacagaccacatacagttgcacaagaatcggagtagaacggatcagagacacaagcaggccaacgatcgtattcagcaccgggatccgtcgcagacgaacgacacagaaaagcattccgccgaacaaacccaaaaaagcggaaaccactgtgaccagcactgcgactggtgccgcctgaagaatttcatagaaatgattaaaagcgtattgggaatcgaatgacatatcaagcaacctttttcaatgaagcgtcatagactaccgaaatcaacttgtcgataagcgcggcaattacccagtaaatcagcataagagctacgtagatttccagttgccataggccaaagtcatccgcggaaagcgtgatcgccttctcataaatatccgtgataccgatagtgaacaaaatcgaagattgcttaaccgcagtgattaacagattggcgaaattcggaagacaattaattagagcctgaggaatgacgatacgcctgtagtaggtcagtctcgacaaagagagggatttcgccgcttgcacttgtccttctgatacagcatcgaagccagctctcatcatttcttcaaagaaagccgacaggctcaaggcaaaggcaatcaaggcatataccaggggatcatccgaatcgacatcgacaccaagggaagcaagaagcgcgggaagagcgtagtaggaaatgaataacagcagaagcaatggcgtgccacgcatcaaccacacataacctgtgacgatcatttttatgagtcgattgcgggaacgcccaagacaggtgagcagaatcccgatgaacatacctagaaccacagattccagaactatgcctagcgtataaggcaaacgcgttagtagcggcgggaatgccgataagaatgccgatgcgttgaaataagtattcattctacttactcctcgccgtgatagcgacgcaggaattcctcggtacgctgttgttccggtctgttgaaaagcttctccggggtcccctgctccacaatggaaccgttttccatgaaaataacgttagaagagatacgtctggccaaagccatctcatgggttaccaccaacatggtacgcccctccgaggcgagctgctcaatcactttctccacttctccaacgagttccgggtctaaggcacttgtcggctcatcaagcagaagcaaatcaggattgaccgcaattgctcgggctatgcccacgcgttgcttctgccctcccgatagatccttgggatatgattgagccttatcagcaaggccgactttgtctaagagttcaaggccgagttgatatgcttcctttcgaggcattttctttgcataaatcaaagcctcagtgacattctggatggctgtcagattcgcaaaaaggttataagactggaaaaccatagcagtcgcgccacgtacgaaagcaatgtctttacgatctctggtagcaaggtctatagtctttccagctaaagtgagtgttccggaatcggcggtttcaagaaaattcagacacctcagaagcgtggttttgccggagccactcggtccgataatagaaacaacctgtccctcattttggctgaatgaaactgattttaaaattgtattgccgttaaagcctttaaccagattcctgattcctattgacatgtcatcctctgtttttgtttatgcaagattgcgaaattgccacatccatcactgcagtcgatcgataacagctttgtcgaaggatggtccttcgaatggatcaccgaaataatctctataaatcgttagcagcgcttcgcaggttggcgtaggaacccccaatagattccccaatgcaacaagaggggcaataccatatgggatgtcttcttgaatgaaccgatgccgtatatctttgggaccaatcaatgaggaatagaccggattgtttttaaataattcagtcaatgtgaggtaatggcttccccaaaacccgttaagttgcgccgtgatgggtatgtacgggctttttaatgcgtttgcaagattgtgccgttccccatcaatatgcctgacaagttgctctgtacgttctgtgaatccgtcggacagcatgtaatactcagatccgctttcgattcgagtcatattcagaaggcaaagtggagcatggatgatgggattcggagccatcaaagaggtggcgaacaccgtgtcatagttcagcacgttcgaataagcggatgacaaaaaacggttagtttcctcatgagcgtccgaattaatcgcataggcgatctcgatagatgatttgagtcctttgaagagcagcgaagcactctgttccggtttttcgttatcgaacatgaactttgagacatacggcattcccgtggattcagcaatcgttaaccgttccttctggatgccatcttctccagccaatatctggaaagcctcatacgcgccccaattcccgttgaacacgataagacgaattgccgagccgggattattttttgcccagtctcgcacgttcttaaaaacatcattgtgattattagcccatgtgcagataataatgaagtcggcaccatccaaaacttcagccagattatcgctcgcatgaatcttccataatccatcaatcacgcctgtggaagatattgcagagccctgcaacgccgccagtttcgccgcattacgtgtatataccatcgggttatatccgagagagcttacatgcaaagccgccgcgatgccggtgtttccagcagacagaatagcgattttccccataacaccaccaaccacaaaatgaatttttaaaagacataaatctgccgtacggggaaaccgtacggcagaggcttcaatcgtcaatcacttccaatagataacgctatcgaccttgtctgcgcccggtagtttaaagacgtcttcgccataccacttctcggacagcttggacaaagtgccattattgcggaaatcatcgagaaccttgtccacatccttgcggagcttcgcagtgctatcgcccttatgatacaggaacaccgttgggaacaatccgatggaatccgtcgtagtcagatcaaggccgagttcatctttaatgctttggaaagacgtgtaagggtagatcgccgcgtcatatttgccagcaccgacggctttaagcacatcagcgaccgtggcggatttttctgtagcaccttcgaactcaattttgttgttaggatgcttttcattgtattgattaataagagtgtagcgtgcatcatccgtcggaatcggtgcaagtttcttaccggatttcgcaagatcctccagagaattaatgttcttctcatccgatcggataatcagtctggcatcactgagacccgtaggattttcggaataatcaaaagtcttaaaacgctcggcagtaccgtagaaagagcacgttgccgcatcatacttgccactctacaatcccgtaagcaaagcatcctgagccagcgcggtatacttgaatttgtactggggcagtttttcatcaatcttcttcagaagttcgaaatcgtagccagtgtagttattgccgtcaacgaatgtatacggttttttccctgtcacaccggcaatattgacaacctgaacatctttcgatgcttctgtatcattcttagatgttccagagccgcaggccgtcaaggagaaaacggatgccgccgctgcgatcacggctacaatacgcttattgatgaggctgttagacatttattttcccttcctcttggcataactatccaactgatgagaagcatgctatctgaggaatgaacccaaaatgcctttcgcgctatcttatctttaatggagaaactataagcgtgatttataaacgccaacgagacaaacggtctcggacagatcagacgctaccgaagtaaataacgcaaatacccaatcagcagcctagaagcaaaagccaaaaagatgaatgaaagcaaacccatatccaacttaaatcgaggtgcgagcggattcccagactggcacggcggctccaatgacagacaacagaaatagcagcggaacaggtttctcatgagtgtgaagcccaatcggaattccagggactttgatgagaaatgtatggagccgaggcggatgattcaatgacggcaaggagagactgtttggggagtatcgacatgaatgacggtatcgtgcgtcgtccacggtacaggggatggacccgtgatcgctacgactgcagtcgggcttctccattccattcccatgagagggcgcacgctccaaagacgtgcgccctctcatgggaatggaatggagaatgaaatcaacggtcttctatctggacatgacccccgttctcgcaattgaccccagccagtccagggatggcttcggatgacgttcgaaggtgtccttgtcccaggaagccagaccgaacgtcggagcgaacgacccccactcgtagttgtcgagcaacgaccagtggaggtatcccctcacgtcgatgccatcgtccatcgcgtcgtgcatgccggctatggcgtcgaaggtgtagtcgatcctctggcggtcgtccgcggtggcgatgccgttctcggtgacgattatcggcgtgtgcccggcgacgtcccatgtgtgccggatggcgatgcccaacgccggcgggaagtactcccagccggtgagggtgcgttccgcgtcctcggggatcggcacggggccatccttgccgatgaaggtcctcagataggcctgcacgccgataaagtcgtccccggccgcggcttcggtgaagtagtcctcgcgcgggtactggtattcctccatctcccgttcgcatcccggcatggcatggaacgcctggcaggcgatggtccatccggacttgatccgagggttcccggacagtatttcccgagccttcctgtgcgcctcgacgagcgtgacggagatgtccggatcgggcgcgggcagcgaggcggccacgaagtcgctgccttcggttccgccacgggtcagcgcgaccatgttcggctcgttgatggtgcatacccaggtgacgtcgtggagtatcgtcatcacgtaccgcacgtacctagcgaagtagtcgacggcatcggcgttgagccatccgcccttggccgcaagccactgcggcagtgtcatgtggttcagcgtgaccatgggctcgacgccgttctgatggcacacgtcgatcatatggcggtagtgcagcagctgcgctttggagaagcatccctccgcaggctcgatgcgggcccattcgatggagaagcggtacatgcgcaatccggcgtcggcgagcattctgatgtcctcgccgtagcggtggtagctgtcggccgcgtctccagacggttcgttgaggtccgtgcgttcggcatgctccctggcccaccagtcgctcgcgacgttgttcccctcgatctgatgcgcggctgtggatgcgccccagatgaattccggcgggaactcgtattgttctttcatgacatgtctttctatttgatgcccgttccggcgacaccttggatgaagtagcgctgcaggaatacgaacaggaggaggatcggggtgaccaccagtaccgctccggcgagcaggacgctgtagttcgtggcgttctggccggtggagtagagggacagtgccacgggcagcgtgtacttctcctcggtctgggccgcaaccaacggccacaggaagttgttccaggaggacaggaacgtgaggatggacagcgtcgccagcggcggcccgcactggggcaggacgatctggaagaatatgcgcagctcaccggcgccgtcgaccctcgcggcctccatcagcgcgtcggggattccggagatgaactgtctcatcaggaagactccgatgggctggcacaggaacggcaggatgagcgccgcgtaggagttcgcgagtcccatgttcgagatgatcacgaacagagggacgaacgtggccacgctcggaaccatgagcgtcaccatgacggcgccgaacaagatgttcttgccggcgaagtccatcttcgccagggcgtatccgaccatggagcagaacaccatgttcccgaggacggtgatcacggcgacgaccatgctgttggtgaagtaggtgccgaagttcagctccccgaaccatttcgcgaagtttgcgagcgaggcgtgctcgggcaggagcttcggcggtttggcgaggatctccctctgggtcttcaacgagcccaacgccatccataggaatgggaagatccagaagactccgatcaccgcgaggacgcagtaggagaggccacgtcctttgacgaatcggcgccagatcggctgcttattgctttgcggcttcgatgccgcgactgtcgtggctgtcatctcaatcctccttgagaatgcggaactggagcacactgaccagcgcgatgatgatgaacagcacccagctggctgcggaggcgatgccgtactgtccgaaaccgaacttctggtacacgtagtacgcggcggagagcgtcgaatcgagcggtcctccctgggtcatcacgaaggattcctcgaagaactgcaggtaggcgacggaaagaagcacggcacccagcagcagcgtgggcttgagcagcgggagcgtgatgctacgaaaggtgcgccatttgcttgcgccgtcgatggccgcagcctccttcaattcctcggggatggcctgcaggccggcgaggaagatgatcatcagcgttcccatgttgcgccagatcgtcatggccatcagcgcgggcagggcgtagcgggtgtcgtgcagccagtccggtccggcgataccgaagacggccaggagcgagttgagcaggccgtccttctggaggatgtacctccacacgacggagaccgcgaccacgctggcgacaaccggcgcgtagaacacggccctgaagaacgcgttgaggtgcttggatcccttgttgagggccaccgcgaatgcgagggcgatcgccatggtgatcggcaggccgacaagcacgaagattccggtgacgcccaacgcgtgcaggaaacggtggtcgtggaacagggtgatgtactggtccagtccgacgaagttgacgttgaacggggtgcgaaggtccttggaggtgatgtcggtgaaggacatcgccatcgaggacaggaggggaatcagcatgaatacgcagaacacgactgcgaaaggcaaggcaaatccccatgcgagaatcgtacggcggcggcggaggacgttgcccgagccctccgtcttcgtctttcttgtcccgaggctcatgggatcagtttcccgttccgatggagtcggcttcggactgcaggttcttcaagccctcgtcaacggagacctgtcccttgtttatctgctcgaggatgcggtcggcagcggaggacacctgcgcccaggtggacagcgccggcggagccatggtgtgcttcagctggtcaccgaacgccgcgagcttgtcgttgccggagagcacgtcctcatcccatgccttctgagaggcgggcaggtcggaggacttcttgtaccattcgacctgcacctcgggcttgcttgcccactggatgaacttccatgcggactgcttgttcttggagtccttgaacgtcacgaagttgctgccgccgacgaaggacgtggcaggacccgaggattcgttcatcgacggcagaatcacggtggcgtacttggattcgaagccatcgccgcccaattcgttgatctggctgacggcggtcggcccctgcagcatcatcggtgtgctgccggatacgaaattcgctatgtcggcgccggaactcacgtcggcattgacgtccgctatgccatccctgtagaggctagtggtaaagttcaatcccttctttataccgttatcttcgaaagtccatttcgtctgttcctcattagtcagggacgcccctgccgagtaggagaacggcagagtcccaaggaacgcatcagtgccagatggattgaggttcatgccatatttgaccccgtcgaccttctgcatgtccttggccatccgcttaagctcattccacgtcttcggagctttgttccaaccagccatcccggcgatgtcggtacggtagtacagcactcgggtgtcgatgtaccaaggcacgccgagctgtttcccgtcgacctggccagcagccctagacccgtcggagaagtcggacatgtcgaggttgtcaggcacggtggagaatgagttggagaaatcggccatccaggtagtgcccatctgtgcaaggtcgggaccgttgcccgcggcgatggcggtctggagtttatcgtgcgctgaggaccatggaatcgcggtgaccttaaccttgacgtcagggttctctttctcgaatcccttagcgaaatcatccagcagatcgccctcgttgcccatggcccagatagtcaggtcgccggtggccttgcttgaattgatggtcttgaccgcatcggaatcggaatccgcgttgttcgcggaccgtccgcacgcggacataccggcaatcatcgccacactggccatgccggccacgaccgctttgaaaaatggcttcctcattaaaatctcctttgattcatatcaatctaaccgcttagattgatattacaatttaagcgcttagatttaaggaagtcaaagcgacacgcccatatgatttatgcgcttagattttttgattgcatccgcagctgccgcgcacaatgaggcggaccgggagtactcgtctttcagccttttcccaaggctccccgttcctggaaagcagcatgcgagccgcctcgcgccctatgtcctccatgggctggcggacggtcgtcagctgcggttccatcagccgtccggcgaggattccgtcgaatccggtgacgatgacgtcgtcgggaacccggacaccggcctcctcgaggagtctgatcacgccgaaggcggtctggtccgtgccgcagaccaaggcctgcggcagtctgccggatcctatcgcctcgcacagacccaccatgtattcatcggacgtggcgaaggagtcatccagcagcgcgtcgctggaatcgagaccacgttcctcgaggcatttccggaaggcgacgtagcgggcgacgacgtcgtccgaatcgaagccgccgacgaacgccatctcgtcgacatgatggacgtctacaagatggtcgacgatctgtctcattcccgaggtgttgtcgcattgcaggtacgcggcaggcaggttctcgtcggacacacccaccatcacaagcgggacggtcttcgccagcacggcgaggggaagtctgtcgttatatccggtcggcatcagagccagcccatcgacccgcccggcgatgtcggtcaccgacttatggtcgtccctcgccaacgcagcccccatgagcatgcccttgccgcttttccagcattcaagctcgaaaccgcggagcacctcgtcaacgtatagaggataggtgagaacgtctggctcgtcgtcatcggacatactggccggcatggaggatacatcggacctatcttcttcgagaccactcccctgcggcttctccagcagcatatcgaacgcgtacatgcccaacgtgcccgtcctgcctttggcaaggctacgtgcgttgccgctgggaacgtagccaagctcctcggcgaccctgaggaccttggccttggtatcatccttcactttgtcgggatgcctgaaggcgaaggagaccgtcgcggtagacacacccgccttctctgcaacgtcatacaccgtaactcttgccataagaccagtctaagcgctttgacatatgagacacacggactgaagtccaaaagcttcctctgaccgttcgcccggaaaccccggggtccgggctccagccggcaggccggcacaacaaacaaaaaaaaagggggttcccggagccgaagctcgacgggaacccccaacgaaagaatgcggcggcgtgctactctcccacaccctctcgagtgcagtaccatcgccgtgccaggccttagcttccgggttcggaaagggaccgggcgtctcacctgggccatgaccaccgcaaaaccaatacaacgtatcgccgctgccagcggcggcaacgcccttgatagcggcatagtatttggcgtattccagcatgttcgccagaagattacgcgtacgttccatgcgcagcaaggaactgtcagccgcgaaacgtttaaattccgcgtacataacgcggcctttgagcacgggttttttcaatgtaacgaccatccagtcgtgcaggaacgcatcgaatgagaggttgccgagaacacgttccatgggcagccaatagtcttcgtataaggttttctgctcggccatggaacaccccatgagcatgtagttgcgtaccaggtcggaagtctccagatcaagcccggtggaattcattgattcgaataccagttgcggttcgtcacgatcttggtccaaggtgacagacacgacttcgagacgctgcagaccgttccacaccacgttcgcatcatcgattgcggcgaccagcgaacggaacaaatcaagatttgcttccagccgggaacccgtattggcatggttcggccgatcaggggcgaccacatggtcgcacatgctgtgcagcacttccctatcgtcgtcagaaagcgtcagcttgtagcggccttcgccggttgcatacttgtcgacaaaatagccacggtcgatgcgcatgtctgcggagaatcgcaggttttcagggcgcgctcgagcatattcggccagtgcgataagcagcagggtcaccgaggtaaggcgctgctggccgtcgatgagcagacaccggctgacaccatccgggccgatgccgccttcctgcatccatacgactgacccggtgaaatgcgttctctcaggatgcctaccagccgttacaatgtcggcccacaattgccggcactgcgcctcgccccatgagtatctgcgctgatacaccggaaccacgaaccgaagcgaaccggtcaataagtccagcaggattttctttccagcgtccatggtgctcctcttcccttacctcacatgcgccgagacgccagtcagcagcacaccctttttggcacgtgtcatagccacataaatgagacttcgttcctccctgtagatatcattcaacgcagccggatcggcaccggcagattgcagcgcaggcttcggcgggcatacaccatcgttcacgtcgactaccaccacatagtcgaattccagacctttgactcgatgcatggtggcgatgcgaattccttgcctttgcctgttttctgcatccctaccaagccggtacacgccatacggcaagccgtcatcaagcgtcttataccactggtcgatgcagtagcgacttcttgctaccacacacacattacgcggatccacacgcccgccgtcggactcatcgctggccgcgtcttccgccgtgccgcacaatccataaatccattccctaacggcatccatctcatctgactgggatgcaaaccgccgcgcttcgggaacgggaccgctcatcaacgatctgctatcgccggtcggactctcccctccgtccaggtcatcgaacgttgtggccggcgaagcatcttcgataccatgaacagccgcgaacactgaatccgcgacatcggcgccggaactacggaaaatggagtcggctgcgctacgaatctgttcggtggtgcgatagttgatccgcaatttgcgggcacgcccctggattcggatgccgcatttcgataacaccgcgatatgcccgtagatgcgctgctgtgcatcgccgacgatgaagatatcatcgtctccctcatccaccagagcacgaatcacacggtatgccggcgtggagaagtcctgcccttcatcgaccaccacatgcgcatatttccttggcatatcaccctgcgtgagcaacgacacgacgttctgcatggccgtgtccacatcgtacgcgtcgttcgcctgcatgatgcgccgatacgtttccacgaccttccagacggcgagcttctgcgctcggtttagtttcgtgccgcgccccttgcgtagtacgcgcatgtaatcggctgcattccgcacctgctgcggcacaatcacctggctgagctcgcttttgaagaaggaaaccgtgagtttcgaatcgttcacgccgatggacgtgatggctttacgccacgcagcgtcaagatcattgccatggtcggggctgccgtcataccaaatctcaccggaatagccatgccccgtcagcagatcttttacgagcttgtcgagattgaccacgtcgatggtattgaattcgtctggcgtgcagatgagtttcaggttcgatgcaatatcggtggcaagattacgcgagtatgtggtgaacagcactttctgacggctaccgcttctcagcagtcttgcagcgagacgtttcgcgcgatgcatggccaccacggtctttcccgtaccggcaccgccgagcaggcggaacggaccatggtaatcatgttccacataaagacgctgcgatggatgcaggaacacacgccactgttccagcggcgcatccagaatacgtttgagatccgcttctccctgcacgaccacgaaagactgctgcgacgcatagcttgacagggcggcacggaagtcctccggatcggcctcttcaccagattcgatggacgaggcagacatctgctgctccagccccagcctgtcgctggtcttgccttcggtttcatcgagcagtccgaagacctcggacttgggaagtccttcagcaacgaaggtaaggtacgtgaaagcatcctttgggagcctggccccccaccgttcaaacgcttcccacgtctttctcgtgcacatgactggcacatacatgtcaggtacgccgaaccggcgcatgtcattatctgtcaatgcccgataagtgtctggaagcggaccggtatgaggttcgggagcttgctgtggcatctgcggcgtcttgtccgtcacagctgaagttgcaatagctgaagctattccgtgattcgtgccggtatggtcttccgtgggctggggaacagattccgacgcagcggaatctgattggggcgcgtttgcggcaacgcttccccatccaactttgttttgggaatcctcatgcatcgctgcgtcgatttcctcttgaggagccatatcgtacagctggatggccctcgtattcgggttgacgctgattcgctttgtttccgcccatttgtaagcgtcatcgtggtctccaacgtacagcaaaacgtacacgttgctgcttttctggaaagcgatgatggcgcgatatcgctggtcgatgcgcgcggaatacagtttttcgtccgccgcattggcgattcgttccagattgattccggatgatcgaggattcgcctggaattttgtcagaaacgtcgtggcatgtttctgcgctttcttaggcagctcgagcaggctgcgcatgagatcgctgccgagcgcgaccacgggtttgttcatcgtacgtatatctgccatcagcgttccatgccttccgtcagtgaagcgaacaccttgtcaaggtcatcgttgttttccgtaatgatagtccagccgcgcttgacgaattcgtcggcgttctctcggtcggattgcaagtcgtaggacgggaaaaacacgatcttcccatcctcccatgcgagctctgcctgcgcaatgatttcctcgttctcgtccagcagctcatatccgagtgcatccggtgccggtatgtcagactcaataaaccgtttgacggcctccttggtttcatccgcgcaatacacgtaggtcggatccgccagaatatcgttccattcggaatcattgtctttctgcagatcaggagcgttccgcaggccgttgcgaagcggctcgtacatggattcgtcacgtagcgcagcatcaccgatagcatggaagtattccgagaattgcatcacgttcgcaaaatgccagaaggctgcccactgcgttttgaacgcctctgcctcgttctcgtccaaagcgtccaacggattataatcatcgttctttgctttcgcggcatcacgttgaatgtccgagaacaccatgccgacgtggggttcggtggtccgcatatcctctccaatgcacaaaccggattggaatttcagtctcgtgcagttcgaaggattccaggacgagcaaatcatgaatgtcgattcgttctcgccgtgcaacgcttcattccgatgcagcatatccacggcctgaggttcaacgttcttgtttcgcggattcagagcatagctcattgccagcgcttggatggcgaatatccgttcggcatccggttccgcgagataatattccagcatggccattgccgaaacttcgctggggttgaattcgtcagtcctcttgccaatcgtgctcttgtaagccaccggagacggcatggacttgggtgccagcatcggatcggcgagctgcgccacatccttgccctgcacatatccgatcacatcgtcataatccaaggaccatatgcgatagcctgcctgacgaagcgcttccctcttcagggaatcctgggcgacgatgcctgcatggtattgcaggccatcggtgaagatggcaaccggcttccttccgtcatgctcaaccacgtcaccagattcatcgatattgctgaccgtcagcacgaaatcaggcttgcagggaatcgcgaccccatcggccggccccaacgcgacttgtggctcgacgctccacacgcttccgttcacggtgatggaatatccaggtttgctattgatgaattcgtccttgacgatggcacgacgtcccttggcatcgtcggattccgcgaagggatgggcatgcatgcaccggagagcttcgatgaactgctgttcgagtccactgtcgaacagtttgttcgtgttgatcttcgaaacggttgtcacacgactgcgtttgttggccaggtcgaggatgcccgtgagcatcgccagcgcggtcttacgggaaataagtttcaggtcctggctttgtctgtatgcatacaggcatctgtagcacccgtcgccgccgttctttgcacattcgcaatgctccatgacttcctttgccctggaaaacacctcgaacatcgtatccggatcggacagctgcttaagatagccagttcctccgggcactgtgtcatatagagcaagataggttttgcgcagtccggagttatccggcaacggctcgttcatgagtgtcgcctgtagatgttccacgttgccgaagcgttcacgcagcccaagcatcactgcggcggtcaatgactccgcagcaccgtccgcaccttgggcatcggcaagccctggcacgagcatacgcagcacttccgatttaacctcacggtataggaacaggcacgtgccgttccgctccgattgctccaactgctgttcctgcgccttcttgcgttccggacagaagtaggcgtgccgtgattcgcgctcgccgagcaacgcgccgcatttcaggcacacgttgaaaccgttacgtatctccttgctaccggcgatttccaccgaggctcccctatcagaaacctgtccgaagttgatttcacggactgtgccctgcggcgtgtagtcgaatccgaagttcgtgattcccttgaactgccatcccgattggatgtctgccggatcaatgtccaccatcgtattcttcaggaactgggtcttgggtctgctgtcggaggtgtcctcaatcaggctttcgctgtaggtctcatcggatatgacggtgtcgatgcgcagcatcggccttttctggccgttatcggcccactgcattgacccacaggagggacagctggcgaggttctcggtgctggaggcgggttccgcgtgcgaacagttcgggcataggcgccacattgccagttcgtcgtcggcaccgcctttcgaacatagcacgcggctgattttgtatttgcgtccgcccgcgaagaacgtgtttcccggcgccagttccgtgatggccgtggccgccgggcgtacgaaatcacgcgtggccttccccttgcgtttcgtcttgtcctgcgcggcaggctcgattccgtgtgccgcatcggacggttccttgtcctctttgaggatggtgtggagggtcacaccggtttccgggaacgcataattgggcaggataccttcgtcggaaaggtagttgaacgtgttggtgttgagaatgcttgtgacgatgcggccaagattgtgaatctcatcttcgcattcgcgctgctgctcttcgaacgatgagtcggagggcttcttcttgagctcgtcgagcaactgcctcgcagcgctcttctgcgattccagcgttctgacggtatcgttggttttttggaacacatcgtagacgcgtctggccatggtgctgccatcttccgtaccgcgtacgaatccgtcgagctgcgttcggagttcctcggagaatgagaacattcttccgaatccgtcgagcagttcgccagaatgttggcctgtccagttcaggaaattcaccgggaacccgctggagccgctgccgttgacattatccaaacagtttttcaatttgtcgggtaccacatcggccggttcgctgccggcatccagcatggcatgcacccaacgatccaatgcgtaggcggtgagctgacgctccaacactgcggtcgcgtcgaggaagatgtgcggcgggttcaccgcgcctccaagcatatctttcggacgctggtagaagtacgtgtcgtgttccttggtattggccaccgccagcaccaaggagttgccgtcacgtcgccctgcacgaccggcacgttggatgtactgggcttgggtaggcggaattgacgagagaatcactgtggagaggtctccgatatcgatgcccatctccagggtcggcgtacaggcgagcacattcacgtcgccgggcttgcggttcttgcgcttgaattcctcttcgaccttggcacggtcatcgccattgagcagccccgtgtgttcggcagcgtggatgcgatcggctggctccccgcagtacagcttgccatagtagcgcaattccagggcttcggcttcgggagtgccggagaccagtctgcccgggcatttgcggatacggcaacgtgctccgttccacgcgtcaaggttctgcgtagcgcacgaatagctccgtccacacgtgtcgcagatcaactgcgttaccttgccactgaccatgcaaccggactcgttgagcccgtacacggtgcgttccattttcatgcttggataacgttgctgcgtgatgaatcctgctgctatgcactcttcgagcacgattcccaacagctcgtggtggatgtcgccttcaagggcgccgtcggtgaggtaccggtcgacgatctgacggtatgccggcgaattcagggtattgaaaacgcctttgcgcactggctccttgtccgacaggaaatagggcataccatccgcgtacatgccgggcatccatttgatgttcgtgttggaaagcaggaacttgttgccgtcgttttgcaggaactggtcataggtcacgtcgaagaacgcgcctttcgtgcgcagctggtcgaggaacgccataatcagtcggagccagtcagtctccatgatggaattctcgtgcaatccgatctcgttatggcaacgttcggcaacggtctgtgccacacgtttcaggagaatctggtcgaatgctattgcggcgcagccggatttctccaacgtacgtccggtacgggagcgcatgccgaattccagcagcgattccagtcggagtctgcgctcgatccaatcgagcagctgacgccggccgggccctgcgggattgccttgcaatacggcttcgtattcgcgcatccatgtcatgttcggcgcgatgaatcgcacgatgtattcgttgtcgtccggatagcggcgatggtagtagtcgttctggctgttgagatattcggcgagggaaacgccgtccttgtgttcctcgcgcatgtagtccatggcggagttgcgcagggcgaatcgccaggtgcgggagttgaacacgctggctcggtaggaggcgtcctgcacactgtcggagaacacgatggccttgctgtcgtcgttgaaggagtctccggaaagttgggtgagcatcacactgacctgcgtggtggttctcacaccgaccatggcaatgtcctgttcgctgccgcagaacggacaccgatagtgcttgcggttgccggatacaagctccatacccctagcgaccatgggtatgcgccgctctccacaggccgggcattcatgttccgtggattcgaaacgttctacggcctgttccttcatgcatgcattgcagaaccagaccatggctccgttgtcggcatgcgggtcaagaacataatccatggtgcagggttgcaaggtcaccaacgcattgtcggcatggtaggcgaaatactcgttgtagaacgttcgtgggtcacccatgctgatgccgccgtctttgccggcaagtccaatccatgcggttcctccgcaatcacggcagttaatcaccggcatgcgggtcttgaggtcgtctttggacagttcgacgaccggacggtagtcgatgctcccctcctgcgaggtgatgttggcgaccacgcggccgagttccttgacccatagctgcacctgcacgttcaggaacggacgtgtgtggccttccgaaccggtgcgcgcgtgggagacaagcgctatcagcgcgtccacacaggccttctgctgacgcggatacaaggcgttgaacctcgcgtccataatggcaagcctatccaacagtttgcgatcgatttgctggggttcgtcgcagatgaacgaggacaggctggccaggaaccttgaatggcggagggattcggcgagccggatgcgtgccttatctgtggagcttggctctgtgggagcttcgtcaagccatgcttgagccgcaagggcaagatattcgctggggtcaacatcctcttcgagttcgatgagccggtcagcttgcgcggcagtaggcatggtgtcgtcgtagtcgctggtgacgaagaattcgtcgacgcgaagacgatcctcagtcaccacggattccggtgtgaacgtggtgttgaagatctggttggcatacgcgcagacgtcgcgtactgtctcttcagtgcccatggtggccgacgtgccgacgaagcacatgttgtcgctggtggtgttcagcctatcggtgagcctgcgcagcaggcaggctaggtcggtgccctgtgcgccgtcgaaggtgtgcaattcgtccacgacgaaatatttgagcgtgtccggatcattgctgtcccagatccgggagtctttggggcgcaccagcaggtagtcgagcatcttgtagttggtgagcaggatgtccggcgggttcttgagcagttcctcatgactggtcacgatgttggtggcggtcatggcatgattgtccttgtcgctgccgccttggctcatctggcccacatacatgcccgcggtcacattgttgcgcagttccggactgtcgtggatgagttcggccaatcgtttcgcctggtcggtggcgagggcgttcatcgggtagacgaggatggccttgatgcccttgcgtccaagtctacgctgccggtagcagtagtcgaggatcgggtacaggaaacattcggtcttgcctgagccggtgccggtggccaccagtgtggattcgccggcggcgatgcgtttgaatgcgcgcatctggtgcgcgtatggccggtacgaggggtgcaggcatgggaacgggaattccgcgtgtttgccgaccactcggaacggcagtttgactgatacgaacggctcctgggaaagcatgccttcctgatgtgcgagcctgcggatggagccacggaacggcatattggtcatggggaacgtagtctccacgtaatcggcgagtccggactggatgtgccgtgcaagcaccatcttcggtggcccagatgttgaatccaagctccaccagtcgcgcagcgaacaacggcagctgacgcttgtcggtatcgttcacggagatgaacacgttgccgctggtcggcagaccgccatcgtaggcggccagctggctcttggcgaacgcatgcgggaagtcacggtcgaagcccatgacttcgccggtggaacgcatttccggtccgagcagcacgtctacggtcttgccgagcgacgtacggaagcgcttgaacggaagcacggattccttgacggcaacctgctggccgcggcgaatgtcaccaccgtctccatgaggcagcagcaagccgttatcgcgctgctgctggatggtttcgccggccataatgcgggccgcggccttggccagtgccacaccggtcgccttggatgcgaacggcacggtacgggaggcacgcgggttcgcctcgataacgtacagggtgttggccatgaaggcatactgcacgttgatcaggccttgcacgccacagcccttggcgatggcataggtgccttcgcgcagacggcggatctggtcatcggaaagggtgctcggcggcagagtgcatgcggcgtcaccggaatgcacgccagcttcctcaacatgttccataatgccgccgatatacagctcttcgccatcgaacaaggcgtcgacgtcgatttccacggcatcctgcaggaacttgtcgatcagcaacggagaaggcagacggccagaaaccacggtatcggcctgagcttccttcaatgcgcgatccacatacttgcacagctgggcgtcgtcgtacacgatttccatgccgcgaccgccaagcacgtagctcgggcgcaccagcaccggataaccgatgttatgagccgcctcacgggcttcgtcaaggctcagagcggtgccatagcgaggcgcgttcatctcggccttcttcagcacttcgccgaagagctcacggttttcagccagatcgatggattcaggcgtggtaccgagaatcggaacaccggcagccttcagacgagccgccagagacagcggggtctggccaccgagctgaacgataacgcccttgaccggacccatcttcttttcggcctcgtagatttcgagtacgtcttcgaaggtaagcggctcgaagtacagacgatcggacatgtcgtaatcggtggacacggtttccgggttgcagttgaccatgatggtgtcatagtccttgcccagctcctgcacggcatgtacgcaggtgtagtcgaactcgatgccctggccgatacggttcggaccggagccgagaatgatcacggcttcacgctcacgcggacgcagttcactttcgtccgcatagcaggagtaatagtacggcgtgaccgcgtcgaattcggcagcgcaggtatcgaccgtcttgaaaaccggacgaagatcatacgaccaacgcagttcgcggatcgtgttttcgccttcgtcgcccaagtggcgcaggtgtgcgatctgaaggtcggaaagacctgccagcttcgccttctttagcagcttgcggctcagcttgctcgcttccttgatttcaagggcggtctcgttgatgagtacaaactggcggatgaaccacgggtcgatcttggtggcatcgaagatctgctgttcggtggcgcctccccacagggcgcgctggatctgcagataacgatgctcggtcggcaccttgatggcttccaacagctgctcgacttcctgtacgtcaggcttgtcgccgtcccagttgaagcccatgtggcgcttgtcgatggaacgcatggccttgccgagggattcctggaagttgcctgccagagccatggcctcgcccacggacttcatggaagtggtcagcgtcggatcggcacccgggaacttttcgaaggcgaaacgcgggaccttggtgaccacgtagtcgatggtcggctcgaagctggccggagtggactgcgtgatatcgttctggatttcgtcgagcgtgtagccaagagccagcttggtggcgatcttcgcaatcgggaagccggtcgccttggatgccagagcggaggaacgggacacacgcgggttcatttcgatgacgatgatgcgtccggtgttcgggttgatggcgaactggatgttgcagccgccggtatcgacgcccacgccacgaatgatggcgatgccgatgtcacgaagcttctgatactcgcgatcggtcagagtgaacacaggcgccacggtaatggaatcgccggtgtgcacgccgacaggatccacgttctcaatcgggcagacgaccacgacattgtctttcttgtcgcgcatcagctcgagttcgtattccttccagccttcgatgccttcttcgatcagcacctcgtcggttggggaataatggatgcctgcgcctgcgatgcggtgcagttcctcttcgtcgtgcgcgatgccggaaccaaggccacccatggtgaagcttgggcgcacgaccagcggataaccgaacttttcggcgatcttgtcgacttcttcaatggagtgtgcgatgtcggaacgtgcggattctgcaccagcttcctcaacgacctttttgaagagctcacgatcctcgccgcgatcgatggcttccagagaagcaccgatcagctcgacgttgtacttcttgagcacaccggcctcacccaacgccatggccgcgttcagcgcggtctggccacccaaggtcggcagcagcgcgtcaggacgttccttggcgatgatctgctcgagaatcggcgtggaaatcggctcgatgtaggtggcatccgccatttccggatcggtcatgatggtggccgggttggagttgacgagaatgactcggatgccttcctcacgcaacacgcggcaggcctgagtgcccgagtaatcgaattctgcggcctggccgatcacaatcggaccggagccgatgaccatcacggacttgatgtctgtgcgcttaggcattgtgggttccctccttggcggaacgcatgagatccacgaaacgatcgaacaggtatgcggcatcgtgcgggccggctgcggcctccggatggtattgcacggagaatgccggaatatcaacgcactgcaggccttcaaccacgttgtcattcagatcgatgtggctgacgaacaccttgccgtacttgccgttttcaaacggcgcgtcaacggtttcgccgatcggcgcgtcaacggcaaagccgtggttgtgcgcggtgatttcgattttgccggtggtcatgtctttgaccggctgattgatgccgcggtgaccgaacttcagcttatatgtgccgaagccgagcgcacggccgagcagctggttgccgaagcagatgccgaagaacggatgacctgcgtcaagtacctggcgaagcaggttcacttcaggatcggcctgttccggatctcccggaccgttggagaagaagacaccgtcaggattgagggcttcaagctcatcgaacgtgatggtggatggcaccacatgtacacggcagccacgctcggccatacgatgcggagtcatggccttgatgccgagatcgaccgcggcgacggtgaacagcggttccttgccttcgaattcaccacacggctcgatggtataggcttctttggtgctgacttcgtcgtagaggctcatccccttcatctgcggagtggacttgacctcgtcaagcatggattcgatggtacgcagcttgccattggcgtcaagcagagcatcaccggagaaaatacctgcacgcatcacgcctgcggaacgcaggtggcgtacaagcttgcgagtgtcgattcggctgatgccaacgatgtgattggattccaaatcgtcatcgaggctgccggtggcacgccaattgctcacattcgggctgggatcgcgcacaacataaccggcaacccagattcgtgaggattctggatcctccccattgattcccgtgtccccaatgtgtgggaacgtctgcaccacgatctgacgatcgtagctggggtccgtaagcgtttcctgatatccggtcataccggttgcgaaaacgatctccccgctggtcgtgccgatcgcgccgtaaggttcacccacatacacctgcccgtcttcgagaacgagaacggcatcttgagggtcaaacatcacggcttcggaatcatactggttcaccaaaacccccttatagtcaaggtattcgtaccaaggatagcggccggttaggactcgcgacccggccgaatcgcttaactttcagctttattcagctgaaggttcggtcggttgctcatccacttgagcggcatccgcatcagcgcttaccgcgctgagcagaccgtggatgaatgccggtgattcgtcatcacacaacgtcttggcaaggccaagcgcctcgtcgatggccaccatattgggaacatcatcattgaacatgatctcccatgcggcgatacgcagaatattgcgatcgacaacgcccatacgcttgaccttccaaccggtggaatgctcgtcaagcgtggaatcgatggctgcgatatgttccgcaacgccacgaacgatttcgatggcgtattcaggcagcggagtctgggcgccgggctgctcaatgcgctcagcaagaagggacaggatgtcctgtcccttctcatccgcttcatacaacgtattcagagccctcttacgagcggtggaacgtgccatgaaacttctttcgtccttactctcagttctcgcggccgaggtaggagccgtcggtggtgttcaccttgaccttctcaccttcgccgatgaacagcggaacctgaatctcggcaccggtctcaacggtggccggcttggtaccggcgttggaacggttgccctgcagacccggttcggtatgggtaacggtcaggatcacggaagccggcagttcgacggacagcggggtgccgtcgtggaaggacacgacgcagtcggttccttccagcaggaacttggcctgatcgccgacgagagtctttggaatgtagatctgatcgtaggtggtcatatccatgaacacgaagttgtcgccgtcctcgtaggagtactggaggttgcggttatcgacggtttcgaattccatcttcatgccggcattgaaggtcttgtcaacgatcttgcccgagaggacgttcttgatggtggtgcgcacgaaagcggggcccttgcccggcttgacgtgctggaacttgatgacggcccacagctggccatcgaggttcaggacggaaccgttcttgatgtcattggtagtctgtgccaaattaactcacctatttcttcgtctaacagggaaagcttaaaagagccttgctcattatgccacggtgtgcatactttgtcggtaagccttccatatataggaaaacctccctcggcgaacatgcctcgggaggttttcctaaaaaacgctagttcaagcgtgccctgatatcaagcagaaactactcgatgatcttggtgacacggcccgagccgacggtgtggccgccttcgcgcactgcgaaggtcaggccctcctccatagcgatcggctggatcagctcaacgccgaaggtagcgtgatcgcccggctgcaccatctcaacgccttccggcagggtgataacgccggtgacgtcggtggtacggaagtagaactgcggacggtagttggagaagaacggcgagtgacggccgccttcgtccttggtcagcacgtagacttcgccctcgaacttggtgtgcggggtcacggagcccggagcagccagaacctggccacgctcgacctggtcacggttgatgccgcggagcagcagaccggtgttgtcgccagcctcgcactcatccatctgcttgtggaaggtctcgatggaggtgacggtggtggtctgggtcggacggataccaacgatctcgacgttggagttgaccgggagcttaccacgctcgacacggccggtaaccacggtgccacggccggagatggtgaagacatcttcgatcggcatcaggaacggcttgtccagatcgtgagtcggggtcgggatgtactcgtcgacagccttcatgagttccttgacggactcaacccacttctcgtgatccggagcgtcgtcgtgcagcgcgccgtaagcggaggtgtggatgaccgggcaatcgcgatcgaagccgttttcgtcgaggaggtcacggacctcttcctcaacgagctcgatgagctcttcgtcgtcgaccatatcgcacttgttcagagcgacgaggatacgcggcacgcccacctgacgagcgagcagcacgtgctcgcgggtctgagccatcgggccgtcggtggcggccacaacgaggatagcgccatccatctgggcagcgccagtgatcatgttcttcacgaagtcggcgtggcccgggcagtcgacgtgagcgtagtgacgctcagcggtctggtactcgatgtgggcgatgttgatggtgataccacgctgctgctcttccggagcggcgtcgatctggttgaagtcgtaagccgggttgatgtccgggtactcttcgtgcaggaccttggagatggctgcggtcagggtagtcttaccgtgatcgacgtggccgatggtaccaatgttaacgtgcggcttagtacgctcgtacttttcctttgccatgtgttttgtcctcctggacgtctcgtagtaagccttgaactcacttcaaggcactcgctacattttactgggtttgacgggtttgtgccactttggagcccgaacccagtcagcgctacaaaatactagcgctgactggagacagtttccacttaagcggcagcgcgtgtcactcgccgcgctgggccttgatgatctcctcggagacgttcttcggaacctcagcgtaggagtccatctgcatggtgaacattgcgcggccctgggtcttggagcgaaggtcgccgatgtagccgaacatttcggacagcggaaccttggcgtcgatgaccttgacaccggtggagtcggtcatggactggatggaaccacgacgggcgttgatatcgcccatcacgtcgcccatgtactcttccggagtacgcacttccacggccatgatcggctcgaggatgaccggcttggccttcggagcagcttccttgaagcacatggaacctgcgatcttgaaggccatttcggaggaatcgacgtcgtggacctggccgtccgtgacggtagccttgacgccaaccaccgggaagccggcgagcacgccggattccatggcttcctgcacaccagcatcgatggaaggaatgaattccttggtgatgtggccaccggtgacctcgttgacgaactcgtaggtctcgccctcttcggtgttgagcggctcgaagttcatcaagacctttgcgaactggccggaaccaccggtctgcttcttgtgcgtgtattcctggttcatgacggccttgcggatcgtctcacggtatgcaacctgcgggttacccacgttgcactccaccttgaattcacgacgcatacggtcgacgatgatgtcgagctgcagctcgcccatgccggagatcagggtctggccggactcttcgtcggtcttcacctggaaggtcggatcttcgtcggacagcttcgccagagcgatgctcatcttctcctgatcggccttggtcttcggctccacggccacctcgatcaccggatccgggaaggtcatggattcgagggagataggtgccttttcgtcgcacagggtgtcaccggtggtgatgttcttcaggcccacgaaggtgtagatgttaccggcttcggcggcatcgaccgggttctccttgtcggcgtgcatctggaagatcttgccgacgcgttccttcttgcccttggtggagtcaagcacggtgtcgcccggggtgacggcgccggagtagacgcgcacgaacacgagcttgccgtagaacgggtgggtagagatcttgaagaccagggcagagaacggatcatcggtggtcggcttgcgatcgatctcgatggattcgtccttaggatcgaaaccgacgatggacggaacgtcctccgggctcggcaggtagtcgacgacggcgtccagcatcggctgaacacccttgtccttgaaggcggagccacagagcaccgggtaggcttcacggttaatggtgagcttacggatgccgctacggatctcgtcctcagtcagttcgccggactcgagatacttctcaagcagctcttcgtcggattctgcgacctggtcgagcaactctgcacgatactgctcggccttgtcctgcaggtcggccgggatgtcggtagtgtcgtagtgagcgcccatgtcgccggaaacgtcgttccagacgtaagccttcatacgaatcagatcgacaacgccagcgaagtcgttctcagcgccgatcggcagctgcacgacaagcggggtcgcgcccagcttggttttgatggtgtcgacggagtagtagaagtcagcgccgagcttatccatcttgttgatgaagcagatacgcggaacgccgtacttgtcagcctgacgccacacggtctcggactgcggctccacaccttccttgccgtcgaacacggcaacggcaccatcgagcacgcgcagggagcgctccacctcggccgtgaagtccacgtggcctggggtatcgatgatgttgatctggaacttctgcttctcgtcatgggtctgacggttccagaagcaagtggttgcagcggactggatggtgacgacaccgtccaaattgaacgctcagggtgttcaggaacaagtgccgacagtgaacacctttattcgatcacacacagctcgcccaaccgcgccagcgcatcctcatcgctgacgccgtcggccttggcaagaccttggaggctggcatcctgatggcggaactcatcaagcgccgcaagggccgccgtattctcgtggtaacggcgaaaagcatgatggttcagtttcagaaggagatgtgggagcgattcaccattccactgatcagtttggattcctcgcgtatccagcagattcgttccgagattcctgcgaatgccaatccattctcctattacgacaaggtgatcatctccatcgacacgttgaagcgtgacatccaatatggcgcggcgctcgatgcctcgtattgggacatcatcgtgatcgatgaggcccagaatgttgccgaccgtgccgtcaacggccgtagcgcacagcgtgccgagcttgccaaacgacttgcctcccgttccgacacgttgattatgctgtccgccacgcctcatgacggccgcgctcgcagtttcgcttcgttgatgaacatgcttgacccaaccactctgcccgatccggagcggtacgacaagaaggatgtcgaacacctgtacgttcgccgtttcaagaaggacgtgatggccgaagtgtcaggcagcttcccagaacgcaaggtgacgcaggagaaatgcatggccactgcagtcgaggaagaggcattcgattacttgactgatatgaaacttgtcatggacatgcatcagaagagaagcaattccttcctgttcaagacgatgcttgagaagagtctgttttcatcgccggcagcgtgcatcaagaccatcgacgagcgagtgaagcggcttgctaaaaaagatgcgtccgatcagaccggagacattgacgggcttgaagggctcaaggctgccttggagaagatcggtccgatgcagttttcccgataccagagactgctgcagcttctgcgcagtgccgattacggttggcataacggtgaagacgccgacgaccgtatcgtgattttcacggaacgcatcgagacgaagaactatctcgaggagcacttgcggcaggatctcaaactaccgaagaaggctatcgtctccatggatggaggcatgagcgatgtggaacagcagaaaatcgtcgaggatttcggtacgaagtcctcgtctgtacgtattctcgtggcctccgacgtggcctctgaaggtctgaacctgcactatctgagccacagactcatccatttcgacactccatggtcgttgatggtattccagcagcgtaacggacgcatcgaccgttatgggcagcgtaaacagcctgatattcgtttcatgatgattaactcgcgtaatgcaaagattcaaggtgacgcgcatattctcgagatcctgcagcagaaggaagaccaggcacgtaaggatatcggcgatccgtccttgctcatgggcaaattcgacgtcgatcaggaggaaaatttcacccgcgaagcgattgaatccggcgaatcagcggagaatttcgcagccagactttgtattcctgatgaggacatcgatcattcggacgaacgttccggagacgttgagactgtggcggatgacgatgttttcgatccattgagttttttcaacctcactacgccggatggttccgatactacgagcactgaggaaaacgagtccgcaggggagagcacggctgggagcgccgacgatggcggcatagtcgattcctctacgctgatgtcggattacgagtatgtggatgaggggctctcctgcgaagagttccggcagtcggctggtcttaaatcgaaacgtcagttgcgtgatgctcatggattcgcggtggagttccaaggggatagcccgttgcgcgcgtggctgcgcagacgtgtgccgaacacgcaggtgttgcgagataacatcgctgaatggagtgatgacgcgaaatactgcgaagaccaagccaacggtctgctggcccgtatcaacgacgagtcatggagtcgggtccaatacctgtgggaattgaatccaatcacggaatgggtcgggttgaaggcttcctcactgctgtaccaacgtgacgaggccccgattattggcgtgaccaacggaaacctgcatgcggatgagacgattatgctgatgaacggcatggtcgccaacaagcacgcatccccggtgatcgatgaatggttcggtgtacggtatctcgatggcgaatgcatgggcatactgccacttgaggaagtgtggcgtatcaccggatatcgtgggaacttgattccgggaaccactgaacgtcgttatgtgaatcgagaggattccgcggccagctccgaacagatagatgcggcacaactgctgttggaggatgcggtatcgcgcggcaagagcatgctcagcgattgcggtgaacaatatcgtgcgcaggcagatgaagaagtgactcggcaaatggaccgcatcgagcattggtcccatgcacgcaaggcactgttgcaatcccaaggcaaaaacaccaaggaaaatacaaaacaggttgatcggatgctcgaacaatatgccgactgggttcaggacacattggacgcctccggcgaaccagtgatccgcattgcggccgcattcgtaggtaaggaatagagggggagaccatggcgaaggaactgaacgagacattcccaggcatcgaggcggtcaacgacttctacacgccgtactacatgaaggaatattttccggatgaagtgaagaatgcctccgcaccttggaaacagcttcctcctgagaaacgcccagcgcgactgctgaaggacatgcgccagtcgttcaccgaagtcatcaacaacaacgagaacgatctgtttccagctgaacgggtacggaatttcatcgacggcatgctcgccgcactcggctatacgcaggaggggaatcaagccaaagacaagggattgcccgaccggatttcagggaagtctgttcctgtctactatcaggtcaatgattccgatggggctccgcgcttgcaagttctggtgagcctgtccgatagtgcggaggcaggcgttctggaaagccccatcgaagacggctctggcaaggacggcacctcctgtgaggaatatgcacgtatgctgcttgccgatttcgacgagccggcacggtggattcttcttatggggttgcatcagatagcgttgatcgaccgccgtaaatggaatgacaagaaatgcatgctgtttgacctggacgagatcttcagccgccatcaggatcatgtgtatacggcgatggctgtgctgttgcgtcgtgatagtctctgcccgaacaaaggtgacagtctgcttgacgcgtttgatgacacgtctgcgaagaacgcggttgaggtgtctgacaatctgcgttccgcgttacgtgaatgtgtggagatccttggcaacgaggtcatccacgactggacttgtaataaggggcgaagcatcgacgaaatcgacgcaggcgacctgactgtgcaggcgttacgctacatgtaccgtctgctgtttctcctgttcatcgaggcgaagccgtcgctcggctacgcgccgatgaaatccgacatctaccgtaccggctattcgctggatagtctgcgagatattgcagaacagatgcgtggtcgcatggatgaggctggcgattccacctatctagcggacacattgcgccgactcgacgatctggtgttcaacggttacccgaaggcggatgaggatttcaaggggctggttggcgaggaagccatcaatgcggtgttcatggttccgccgctcaaggcgcacattttcgatccggagcggaccgtgctgattgaacatgctgcactccgcgacagcgtaatgctgcgcatcatagacctgatgagcgtcaccaagactggtaagggagtcaaacgcaggcagcgcatctcctatgcggccctgggcatcagccagatgggtgccgtgtacgaggcattgctgtcctaccgtggttttatcgccaaggagaagctctacgaggtcaaacgcgccaaggattcctacgaccctttgaaagtcggctactttgtgccggaacgcgaactcgacaactattcggagagtgaacgcgtccgttacccggacaaaagcccgcatgccggcgagctacgcacctacgagccgggcacattcatctaccggcttgcaggtcgggaacgcgagacttcggcctccttctatacgcccgacagcctcgcgcaatgcctggtgaagtacgcgctcaaggagatcgagccacgtattcaccaagccaccgatattctgagtttgaaaatctgcgaaccggccatgggttccgcgaccttcctgaacgagaccatcaaccagctggccaccatgtatctgaaccgcagggagaaggagcgggtcgccgaggaaggccaacgggcggcgattcctgcggaacgccggcaggccgaactgcagaaggtcaagatgtacatcgccgaccacaacatctacggcatcgacctgaaccccgtggcggtggaacttggagaggtgtccctatggcttaacaccatctgtgaaggatccttcgtgccatggtttggcacccagctgcaatgcggcaattcactgatcggcggccgccgcgtcggataccttgagtcggatctggccagcacgaccaaaaaccgccactggtatgaggtcgagcccaagcatatcgggttcaaccagagctcgtcgtccgtcaagcgcgtctaccagttcctgaccggggacccagacatgtgcaagtacgacgacaaaatcgtcaaaagcatcgaatccgaacatctggaaaccatcaaggcttggaagaagaattttgccaagaagccttattcccagacggagattggcctgatgaggtcgttgtcaaagaccatcgacgaactatggcgcggccagatcaaagcgcgccagcaattggagaaggcgactcaagacgatctgattatctacgggtttgacgcgaacgcctccaaaaagaccgcgaaggctttggaaaaccagcagaagcatgggcagggctcgctcggcatcgaaaatgaatacttccgtggcaacaacctcaccatccgtgagaaggacgagatgcttcgcattgcctaccattcggagaaggccgagaacgccagcgaatacgctcgtttgaaacttgccatggactactggtgctcgctgtggttctggcccatcgaccaagcgaacctgctccccacaagatcgcagtacctcacggaaatgtcgctgatccttaccggcgagatcccgcaggaagaaggattcacgctgacatcgatggacaacggccagcctacgttcgatgatgccatggacgacagccacgagcgcgattacatgtatgaccatgccgtggatttgaacgagctatgcaaaggcgacggggaacccgcacaaaggcttcgcttggtgaagaaaattgccaagaagcagcgtttcttccattgggagctcgaatttgccgacgtgttcaaagacggcggtttcgacttcatggtcggcaacccgccgtgggtgaagcttcagtgggaggcggccaatgccatttccgacgtgaatccgaagtatgcggtccaatcgatcagcgcatccgatttgaacaagaaactacccgaattgttgaagaaccagcgcacgcatgacgcattcatcagcgaatatgtttcaacggccggtcagatgtcgttctacaacgccatcggcaattatccgctgctgcaaggccaacagacgaacctgttccgttgtttcctgccgaacgcttgggattacacgcgcaagcatgacggggtgagtgcgtttgtgcatccagacgaactgtatggtgacacgagagcgggcatactacgcgagcagatgtatcgcaggcttcggcaccatttccaattcatcaatgaaaggaaacttttcgccggtgtccataacgaaactatattcagtctgaacgtgtatcggaatccgaatacggattacaatcttccccgttttgattccatctggaacctctacgatcccaagaccatcgacgaatgctatgcgtccgatggctcgggagccgttcccggagtcaaaaacgaactaggcgaatggaatacgcgagggcacaagagccgtgtcatttccatctccaagggtgaactgtccatgttttcccgtctggttggcagcggcgaatcgagcggatggttacaagcgccaatggttggcatgcatgcgacggagttgctttctgcactggagaagatgtcggagattcctcgaacattgaggaactatgctgatgaaatcacatattcgggaatgtggcatgaaaccaattcccgtaaggatggcaccatcaaggatgacattcatttcccaacctcaacgaaagcgctaatctactccagcccatttataggtgtcacgaatccacttttacaagtggcgcgccaaaaatgtcaaactaatcgagattacgatccgattgacctgaccgacattccagcagactatatgcctcgcgtgaaatactcgcaggcatgcacggatgcggaatatgaggcgcgtgtgcaaaaaatggccgatccgaatcaagaagacggtgctgctggccgatttgatgccgtttataggctttgtaatcgcgaatacgtcgggcttagcagcgaaaggacactgcaggcgtcctgtgtgcacccaggcgtagcctgggtgcacaccatagcaggctatggtgttcacccagagcgctacgcgttgctcgcgctcatgagcggcctggaggccgccttgccttacgatttcttcgtacgctccgctggaaagccacacattaacagatccgtgctggaatctttaccagttccggcaagtgtcctcaatcctgagatccgtctccgtggtctactgctcaattgcctgaccaagccgtatgcgaatttgtggcaatcctgttgggacgagacgtacacgtccatgagctgggcgaaggatgatcctcgacttaccgccgatacgttcacctcattgacggacgagtgggactggcatacgccattgcgtacggactacgaacgccggcaggcattggtggagctggacgtactggcatccatggcgctcggcatcaccttggacgagctcattgacatctacggattgaccttcatggttcttaaccagtatgaagcggatacatggtatgacgccaacgggcgcgtggctttctcatccaaaaaagggtacgggaagctgaccttcgaccgtcccgatttcgaaagaatcaagaacgcgcctgcaggcaaagtattcactcgcaccatcacagacgacacccagccgggtggtccacgtgagcggaccatcgaatatgtggcgccgttcgacaaatgcaatcgcgtagaggattacaaaaccgcgtggaagttcttcacgcagaagtatggagatgccaaatgattcccatggtgcttgcacggcacatccagtccggactcgccgattacgtggagactacgttccccatgaccaatatgccgttgaaccttcaaaaccgaattcctcgcgcaggcaacgttcgatgtatcggcggtaaccatgctcaaggaagccggtagcgaaaatcacgaaacgcggtggacgcgtcgaagcctgcgtcgcgaacaagatacgcggctgcttgcctccacgcagtggatgcggatgggcggcttggattttacccaagaacgcattgagcttaccggtcggaatacgctcgtcccatgattccagcgctccacgcatggctctggccagacggttcgtatgccatccggttttagccgacagattcacgcgctgagcccacgttacacggtcgaattctgtcttccacaagcgttccattcgctgacggtcgaaatcatccatcaaatcccacttgttgaacaccaaaacgatgcatcgaccggcgtccactgcttggctcatcaccttcaaatcctgatcggaaatcggttgggaagcatcaaacagcaccagcgcaagttccgaacgctcaatcgcggcctgggtacgcaaggatgagaaatattcggcaccagacagcttatgcaggcgacgcttgatgcctgcagtgtcgatgaacagccaatcctccccatcaaccgtcaccacttcatcgactggatcgcgagtggtacctgccaaatcattgaccacagtacgttcctcgtgagccagctgattcagcaaagacgacttgccgacgttcggtcgaccgaccaacgccacacggcgcaaatgggacggagtaaggaaaccggatgttttctcagccttcttcaacgaatccaaggcagcgtcaagcagttcgccaataccgcgaccgtgcatggcggaaatgccatacggctcccccaagcccatcttccagaattcagcggtcaaatattcgctctcacgatcatcaaccttgttcaccgccagcgtgaccggcttgccggaggcgcgcagcatcttgacaatgcgctcgtcggtgttggtaagaccaacctggccatccaccacaagcaccacagcgtctgcaagctgaacggcgatctgcgcctgggatgcgatggcggattcgataccttcgacgtcggcttcccagccaccggtatcaaccagcttgaaatcggtgccggcccattcggcatcgtagctcacacggtctcgagtcacgccgggagtgtcttccaccacagcagcgcgacggccgagaatacggttcaccagcgtggacttgccgacattagggcgcccaacgacggcaagcacgccaaccggcttcgggccggaccggcgttcgccgccaacgaacgacgatccatcgatcagtccttcatcgccctcatccaactcataatcgtcaagattggaagcgtactggcgatactgctgctcttcgatggcatcgtcgacaatgcgcacaagcacatcaagcgtttcgccgaaattcaaatcggaattatcgacggtcagcacgccttccgcggcagatgtgaaattcgtgaccttggaatcagctgcatctcgcgccgcaacattttctgatccgacaccatcagttgactgaccggaacgacgagcctgtcgcacctcttcacgggcggtgagcaacacacgcacttcagcatccggcgcaacaaccgtagtgatgtcacggccttcggcgaccactccggcaccctcagaaaaagagtcagacgcagcttcgcgtgcgatgtacgcgcgttgagcggcaatcagcacgtgacggacgggaatgatgttcgacaccttggacacatgggatgacacttcggaggaacgaataacgtcgctgatgtcttcgccgtcggcatataccttcgaatcgtctggatcgacgctgatgtcgaaatgaccttcggtaaagaactctcccacggtttcggtgaccagttgttcatcgatcgtctccgcgtcaaggtcaatgcccttgttcatgcaccaccatgcgcaggcacgatacatggcaccggtatcgaggtaagcgaaaccgtaatatttggccaacgccttggatgtggaagacttgccgacacccgcaggtccatcaatcgctacacgaatcacaggcccaccgccttggacagggaacgcacctcggtctgcgaaagcacacggtacgatccggatttcagatcgccaagcttaatcgggccgatctgggtgcgtaccagacgcttgaccgggaatccgatcgaaccgaaaatgcgacggacgatacggttcttgccggaatgcagcacaaccttgaccagcgtgctgtcgcggctggcatcaagaatcgcgcaacggtcgagcttgatccaaccatcgtcgagctgcacgcctgtagtgaccagtcggcggcacacctgaccgctgatgcgaccttccaacgtggcgatgtaggtcttctcaacctcgtacttggggtgcatgacgtgctggctgagctcgccatcgttcgtcatgagaatcaggccttcggaatcataatccagacggcccatgtggaaaatacggtcatacttgtcgccgacgatatcgctcagggtgtagcgtcccttcggatcctccatggcgctcagcacacgcttcggcttgttcaaagcgagcgtgacatgattgggattcacgcgaacacgggagccgtccacacggacttcctgatgtttcggatcgacgcgagtgcccaattcggtaacaagctcgccgtcgatttcgacacgtccttcagtaatgatctcttcacatttgcgacgggatccgaatcctgcctgagcaagaagcttctgcagacggataccttcattatcgtgtgtgtgcgccttcgcggcgcgggaatatgcgtttggcatcgttctcccaacgtggccggataatacttatagggactgctggtactatggcagtcgtttggcgatttcccaaaatcgcaacttgtccactatatgacagaggaaagactatgactgctgttgaagcaacgcccataaccaaggaagaacaaagcaagccgttgacacttcgtgtcggagcggaacttgtgggaagcttcatcatttgcttcgcgatttatgcgatctgctcgcttggttccgcggtgtatggcattaacatggcgttcatcgccctgttgacgggcatcgtatacgccgccgtcaccgtaatcttcggttccatttccggagcacagttcaatccggccgtatccgtcgccgccatgctcactggcaaaacccacgtgcttgatggcattctgtacatcattgcccaagtgctcggcggtatcggcgcgggtgccgctatccggttccttctgccgacttccgagcaggtgacattcaagatctggatgacaccaacggtcaacggtttcgataagaattccgtctcctactccaccctcggcaattatggagtgaccctcggcatcactctggccatcgccgttgaagtcgtcgcaggtatcattatcgttgcctccgcactgcgcaccacggacggacacggcgagtccaaaacaaaccacgccgttgccatgggccttgcctacggcatcggcaccgctatcacctatccggtgaccggagccgcactgaatccggcacgtgccacgggcattgccattttcgcacagaatcaaggactgaatgaagagccgctgcaacagctgtgggtcttctggatttgccctgttcttgccgctgcagttgttgctctcgtcgtcatcgtcgccggcatgattggtacgaagaagaacgtgccggatactgtcgagaccatcgataaggtcgaaggcaataccgttcttggcgaagcgtcagttgccgacgggaacgatggtgagcaggatgaacagtcctacgcccaagccaatgccgatgaaagcgtcgaaagcaactgaccgaaccttccatggactgcgctcacgcaatgccagtctgaccagtccagtcgctatggccgtcaccgcaatcgcagcggtggcggcttttgtatatcctgcgaccgcaagcaccgtcgcaacaatcactaccgcggcgacgatccattcgaaccacggtttgccctcatgatcttcggaaacgtaaggatggctcattccggggcctttcatcttgcttgctgtacaacaaccgtaatcataataaaacgtggcgtccgaaaccaatacggaatcggacgccacgttgaccaataccctcacatgagaggcggcgtatcagtggaagaagtgacgggtgccggtcacatacatggtgacgccggccttacgagccgcttcgaacacttcctcgtcgcgaatggaaccgcccggctgaacgatagccttaacgcctgcattgatgagaatttccgcaccatccgcgaatgggaagaacgcgtcggatgcagcgacagcgcccttggtgcggtttgcgccatcagccagcgtgttggcgcgttcgacggacaggttcgcggaatcgacacgattcacctgacccatgccaatgccaacagtggcctgatcgtgggcgatcaggatagcgttcgacttgacacagcggatggcccgccaagcgaaaaccagatccttgacggtctgctcatcagcaggctcgccggaaaccagtttccaagcgttcggatcgtcgcccggagcatcgataagatccgtggactgcaccaacagaccgccgtcgatctgacggaactgcgtcttggacttcggcggctcggaaaccttcagaatgcgcaggttctttttcttggtctgcagcagttcgagagcgtcggcatcatagtcgggagcaacaatcacctcggtgaaaatcgggcggacgctttccgccatttccatggtgaccttgctgttcgcggcgatcacaccgccataggcgctcatcggatcacaggcatgtgccttcttgtgcgcttccgcaacagtggcgccaacggcgaggccgcacggattgttgtgcttgaccacggcgacggcaatctggggagcaaaatcccatacggcacgccaagcagcatcagcatcaacatagttgttgtagctcatcggcttgccaccgagctgttcggcatgcgcgaaaccatcctggttcagcggatccagatacagcgcggcctgctggtggggattctcaccgtaacgcagcacgtgggcacggtcccaagtacgagtgaatgcggccgggaacttggtctcattcacttccggctcgtcttcggcggttggctgctcaacggtcaaaggcttcggccagtgctttgcagtccactcgttaatggtggcatcgtaggcggcagtatgggcgaacgccttgccggccagccaacgacgttcttcgagagagaagccctctccgttttcgatgcgcgcagctaccagtgcgtaatcgttcggatcggtgatgatggccacagtggcgctgttcttggccgcaccgcgaaccatggacggaccaccgatgtcgatcttctcgatggtggcagcctcatccgcgccagaacgaaccgtatcggcgaatggatacaggttgacgaccaccagatcgaacggcttgatgccgaacttttccagctgtgccgcgtggtcctcattggtcatgtcagcgagaatgcccgcgtggatatgcgggtcgagggttttgacgcgaccgtcaaggcactccggaaagccggttacttccgagacttccgtcaccttgacgccaagttccgcaagacgcttcgcagtggaaccagtggaaaccacttcagtgccggccttgatgaacgcttcggcaagaacctcgatgccttccttatggaagaccgataccagagctcgccgtatcggtcgattcgttgttgtcaccctgatcctccttgttattgatggttgaggtcactgtgcgggccgcatttgcgacctcacgattatctgattcaagagccgcagtggacgcaccactcctgctctcgcggacacgctttactatccagcgtattccaaaaaacatggatacggccaccaaagtcagcagccatgacgaaaacagtcccacggcagtaggctgtccaatcttacgggtcgatgaaatcacgtcgacgccgatgtgcgcaagatgttttgagcccaacgctccactagagatggcaaaaagcagactcgaacataccgatacaacggtgcaggaaatgcagaacgctcccgctggataggcaaagccaagcactaccctcttgacatcaatctgctgatcggagttgcctactctgatatgaaagcccttgttgaacagcatgaccaccatgcccgcggcacaagctaaagccaaaggaacgcacatcaacgcgatccgaatccaattcgtttcaatcgcttgaggaagcaaaccgaatatcggcagagacggcaatgccgacccctgaccgctccacatggtgaattccgctagatcgccaatcgaaaaaccagccccgaatacccaggaaatagcccaaatcgcgatatttggaatccaagcgatcatggcgatcgtggtgaggatgcgagaaccgttctgcattcccgatagctcatacaacttcaccatggccgactggttgctgaatgcccagtacaagaccacaatcagtccaatgaccagatagaccgtgatcaacagcacacccaaggcaacaccaatggtgacggttttacggaccggagacgaaacatgctcgctgatccaatccaaatctcgtttgatcagtggtgattcgggaatcgcggcaatggcatagccaagtacaaagacgatcgctgttttcacagcaaccacgcccgtcgtatcaacgagtttgatgtcaaggctattggcgaagaacacattgatcaacacccagcctatggttcctgccacgcatccggacagactcgttccgacgcgtttggcgagcgatgcgataagagcgatcagcaaaaccgtaagcagcaacggcataatcgtcaaagtgatggatccggttttgaaaccgttcccttggctgagaagcacaaccgcctcggtcaaggaaacagagaaggcggagagattgtcgccgccttcttccatggaaataaccagaagcatcagcgcaatgtagcagcctagggcaccggcatagacgaccatggacaatgccgccacggcaagccccttcaaccaatacttcaggttcgccatcatatcgacttggaagcgagcacctcgcgcatgatttcagcggtctgccccggagtgcgtccgacacgaatacccacggcttcgagcgcttcccgttatattggttttgcggtggtcatggcccaggtgagacgcccggtccctttccgaacccggaagctaaggcctggtcgcggcgatggtactgcactcgagagggtgtgggagagtagcacgccgccgcattcaacttatggaccttccggtcgagccccatcggggttcccggaaggtccttttttattcccgcgcacgggtgtcttcctccattcggtggagggaaacggacgccggaaggcccgtgggcgggaggattgttccagtgagtggaggaatcgggactactgctgattcaaccaggcgtggagtttcagatgattgagcgcggtattgggatcatacgtatcatccaagcgttcctgatacatggcaaccagttcgtcgctgcgtcccagcgcttccaaagcggcctcgcgaatcgtctcccactcgtagggcaccacttcttcggggaacatcatcgtgacctgattaggtttgtcccgcaacaccagatcgacaaaatcgagcagatcctgccaacgttcggcagcaatcagacgtgccgcatacgcatcggcgagcggttcggaagtatgattgtcacgcaggaaacgatcagcctcatcaatgtcaccactaatccgcagcaagtcatgtcgcaaaaactgtacggcatgatcgaactgattctgcgcggcctgcgcaatctccttttctgaaagcaaagcaggatcaagcatcgcgagattattcaaatcttctgcggataaggaatcagcgtcttcaaacaaacccaaatcggttttcacttgcgcaacagactgcgaatcagtttgcatgtcgcggctgtcggaatcatctgccgagtttgccaacgtcgaagcagacgtggcgaaatcactcatcgtggcaatgcccttattcaacgcatcgtaagcgaacatgcgcgtatcgtcccattgcgcgaacgacaggccgcacgaaagcagttcaaccatctgcatggcgttaagacggaaatcctcattgcaggccacttgcgtgatgatattcagcgcctgttcgccggtcatgggatcggcattgcaggccacggcgtccatgtacacgcgcacggtctgaatcaggtctttcaaatagtcgaagccctcattgtctcgatctgcgacgttgccaacgaatcgcgcggtcatttccactgccttggcgagattgccgacagcatccagccaacgtgtgcttacgatggcattgccgaccaccgcgtccacgccggaaagcgcctgcgaatcaagatggaacgttggcatgtcgattcttggaatctccacgccggtatcggtgcgttcggctgtgggcaccatggcggcgatggaatcgaaataccattgcatgggcatactgattaccatgtccgcgtcggaaagctgtgctacgggcacattattgcggttttcggcatcttcctgactggcctcgcggatcatgtcgttccataggaacgtcgggccgtcggattcgccggaatgcagccatccattgttgatgtactcggtgagatcctcgacttcctgcagacggttgatcctaccgtgttcgttgctcattgcatgcctttcctttaaaaacatggattgcatgtgccgcgttgacgacgggtgcttcgtggaacaagacatatccttattcagcctatatcatgctgccgttgtcgcgcatgtttttttgctcttttcacggcgaaaagccgatgattttgaatagtcgcttgaatgctgttgcatttctttttgattgagcgaaaagattatgccgaaatactgtgtgaaacgatgtgtgaaacatgatttggaatgagcggcatggccgtacggcggcgcccggtagaatggcagtgttgccgcaacagggcggctttccatcgaaggaaaagggaatgatatgaaggttgcaagcggtaatgttctgtggcgtcagcgcaagcgtaattggtgtcgtacgccgttcacgttcaccgtgtacatgctcactgatcaggaaatgagcatcaaaaccggcatccttaacgagaaattcaatctcatcaaactattccgcatcgtggatattagtgtggagcgcacgttcctgcagcgcctgttcggtttgagcacgctggtacttgatacgcgcgaccagtcttccggcaacggtgttgtggtactgaagaacgtggtgcatggttttgaggttcgccgggtgatgcaggaggccgtggactcatcccgtaaggaaaatggcatgtcagcgcgcgaattcctcggaggtccgggcggtccggggccggaaggacctggcatgggattcgatgcgcctgatatgggcgatttgtagagacgcgtggtagtttcgtttcagcgcatacgaaaggcgcttgacttgagctggtttttctggctcgagccaagcgcctttctttttctggagagtaccgccgcggcggtatgggaatcgttatatgtcctatggggcgctcatacaacgtcctctggggcggtcagtacttgttggcgccgctgccgacgaagttgacctggaagccgcggtggtagtgcaggaacatgtcggcgccgtagcggtcgacagggcggtgggtgaacagcatacggatggcgaaagcggtctgcacgtcttccggcaggttcatgaattccttgtgcgcatcccaatacgggttcatggtgatggctgcgtccggcacataggcgtagccgtaaccgtcttcgttcacgtagcccatgaacggcaggtcccaagcgttatgcgcggtgagggctgccttgaattcctccacctgagcgagggcttcgtcgctgatgccgaggctcttggcaacctcgttggctgcggcggtcttggcgtccgcgtcctggccgaacatgttcagatccacgttgatgacggtcttttcatctgccatgatgaattcctttcctgcgatgtgttcgcataatgtcatgaacatcagtagtgttcgttttaatgttcgtttagataagcaaacgaacatcatttcttgaagtctggttcatgttgttgatggatgcttgctgtatccgtgactaacgatagcacgcttttttagctgtgataccgcggaaaatactgtttttgcaattgatgatgctgggaatcgttgatgttgcaatgattgcaggtcttgaaaatgacattgtaaaaagtaacattgagcgtgttctttttgttctgcaaaaacatgttacttttctgttcaaacgaacatctgcatatgattgtagggtggattgcacgtgtgaaaaggtggtttgaaaaggcttgagcgatcatcgacgatgcactgtgtcactttttgcggatgaggtgacattttccatgtctgaggcgtggcggccgtcggttcaacaatgacttttcgccacgtcagcaattttctggaactagaatgctgggttgccggtgaggtgacggtagagttcggggtcaaccggtttcgcgagtttcagtgtggaaatcacgacctttgattgggttccgtcatctgcgatattcactgactcatgcgcatcgtctacagctactgccgaaccgacataatagtaggatttctccttttcctcggccttacgtcgaataaaaatgggaacaaaatgacgattcttccattccgacgtatgctcggttccatcaagcagccatttgaattccagagattgcaaagaacgattgtttttgctgaaccattcaatttctccaggattcaagaaacgatcgccatactggcttgcctcatatttaatgaagatcggcaaagaattcgtgtcggtgtcaagcttatatccgcccacattctgcggaatctgctcatccttccacgcgcacaatcgcatgacatcggcaagactatatttctcgccatatatgaacccatgatccggcatgatgcgacgcttgcgagcttcccttgacagtgcaagcgcattgaacaagctggcttcgatggtatctgtaaagaacgttcggaatgttgcgtgatgcagcattgactcgcattcctgggtcaatgcatacgattcattgtcgcgcatacaaaccaaagaagtattgccgaaacgagtgcgattcgcacttgtgaaatacgaataattcaacgtggaaaaagcagaaccgcactgctgaatattattatcgacatacggaaacagcgtagacaataatgtttgcaaatcaaacaaactcaagctgtgctgtgtggaaaaacgttcaaacagtaacgcatcatcgttggaacaatccggattgatgcgacgccaatccaaatcgcacaacaccgcaagaatcagcgactcatgcgggcgcaaaccacgcaactgagttgcagccaacattttcagcacaccagactgcgcgtttgacaccggttcaagctgctccacatacgaagccgacgcatgcttgccgcgcgacagactcttctcacgagagaccacgaacgacagataatcgttattcttcgaagccaacgtgaacactaaagacgcatcgcgatgcgcgaaatccatcagcatcggaatacgacccaactcatagcgcatctgctgatactgcttgctcagcagcttcatatccgacaaatcagcggtatcgagtgacgcgagcacgcgctcgcgggcgattttatcgaaactgatcgaagaaatgccgatggactcgcgttgaagattcttacgggccacatcacgatcgccagtattgccatacaatgcgatcggaatcaaataattattggcgtaattgccaataaaatcaatcactacaaccgaatctttaccgcttgccttacgtaaacctcggccgagctgctgtgtgaaaataatgctcgactgcgtttgacgaagcataacaatttggttgatatgaggaatatccacaccttcattgaataaatcaacggtgaagatatagtcaagttcgccattttcagctgtttgacagcttcgtcacgttcggcttgcgagttttcgccggtaatggctttcgtgcgatacggtcgttccacctgctgattcacctgctcgttgaacatggcggacagacgtttcgcctcatcacggcgagagcagaacaccaaaccgcgcacatcggttccggcttcgctgtaaatctggattttgtcgatgatatagcgcacgcgattagggtcggtgagctgttcgagccaacgggaaaactcagtgcgatccttgtctgtcatggaatcagcggaaacctgctgccccataaacttgctaatgtattcgccaaccccgtaatagtgggacgggcagagcatatcctcttcaagcgcctgctgcaagcgaatctcatacgcaacgttattgccaaataattcaactgatttcgccaaggattctcccgtctctaagcggagcgtaggcgggagatgaattggcgtgcgttcgcatgttataatgatgttcagtcgtacatgttgtaatcgaggaggtgacaatggaattggagtcgaatcatcattcggtgttcctgttgcattatcatctcgtgctcgtcgtgaaataccgtcgcaaggtgttcgacgatatcgtttcggcgcgtgcgcgtgagatattcgagtacatcgcacccaagtatgggataaccgtggaggaatggaaccacgacatggaccacgtgcatgtattgttccgcgcccagccgaagagtgagttgagcaagttcatcaacgcttacaagagcgcgtcgagtcgtctgctcaagcaggagtttccgcagattcggcagaaactgtggaaggagtatttctggagccgcagcttctgcctgctgaccacgggcggcgctcccatcgaagtggtacgacgctacatcgagaatcagggacgcaggtaggaggcgcgtcatgcaggtcacacggcattgcgcggtcacgtaccgcatctacccggacaaggcccaggccggtctcatcgaccggacgatagggtgcgcgcgactcgtctacaatctcatgctcgaaacccgcatcgacacgtacaatcgcaccggcaagtcatgcaaccccacgcccgcccagtacaaggacgagtatccgttcctacgcgaagtggacagtctcgcactatgcaacgcccaattgaacgtggcgaaggcgtacaacaatttcttccgcgaccccaagcatgtgggcttcccgaaatacaaggcgaagcatcgcagcgcatggcggtacacgacgaacaacaacaaccgcaacatcctgtatttcgtcaaattgaggtggacgtgttcggcacttaatctggacaccgtcggcgttcaacttgaacaccgtcgttcggtgttttccatcacttccaccacggatgaccagcagtccaagcgtctgctggtgttccgccaggattccgcacgtcagaactacaagttgtggggtgtggcacgactgttttcgggcgtgaaaatgccgagttttgagatttccaaaaccggtagcgagcagggaacggaaaaagacaccggtctggtcatgaccccgaaggatgcggtcgccgcgtatgccgacgtgttgcagaatggtgcgtccagccagtatgcgcagaagtttgccgacgacgatttgcgtacgaagcttgccgatctgaccgaacaggtgcagaaggccatggagttgaacgagggatcgcagcagcaggtgttcacaccggttgacgatgccatcagcgttatgcgttccgcggatggtggcgatctggtggtggcgcagatcaattccgaatggacgcgttcagctggctccggccgtgagtcgcagcccgcttccgatgcggaaaaagcgctgtttggcgacggtcaggccaccagcaccatgaaaaccacgtatgtgaatgtggtcgcgctgtacgtgcctccggcaaattctgacgcgaagatcactgcagtcggttccgagcgccagccggttcgtgttgaggcactgtgatcgtggcagtcgcacgaatgcgcgtaagcttggggcgaacgtttgcaatgcgtgttacgccgggcgcttaatgttgttgattgttgatatctaggaggcaagcatggcaggtcaaaggccgtttaatccgggagtttccttggcgggagccgtcgatcttgaagcgttgaagcatcaggtgaaggctgagccggggcaggctggaggcgctccggccgcaggcggttatgtgatcgacaccacggagaacacgttccaggccatggtgcagacgtcggccacgttcccgatcctgttgctgctgtgggtgccgaccgatgatcgcctgttcgacatggcacgccagctgggcgatgccgtgaaccagctgaacggccagattcagctgtctcgtatcgatatcgcgtcgaattcgtcgatcgcgcaggcgttccaagtgcagggcgcgcctgcattgttcgcgttgatcaacggccgtccgatgccgattttgcagggcttgccgtccgctgaggaaatgcagcagatcgtggatacggtgattccgaatctggtcgcagccgcgcagcaggccggtgtgaccggttccgcgccgtattccggcgatccgaattccgatgcggcaaactcggcttccgctgccggcgcccaggagcaggtgcctccggagcatcaggaggcgtatatgctggcacagcagggcgattacgctggcgccgcagccgcgtacgagaaggtgcttgaagccgatccgaacgatgcgcgtgccgcccgcgagcgtgcgaaggcgttgctgttggcccgttccgccaatgcgaacgtgcgtgaggtgcgtgccgccgctgccgacaatcccgatgatgttgaagcacagcttgccgtcgctgacattgatatgatcggcggtcagattcaggatgcgttcgatcgtttgctggatttcgttgcggccggccataaggccgatattgaaccggtgcgcaagcgtctgctggaatatttcacgattcctgagccgaccgacgagcgtttgaagcgcgcccgccgtcgcctcgccacgctcatgtactgactcgtttattgactttaggtaccgtttaggtaccgctcaaccgtaggctgcgcaactacatcgttctttacggcctacggttgttttttttaaaaaaagacttattccatacggttggtgccgaaatagtcgaggaattgcggtccgtctgcttccagttcgtcttcgaattcggatttccatcgtgaatatggattcgcggcaagcccttcattgctgaaccgcgattggtcggtgatttcggtggtgcagaatttcgggatcaccagattggtgaccggcccgatacgttccgcttccgcaatgatcaggggagcgttggtgcctccgaacacgtcgatgttccagccgtcctcatcgatccagtcggtgaaacggtttttgatggtcacgtgtccgccgcgtttgatgagctcccctgcgatgcgcgaatccaaatcgcggctcgcctcatatcgcgtgcctcccacggacggccctttcacggtgactgatccaagccggaattcgtcgcgatacttttcgagcacagccagcgggtcgaggtccggagtcatggcaatgcggacggactttgttttcaatcgcacgcgcagcgcgtaattatcctgatgcacgtaataactttgtatgatcagcgtcggactgtcgttatcatccaactgcgtcggcagggcacggcagaaaaaacggcgcgtgtattcgaaatcgcctatatttctgcctgaatcctcaaccatattttcagtttagtggaaaagacgcttcaaatggtgttatgttgctacaaatttcgttgtggcgcacgctatctctcgttccttccccgttctatgcccgttatttcccctctagggttgggtgtgctgtcgaaagacccgccgtagctatgttttcgcaataatgatccgagattcgaagatcgtttttccgtaaaaagtgtcgctttcatctcaaggcagtgtaaagtagtttgacgcacgggtttgtagctcagtggatagagcgtctgtctccggaacagaaggtcgtgggttcgatccccatcaagcccaccacaaagacaagtgaagagccggggcagggagccggtatttggaacatggggcgatgcgtgtcgattccatgggtacagtgattgcttgagattgcgttgtcgtggtttgccgcggcctgaacgcaagcaacatgcataacacattcttcaaaggagaacattatgagcgagaagatggaagcggttgcgacttctgaagccccggcggcgctgggcgcatacagccaggccgtgaaggccaacggtttcgtgttcgtctccggccagctgggcatcgacccggccaccggcgaactggctggcgaaaccgccggcgagcaggcagcccaggcactgaagaacatcaagcatattcttgacgccgcaggcaccggcatcgaacacgtctgccgcgccaccatctacatgaagaacgtcgaagacttccacgagatcgacgacgtgtatgcgcagaccttcatcggctccgtgaagccggcccgcgtcgcgttcggcggcaacaacattccgaagggcgctctcgttgagatcgacgccatcgctgtgctctgatttcagtgcgctgattgcaaatctccagaaaatcctttttcaggctcgtatgcggtttcttacgctgcatgcgagcctgtttttgtttatgcaatctcaggattgccgctaaaagtgaacggcaggcaacatgattccaccgatttccgtatagtaatgcgattgggtattgtgcaaacgcatgcaaacgcaagaacgcaagaacgcgcccatccaaatatgaaggagcagtcgcgcatggccgaatcgcaagtcaacgcatccactgcagacactgacgccgctgaatccgctgaagccgagcagggcggtcttgaacgcaagatggaaacccgccatctgaccatgatttcgctaggtggtgtgatcggtacgggcttgttcctcagctccggctacacgattcaccaagccggccctcttggcgcgatcatcgcgtatggcatcggatccatgcttgtgtattttgtgatgctcagccttggcgaactgtcggtggccatgccgtatgcgggcagctttcacctgtatgcgaagcgtttcatcggccccggcaccgcgttcaccatcgccgtgctgtactggctgaattgggcggtggcgctcgcttcggaattcacggcagccggtctgctgatgcaacgttggtttcctgattcgcccgcgtggatttggtccgccgccttcattgcggtggtgttcatgctcaatattctgtcggtgaggctgtatggcgagtcggaattctggttcgcatccattaaggtgtttgcgattatcgtgttcattgtgatcggcttgcttgccatgtttggtgcgattccgattgccggttacgatcacgcaccgctgtttgagaatttctataatgacggctggctccccaatggtgtgatcccgattttttcgacgctgctgacggtggtgttcgcattttcgggcactgaggttgttggtgtcgcggcgggggagacgaaggatccggcgcaggcgattccgaaggccgtgcataccacggtgttgcgtcttgcgattttcttcatcggttcgattggcgatccacacgccagtcgtagtcaggcgtttgcgcattcaacgatacggttcccgcaacgagtccgattttgccgccgcccgtcggcgaatcgatgaccaacggctcatacgaatccttttcggttttataggaaccggtttgcgctatgccgtcctgttcaagcgtgtcccacaaacgtgcgatgccgtcggcaccttgatcccaagaatgattcgaagcatgagtgcaggcatgatatcccacatttttcgcggcatcggccacttctggaggaatattgaaaatcggataggcggaatatggaccgccacgttgtgcgataggtgtttcgaattcacatacggcgatgtcggaagcttcgatatatttgcgcatcggttcgaacagaccggtgaaatcaaatgcggtgccgtcggtggccgcggtgttggcgctggcatactggttccacaatccctcatggaacagcagatcaccgttgacaagcatggcgatgcaatcggtatcgggacaatctggggaattgccatgatgctccgcaggttcggtcacttgtttcttttcaaccgtttttggctcgctcaccgttgttgccggcttcgtatcggcatcactctgctttgattgaaggctatgcaccagcagccatattcccgcaacaagcacgacggcaagcacggccaacgccgcaaacgcgagcctgcgtcgaccggccgcaagcacttccgtgttggttgcgtgcactgcctcttttctgtatttcacggcaccccgccttcctctgaaaccttctcaactcttcaattcaagaataacggacgcaccacggtttctacactccgaagctggcgatgttgttgccgtatttttgacgcaccgcatccagtgccgcttccgcaccacgcaaacgttttgcgtgggtccgcatttgcgcaggttttgcctgaaccgccgcatgccgttcggcttcgttttcctccagcagatcatccagtgagggctggatcgcagtctcttcggcaagcacaagtccactggcgctcattcccgccaaacgcacgggtcgagcaagggaaatggcatgcacggactccggaaccatgcccatcatggcgagcagcaggtctacgcattgcgggtaaagcacgctcgccgcgtccgtagggcagtccagcgtgcgccctttcgtcgcataactcaagtccggaaatcggagtttgaccatgaccttgcgtgcgaggaaaccacgcttacgcaacgatgtagccacgtcatcgcaacaccagcgaagcatagaacacacctgtcgcatgtcttgtgtgtctgcttcgaaggtgcgttccgcaccaatcgatttttcctgcgtgtatggcacgacgggcctatcgtccaggcctcgggacgcctgatacaggccgtgtgcggagatagcagatccggtggcccgctccagagattcgagactcatgcgtgcaaggtcggcgaccgagtcgatgccccacgcgttcagacgcttttccagagaaggtccgatgccgggaatgccacgcaatggcatcatctgcacgaattgcgcatgccgcgccacgggaatcatcaacatgccgttgggcttggcattggtggatgccattttggcgaccagcttgttcgccgcgatgccgacggaacaggtgatgttgtagcgcaaggccacctgttcacgtatccacgctccaatggcactgggactgccccaccgcagcaatgctccggaaacgtccatatagcattcgtcaaccgatacctgttcgatgcggccggtaatccgactgagcacttccttgaaaatgcgatgcgacatcgcgcgatagtaactcatgtcgaccggaaggaaaatgccgttcgggcatagcttttgcgccctggaacttgccatggccgagttgatgccgtattgccgtgcctcgtagctggccgcggacaccaccgaacgattgcccacgccgatgatcaccggcctgccacggtattccgggtgccgggccacttccaaagacgcatagaaagcatccatgtcgatatgcagcaccgtgcacccagcctcgtcatggccccagtcacgtttggctgctgcgattctcggtgcggtactcatgattccatgatagctgttttttcacgttcctttgaaacaaatgttcgaatatcgcagtttatcttatgaaaacggcgtgtcgacagttgcgatttcataaggcacgcacatgcatacagcacggatttttcccgatatttcaacgttctttcatctttttttcgagatatggtgttttgcccgcaaatggatggtatagttgcatgctgttgcgccgtgaaaacggtaaaacagtggagtcatgcctgagtggccgataggggcaccctgctaaggtgttagtcgtttttagcggctcgagggttcgaatccctctgactccgccttgagggttttcggagaaatccggaagcccttttttcatgccaaaacgatggaataccaacgatttcaaggcatccaaacgcgacgatacacatgggcgacgccatgaccgacatgctcaaacagcagataaacggcaaggctcctaccgactacgtgatatccgcacgacgccgaacagggtctttaatggcccgagcctccgcgagacgccaccgacgaaccagacgacggaaacggtgaaaagtcggataatcagtctcgaaatcctcctgcacgcgcaacggcaaaccattatgcgacagggacgatccataaagaccgtccctgtttacatatcagtatttatacatcaacggcatgccgtcacaggccgaatgcttttcgatccgtttcggtaagccaatccgtccgcatgcccggtttttggcacaaatgcatggctgggcattcctcaccgatgcaaggatcccatacaggaagcggcgttccgtcacggtccgttccgttgggatcgccattggcggcgaaattggtccaatacagccccattcgccttgccagatcgtaatgccatccaacgaacggacgccagcatttcgcaaggcttccaaaggagaaccacagatcggacgagtggaaggctccggcatcatcccccggcatagcgacatcgaaatgatagtagtatggcgcggtcccaccgcttgcggtccatttgcggatcaacgtgagattgccgagctgtccgacatgcacaggcttcccatcttcagtcgaagcgatgaactcattggtcgtgttgccgaccagcatgtcgacgttgttggccttgcagccctcgacgatacgctcctcctgatcgggaaggaacaggccgtccacgcatggcacccaattgacaatcatcgaccagtcatcttcacgtccgctgtccggtggaacaggcagggactcggcggcttccaataccgttcgggccgggattgcacgggcctgctccagcgtggagacacccaatgcttcgaacagacggattccgttggcctgcgcatgctccagcgtgtcctgccgcgcattgaaataccctaagcctgcgccggattgcatgatggctttctgaaacaggccatgattcatcggcgagcagatctgggccaagacgctggcggcaccggccgattggccgaaaaccgtgatgttttccggatctccgccgaacttcgcgatgttttccttcacccattggattccggcacgctgatccaggaatccgaaattcgcatatggttcgccgtcgccgcgttctacggcctcctcatgaagcaaagggtgcgtcataaacccaaatgcattcagacgataggccacactgaccacaacgacgccgttcgcggcaagatgtgtgccgtcgaattccttttcaaatgtgccgccacattgataggctccgccgtagatccagaccatgaccggcagcttttcggaggctaccatgctatccgcgccatagctgcaatggcacgatgcgtttcgacgtgatcacgcacggcattgcggcgcattcggcgcgtgcgtggatgggtaggaacgccatccacgcggccgctgagattctgaaccggctgaacgcttatgaaaatcgtgcgattgaagtggatggcctgacgtatcaggaaggcctgaatgccacgctgatttcgggcggcaaaggtacgaatgtgatccccgacgaatgccgcgtgcatgtcaactaccgttttgcccccgacaagtcgttggctgaggcgaaggcgctgatgattggcgcggatgccggtgcggaattgggcaatggcgagcatgttgccacaggtggcgtattcgaaggcttcggcattgaaatgaaggacgagtcgccttccgcacgtccggggttgacgtcgccgctcgcgcagtcgctggtgaaattggtgcgcgagcgcacggggcgtgagcctctggccaagcttggctggacggatgtggcgcgattctcgatgctgggcattcccgcggtgaatctgggtgcgggcagtccgttgctggcgcacaagcatgacgagcagctgccggaatcggatctgctgctgatggccaacttgcttgaagactggctgaagtagctgtctgctgcctttttctgcctcctgtttctgcctgctatcggctgtttgttgttttccgtcttctgtctgcacaagtcggatcggctgtctgcacgagtcgtaatctgtgtctgcatttctcgcgaatcgtgatttctttcgacttgtgcagacggagcaacgacttgtgtagacggggcctgggatttgcgggcggggaaagcaggcggtgagttgcaggatccggaaaatttcccgtcatgtcacgttccgttgttttttgtgtcatacttatagacggtggttctgcaaatcaccaatgcatccgatggcgttgatcccctcgcgtgaagttcatgtgtgtccgcgagcgctggtgtccgccgtcgcatgatgaggacttttgacggaagttgcttcctacgggcgccatgatgcgcggccacggtgagagcgtggtgtgagaaccgtatgaggcctaagcgtgggcggcgcgattgcagcgtgtcgtcgaggagccattgtgcctaataccagtgagggcttcgatcaggtcgaagcttcggcatcgcctgagcatgccgtgaatgttgtgaaattcgagtcggtccagtccgatcctgccccgcgtcgccgtcgtggcggtcgtcgcgtggtgcgtggcgtgggagctgccggtgcgtccttggagttgaaggtcgaggagcatgcttcggctccgctgttcgaggagccgaagttgccggttgcgcaacctgcgcatgataccggtgattccgctgattccgagggtatgacccgtccgacccgtcgccgtcgtcgtccggtccagtccgatgatgatgttcgtgagattgccgacgaacggccgacgcgttctcgtcgccgtcgttcggtgcaggttgaggatgagcaggacgaggatcgtccgtcgcgtcgtcgcagccgtttcgccgatgatgcggatgagtacgatgagatgccgcgtcgtcgcgcttccgtcgatgattcccatgatgaggagtcgtctgtggagcgtgccttggatgccgtcgatatgttgccggaaggccatgaggtccgccacaatccgcgtccgatgatgtctctgcttttccaggagccggttttgccgtccgttgcggattcccgagacagggcagacgacgatcgcgacgattcccgtaatgaccgcggcgagcgtaatgatcgcaatacgcaggaccatgaggatgagcaggatgaggatcgtccgtcacgtcgccgtcgccgccgcaatcgcgacgttgccgacgaagagcgttccgaagacaatcgcaatgaacgcgataatcgggataatcgcaatgatgatgcggacaatgatgaggaaggcggatctcgcaagtcgcgtcgttcccgtcgtttgaacgcgcaggagcgtcgtgccgcagctgaagtcgaacagatcgaagaggatttgatcctcgacgatattacgtatgcgccgattgatgacgaaacccgcaatcgtcatgacgatgatgacgacgagcagccgacgcgcacccgtcgtcgccgtcgcagccgcggcaatcgtgaggaagccgacgaacagcagcgggatagcgatgaaggcgagtcccgtcgtcgccgtgaggacgatgacgaggatgaaggcacggtgacccgtcgccgtcgtcgccgtcgtggcggtgcgaagacggatgagacggaagagccgctcgtgcgtcgttcccgcaagcagcagtacatcgacgagatcaccgacgtcgaaggttccacccgacttgaggccaagaagcagcgtcgccgtgacaatcgccgtgagcgcagccgtcaaagccagctcatggagcaggacttcctggctcgccgcgagcatgtcgaccgcctgatggtggtgcgcgaacgcgaacgccacacgcagatttccgtgatcgaagacaatgtgctcgtcgaacattacgtgtccgacattcaggaagtcgccactgtgggcaacatctatctgggccgcgtgcagaacgtgctgccgagcatggaagccgcgttcgtcgacattggtcaggcgcgtaacggcgtgctctatgcgggtgaggtgaactgggattccgcacggttggaaggccagcctcgtcgcatcgaactcgcgttcaagtcgggggacccggtgctcgtgcaggtcaccaaggatccgatcggacataagggtgcgcgactgacctcgcaggtcacccttgcgggccgtttcctggtgctcgtgccatccggtggcatgacgggcgtgagccgcaagctcagcgagcgtgaacgttcccgcctgaagaacatcgtgtcgaaggtcgcgccgaaagacatgggcgtgatcattcgtaccgcagcggaaggcgcctccgaagaggcgatcaccaaggatcttgaaagcctggtgcgccagtgggaacgcatcacctccaagcgagacgaattcctgcacggcaagcgtccgaagctgctgcaaggcgagccggacgtggcgatccgcgtggtgcgagacatcttcaacgacgacttctccaagatgatcgttgaaggtgaccgcgtgtacggccgtatcgaggaatacctcgacaccatggctcccgacttgaaggacaagctcgaaaagtgggatccggccgaacatgaaggcaaagacgtgttcgacaagtggcagatcgactcccagctgcgcaagggcatggaacgtcaggtctacctgccgtcgggcggctcgatcgtgatcgaccgcaccgaagccatgaccaccatcgacgtgaataccggccgtttcatcggccgcggcaagagtcttgaggagacggtgacccgctgcaacctcgaagcttccgaagagatcgcacgtcagctgcgcctgcgtgacatcggcggcatggtgatgatcgacttcgtcgacatggtcatgccagccaaccgtgatctggtgctgcgcagactggtggaatgcctggcccgcgaccgcaccaagcatcaggtggccgaagtcacttcgcttggcctggtgcagatgacgcgaaagcgcatcggacagggcttggtggaggctttctccgaggaatgcccgacctgcaagggccgtggattcattcttcatgacgagccgaccgtgtccgcggattatgacgatccgtacgccctgaagggcggcgacccgttcgtcaaaaccaacacctgctaatcctgcccccagcgtgtccgattctgaagaatcggacatccaagcgcctcaaaacatgttccagttgtccgattcaccagaaacggataaccggaacaccaaaacagacccacggttgtccgattctccagaatcggtcattcaagcaccccactttgacctgtagttgtccgattcgggagaaacggacattctggtactcaaaaacacatcctggttgtccaattcgggagaaacggacattcacgcgcccaaaagtacgttccagttgtccgattctccagaatcggacactcaaggcgacgaaaacgcgtaaaggccgttccgcgaaacttgcaatctgcggaacggcctttacgagcaaacaatttcaggactgcgctaccttgcgccccttggcgtcgatctcaccgtcgatacggcggaaaatccagttgtagatccacgcgcaacagtattgcggcaacgtgacgcccatcaaaatcagcagcggaatcatatatatgaaaaactgcgcatacagcacggcgaacgcggccaaaatcaccagcatgcacaaggtgcgcgggaaaaagccgagcgcaagtttcgtcgcattcttcaacgtttcggaagtcggattctcatagcgagaaagcagcgggaagaagtactgcgcaatcgcaataatcaccaatcccatgaacgcgacgcacgccatcagcggcccgcgcatcgaccccatggaccgggcgagcatgccgtcgaccaccagcacaatcgccgccagcaggaacgcaagccacggcagcagcgactgcttgagattgcgcttgaacgagtcgaaaaactggcgcgccacatacgtttcctcatggcggaccatgcgccagagcacactgtgcatcgcagtgaacgatgcgccggccgtgacgaccggcaggcagcacaacagcgtgagcacgttgagaataatcagatcgaacagcacgcccataatggcgaaaaacatgttgtcttgatcgaaaagctttgacatctttgacataagctcaccttacccgtttttgctgggatttcagctgattcccgggaaaattgttttcccgataagacgattgctcgaaaaaacgaaaatgcgaatcgtccttcctgaaggagaggtgacaggaaggacgattacagatttatggatttatgcgcggtcaggcagcgaccggatcaggcgaggctgaatcaggccacgaccggcggattggcgatcagatcgtccgtgcggtgctcaccggcggcatcacgccattcgagcgtggcgacggacgcggtgttctccacaccaagaccacggcccggctcaaacgtgagcgtggcctgagtggtcgtgccctcccacgtgaagctgatggacgtatcgccgtcggcgctgtacgagaaggtgccatcgaacgcatcaagctcgttgcggaacttggcaagcgcgttcagtgccttcaccaccggacgctgcagattctcgtcgatctcagccgtggaatagtaatggcgattgatatcgcggccattgttggtcttgcgcagcagctccatgtcgttcttgccggcaagcgcgccgacatagtagacctgcggaacgcccggcaggaagaactgcaccgcgcgagccgcaatatagtgctgatcgttgcatcccagcgccgaatagtaggtgctgttgacctgatacaggtcaagattggatgcggcggcaccggtagcggcctgcgattcgccgtgagtgttcgcatgaatggcgttgacgagattgtcgacatcctcatccggcacgagccccttgagcgaacggtccagctgatcggaaccgatgtcgatcacgccgatgccatcatgcgtgtcaagtacggtgacggcattgttcggacggatgtcggtccaatgcgcgaccggctcgacatgaccggtattcagcgaatgcagcagcagcggcggaagggcgaaatcgtagacgcgatcgaccttcgacgcgatctcgacctgcttcttgtagtaggaatgcacttcgatgaggatttccaagccgcgcttgacgccctcctcacgcaggcgggagatgagcttgaacgttttcggcgtcatgaagcagctggtaccggcttccttggcaccgtagccgacggcgtcaagacgaatgtagctgacgtgggatgcggccatctggtcgaaaatcgacatcaggtattcccagcctttgtcggaatccgtgtcgatatcgacctgctgcggggtgaagctgacccagaccaggcgagtcttgcccgcgaacttgtagtgggtgaacggcagacccgggcgcggacggtagatgccggccagatcctcttcggtcgcgccgttcggaaagacggaactcatggtcaggaacatcgggtaatactcggattcctcgcccttttcaagcacgtcttggaactgcttggattcccagctcatgtggttgacgatggcgtcgaccatgatgccgtgggtcttggaaagttcggcgacatcgtcccagccgccgaggcgcgggtcgaccttggtgtggtcgatggggtcgaagcctgcatccgcgccgtcgaatggagtgaagaacggcaggatatgcacgccgtcatacacgccgtcgaaacgggtgcgcaggatgtcggtcatcgagctgagggtgccgtcgccgaggcgatcggcgtaggtgatgagctgcactttgtttttcatgggacctcccttggttcatgggtgcgggtgcaatgtgtgcgcgtctgcctgtttgttgtttacgtatttgcatactcacgtatgtatcgaacaggttcgatattacctcgagaggggcgtcaatgtccagtcacacagcggaatgcgcgtgtcgaaccggtttgatgcggtgttctatgcagcccagcctgtccgaccccaacccagcgttccaacgcgcagcatcaacgcgtggtatcgcctggcaccagcgtcatgggaataagcacattcggctcgaacggcttggggatgttcttgcgcgaggcgttggccgcagccgcctcttcattggcgatcgcctgcaccatatggtcggccgccgactgcgcgatcgccgagaaatcctgtgcgaccgcggtcagcttcataccggccaaatcggtcaaatacgtgccatcataggcgacgacctgcagctcgtcaggaatggaaattccgcggctcaacgcttcgcgcacgcagaacgccgcgccaatatcggagctgaccacggcatcgacgccgtcggtcgccactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccaccagggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctccctcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaaccctaatgatagcttcaaacgccagacgacaaatcatcacactgtaaaaaatgatcacaaaacgatcgatctcgaaaccagactccaaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccgccaggggcatccggaaaaccgcacgcacccaaaacggatgcgggtggcggtccgggaacccaaaagcatacccataccactccccgcaaggcccccaagaggaacccgcgaagcccatgacctcttccacgccagcacgcccacaccctccggagacgatccccggcgcatgggccacacgacggacgccggaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactcgatgatgaccagcccggccctgcctatcgacttgagctcggcgtccaatctgttgtcgtccttggccttcctcaaccgcatgaccaggctggaggcggtgaagaacctcacgggtatcatgcgttggcatgcgagcatgccgatcgcgatggcgaggtgggtcttgccgcagccgacgtcgccgtagagcacgaggtcctcggcccggtcgacgaattccaggctttccagctgttcgcggccccagtcggcgggaaacgaggccatgctccagtcgtatccctccagggtcttgctctgggggaacccggcctgtttgagcagccgccgccgtttggattcggcccggctcgcgttctccttctcgaacaggttggccaggaagccgagctggccgggcgtggcgtcctccagggccttctcgagcacgctgtgtgtcaacggcaggttgcgggcgaggcccatgacctgttccggcgtggccttgtcaagaacgcggccgccgcgctgccgcggtttttgctggctcattcggcctccttcatgtatttgtcgtaacgcttcaaatcctgcccgccttcggttcccgcaccctcgaggatgcgtttggcacatgtgccgatcgccgcgcggtcgacggtccgtcccgcgttgatgacggtttccaccgctttggccgtggcagcgaacccgcagtcggcggcaacggctcggatgtcgtcgagcagattggagcgcgtgcgtgcgtccatgcggtcgagcagggctcgcacggtttcggggaaatcgttcctgatcgggctttcgccccatatgcggggctttcgcgcgatgatcgcgagcaggctcgccggatccacctgggttttcgccgaatggccccagatcctctccagcgtggtgatcgtttcgccgtcggggccccgcagttcgatctcgaagacgcgcaccccggcctgcaggcgcatggaacgccatttcggtccggccagataccggttcgcgtcgatcgtggcggcgccggtcttgtcggttttcacgctcctccagtcgcacgggtcgaaccgcacgccgggcaatggaagcatgtggtccttctccgcctcgaacagttcgatcaccggaacatcatgccggtagtgatccgatccggcgatgcgttcgcacgcgtcgagccacacgcgcgtcagcgtttggaagctctcggccgacggcatcggcaccatcaggttgcgcctgacgaagccgacggcgttctccacactgcccttctcatggccggaatacgggttgcagaaccgcggctcgaacccgtaatgcgcgcagaacagggagaacaagcgggtctgggtgaccgtgccgtccggcctgcgatggcccacgccggtggcgttgtcgaacaccaccaccctaggcgccatgcccatgcgctcgaagatccacagcaaaccctggcacacgcactccgaggtctcgccgggaagggcgaccacccagcgcatgttcgaatacgggaacgacaccaccaggaaatgcaccacgcgttcgactccggcgatcacggccctggcctggccgaaatcgacctgcgcgcttcccggcgcccactccaactcggcgaagccgtccgactccatgcgatgctcccgccgccagcgcttgacccagcgctgcaccgacgaatacgagcccgtgaacccgcactccgccacgagccgctcgtacacgcgcgtcgcggtgtggcgctgcttgacgggcatgcgcagatccgcggtcagccacccgtccacgacggccgaataccccgcgtcgaccagcgacctgcccgcatgccccgagccaaggggcttgggagagtaatccccgtggttggcgtacttgaccacggtcgtgcgcgatacgccgagtttccgcgatatctccctgtggctcaagccctggcggtcgagctgcctgatacgctgttgaacacacaccggtgtcgtcatttcctttcctcccgagaaccatcagtttggttgataagcactcgggaatctaccaaggaaccggacgatgtcattccttgacggcgcctgcggcaaggccggactgccagtacttctgcaggcacaggaacgcgatgaccaacgggacgatcgtgatcaacgaacccgtgaccaccaggttctggatcgcctgaccgccagcggtgctcgcctggtccttccactggttcagaccgatcgtcagcggataccagttcgaatccttcagcatgatcaacggcaggaagtagttgttccacgtcgccacgatcgtgaacagggccgtcgtcacgatccccggggcgagcagcggcagggatacctggaagaacgtgcggaactcgccggcgccgtccacgcgggcggcttcgagcagctcggtcggcacggcctggtcggagaagatccacatcagatacaaaccaaacgggctgatcaacgatggaatgatcatggcccacggggtgttcgtcaggttcagcttggcgaacagcaggaactgcggcacggccagggcgatgcccggcaccgagatggcgccgatgatcaccgcgaacacgaccttgcgtcccgggaaacggaacttcgccaggccgtacccgcccatgatggcgagcagggtcgcgccgccggcgcccacgaccacgtacaggatcgtgttcaggaaccagcgtccgaagatgccgtcctggtaggtgaacacggtcttgatgttgtcccacaaagcgaacgtgcggccgaagcccagaccgaacgtggacgtgaagtccgcctgcgtcttcgtggcgttgatcagcaggtacacgaacgggaacaggcagtacaccgcgaacagcgcgcacacgatggtcagcagcgtgctcctgcgcgggttcgccacgttcgcgaagccggacttcgcagccctcttgcgctcggccttctcgtcgcgcgcgaccctcttgaggcgttccttctcggcctttttcgcggccttctcctgggctttgagctcctgagcggtgagcctctgctccgtgcccgcggcgattgttgcgtcactcattttcgatgctccttagcgtttcttccccctatatgcggatggttcgcgccaccgggcgttacttcatctgctccttcatgctgttgagctgcaccgcgtacgcgatcgccatcgtgatcacggccatcgtgatcgccagggcggcggcgtagttcgactggttgcccgcgaagctcaggttgtacgcgtacatgttcggcgtgtagtacgtggtgatcgcgttgcccggcaccatgttctgcaggatgctcggctcgttgaacagctggaacgagccgatgatcgagaagatcaccgtgatcgcgagcgagcccttcagttccggcagcttgatggacttgacgatctgccactcggacgccccgtcgatcgaggcggcctcgtacagcgaatgcgggatcgtggacagcgagctgtagaagatcagcatgttgtagcccgtgaactcccacgtcacgatgttgccgatcgaagcgagcagcacgcttgggctcagcacgtcgaggttcgtgcccagccagtcattcagcgagccgaccagaccgtacttcgcaccgtacatgaagccccacaccaaagtcgacaccacggccggcaccgcgtacggcaggaacgtggagatgcggaagaacttcgcgccgtgcagcttcatggaatccaacgccagggccatcgccgccgacaggaacagcatgaccggcacctgcacgcaggtgaacagcgcgaccctgccgaccgagctccagaactgctggtcgtggaacaggcgaatgtagttgctgattcccacgaacttcgtgccgccgatcatctgcttctggaagaagctgatgtagatcgcgtacagaatcgggatcacgaacacgaacacgaacaccaacgcgaacggccacatgaacttccaaccacgccaatccgcatacgcttcgcaccggccacgttgaacggcagtgaaccgtcgttcttcagcaatgccacggcttcgcgagccacttcaaggttgagctgctgatgctcttcagaaccgatcactgcatcgatacgcttctggtcgggcaagcgtggatcttcgaacagtccaagacggaacttcagtgcgaggatacgagccacggcggcatcgatcaacgattcgtcaagcagaccggtcttcacggcttcgatcgcaccctcgtagaactttggcgtggtcatcaccaagtcattgccggacttgaccgcatcggcagcagcctgcacatagtcaggcttgaccttctgctcccacacggaacggccgacgttgtcccagtcggtgatgagcgtgccctgatagttccaagcgccacgcagtttgtcggaaagcagccacttgttgaaggtgaccggcacaccttcgatggattcgtagccgagcatgaaggtgccgcagccttccttggccacgcgttcaaacggcggcaggaaccaggattccagcttgcggtggctcaggtcggcttcggaagcgtcacgccctccctgtgtttcggaatagcctgcgaaatgcttggcgcatgcgaggatcgcgtctttggcgagcggctcgcccgccttagctccaccttgatagcccttgacaatggacgatgccatttcgccaatcaggtacggatcttcgccaaaggtttcgcccacgcggccccaacgggtgtctcgcgcgatgcacagcaccggggagaacgtccaatgcacgccggtggctgacacttcctcggcggtggcacggcccgcggcctgtaccttttcagaatcccacgtggttgccatgcctagctgttccgggaaaatggtggctcccggccagaaggaatagccgtgaatgcagtcgtcgccgatcaccagcggaatgccgagacgggttttggcgttcaccgtttccacggctttcggcagatcggaaggcgaggtgtgcagaatggaaccaacgtgcttgtcgacgatcagatcgtccaaatcgccgcttcgcgcgtcaagctgcatcatctgtccgactttttcctcaagggtcattcgaccaagcagatcggcgatgcgttcctcagtaggaagttccggattcctataaggcagatttacagtattttcagtggtttcggtcatggattgctcactttcctcattgaagcgattttctttaattaccaattggtagtttagtatatcatatgcacatccgcaactcgacataaacccgtcaacgcaaaaggcgagggaccatcagacctcaccctttcgcacgcgcatgcaatgccaatctcaacaagtattcaaaatcaacgatatcgaggggcgtcgccgcccgtaccccaaaccgacactggtggtcaggtagagaataccaaggcgatcgagcgaatcctggtcaaggaactcggcaaatcactcccgtgccttcggtataagggagacccccgggcgtgaagaggcttgccctcggagcgttggggggtggcacagaccagggggtagcgactgtttaccaaaaacacaggtgcatgcgaaggcgcaagccgctgtatatgcactgacgcctgcccggtgccggaaggttaagaggatccgtcagccccttttggggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcgcggattgtgtagcataggcgggaggcttcgaagcatgggcgccagcccgtgtggagccgcaaggtgaaataccgctctgttctcgtttgacgtctcacctcgaacagtcatcctgttcagggacagtgcctggcgggtagtttaactggggcggttgcctcccaaagagtaacggaggcgctcaaaggtccgctcagcccggttggcaatcgggtttcgagtgtaatcgcacaagcgggcttgactgcgagaacgacggttcgggcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacggacctctggtatgccg
